United States Patent 9,238,822 (COMPOSITIONS AND METHODS FOR CONTROL OF INSECT INFESTATIONS IN PLANTS) - sequence listing, part 5

SEQ ID NO: 13367 - DNA, 258 bp, Diabrotica virgifera
  misc_feature (7)..(27): n is a, c, g, or t
  misc_feature (37)..(37): n is a, c, g, or t
  misc_feature (42)..(77): n is a, c, g, or t
  misc_feature (80)..(94): n is a, c, g, or t
  misc_feature (101)..(101): n is a, c, g, or t
  misc_feature (110)..(110): n is a, c, g, or t
  misc_feature (133)..(161): n is a, c, g, or t
  misc_feature (163)..(208): n is a, c, g, or t
  misc_feature (212)..(235): n is a, c, g, or t
  misc_feature (237)..(257): n is a, c, g, or t
taatcannnnnnnnnnnnnnnnnnnnnggaatggaangggtnnnnnnnnnnnnnnnnnnnnnnnnnnnnnnnnnnnnggnnnnnnnnnnnnnnncgttaanaaggcttanatttttttacaagacgagagacnnnnnnnnnnnnnnnnnnnnnnnnnnnnngnnnnnnnnnnnnnnnnnnnnnnnnnnnnnnnnnnnnnnnnnnnnnnggcnnnnnnnnnnnnnnnnnnnnnnnncnnnnnnnnnnnnnnnnnnnnnc

SEQ ID NO: 13368 - DNA, 672 bp, Diabrotica virgifera
  misc_feature (89)..(120): n is a, c, g, or t
  misc_feature (144)..(168): n is a, c, g, or t
  misc_feature (209)..(241): n is a, c, g, or t
  misc_feature (281)..(303): n is a, c, g, or t
  misc_feature (311)..(333): n is a, c, g, or t
  misc_feature (449)..(478): n is a, c, g, or t
  misc_feature (496)..(520): n is a, c, g, or t
cgtccgcttagaataataacaatattatatacttaaggtaaagaaaaaatcatatttaatgaaatgaaattaacatagtattagaatannnnnnnnnnnnnnnnnnnnnnnnnnnnnnnngtatcgtgccttgcgcgtcgtagnnnnnnnnnnnnnnnnnnnnnnnnncttattatccaatatagaaaagccaacaaattaataattgnnnnnnnnnnnnnnnnnnnnnnnnnnnnnnnnngaaatgaaatgccattctatatatcacatatcttatcacnnnnnnnnnnnnnnnnnnnnnnncctcaacnnnnnnnnnnnnnnnnnnnnnnnttatctaaataatatattataaggtaagagctgatctaaaaaatcatattgaattacaatttccttataaaaattaagataagattgttacatatcataatatatgatatgatatnnnnnnnnnnnnnnnnnnnnnnnnnnnnnntcgaataaatattgaatnnnnnnnnnnnnnnnnnnnnnnnnngtacagcagagacgattatattagaataattgtatagttaatttacatacataaggtaagtataggaatgcgataccacaacattcacctcacctgtacatacaagtcctgtcgtattgtatgaaatgtctcgcctcccctgtgaattgatt

SEQ ID NO: 13369 - DNA, 1186 bp, Diabrotica virgifera
  misc_feature (694)..(712): n is a, c, g, or t
  misc_feature (937)..(1024): n is a, c, g, or t
  misc_feature (1026)..(1046): n is a, c, g, or t
  misc_feature (1105)..(1153): n is a, c, g, or t
  misc_feature (1162)..(1180): n is a, c, g, or t
attccatttatctgcccttttactatttatatagatgtggccttttttagggaattttagtaaatataccttttataaaggattttacttactttttgtaatatatggtatacagccagttacaggaaaacctttttccttgtggatttttaaaattaactgtttttgctgtctgctgcacacctgattcgcaaatttagagaaaaaacccatattactccccgtattaatagtaaaagtgaattactcagaaatgggaaacagttactatagaatacggggaaattttagactggatttttttttgactgaatgcttttgaatgtttttatttattgttatatcttatataacaatacatatatttgtttcatttatgtgtagataaatgtattttcttctatgttcttgcattttatatttgattcattaaaattaaaatcatacaaaaaattatattataaagttgaatatatcacccaatcagtaagtcaacaactgttcctattgtaaattgtaaaaaaataaaaaagtgttgcagatttatgttaaatttgatttttgtcgaaagctcaatatttcttttctttccaattccactttaaatcatatttttcattttatatgcaaatgtgcacatttatattattgtctatatttttggggttttttaattactcgactttttactgtnnnnnnnnnnnnnnnnnnngcatcacaataaaagtagatctctaagctactagttacaaccaattgctcataatggggtattttttcgttctcttctttttcgacttgggaacaagtctgtattttgttctagtctagatgtcagcaagctaaagtaaatcttagtgttcggtctattttcattcaatgtttttatctaagctactggctcctagtaatccttgctgcatcaaataaaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnggattattttggaaacggttttttcaaaaaggggaaaaaggggtttttaaaactaaccnnnnnnnnnnnnnnnnnnnnnnnnnnnnnnnnnnnnnnnnnnnnnnnnnccccggccnnnnnnnnnnnnnnnnnnncttctt

SEQ ID NO: 13370 - DNA, 403 bp, Diabrotica virgifera
  misc_feature (2)..(14): n is a, c, g, or t
  misc_feature (16)..(28): n is a, c, g, or t
cnnnnnnnnnnnnngnnnnnnnnnnnnngtacgtcttgttagtataaaatcatctcatataataagtttatctacttatgcttattagagattaatactaacctctttgtgagataacgactccactacgactgtatataaccacgatatcctgataattaacattacatacgtatgatgatacagctcatccctcatgcatggaaatcccgactacaatactaatgccgtagtatgcgcattgtagcaattctccatctcatccactgtcctagtagtgacggcaggccccgtagaatgggcccaaccataaatatctgattttgttccagttctgacccatttgtgtagctcaacacaatctttcaaaactgtatcctcaataagtgttccatctgaagag

SEQ ID NO: 13371 - DNA, 983 bp, Diabrotica virgifera
  misc_feature (290)..(309): n is a, c, g, or t
  misc_feature (551)..(573): n is a, c, g, or t
  misc_feature (677)..(694): n is a, c, g, or t
  misc_feature (763)..(788): n is a, c, g, or t
  misc_feature (820)..(836): n is a, c, g, or t
  misc_feature (838)..(850): n is a, c, g, or t
  misc_feature (929)..(951): n is a, c, g, or t
cccacgcgtccgatttttcagaatttctagaactttgttatcaggaaatggatccccaactatgttctgaagctgcaataacgattgaacagtctaattccggtttatggtttgatctgcgatatgcaagaataactgcatcaaagatttatgatgcagcacactgcaaaaaatcagatggttccctggttaaccaaatacgttaaccaaatacttggtgtaaccaaacttcctgctacagaagccatgtctcgaggaaaaaggcttgaggatgctgtaattaaagctannnnnnnnnnnnnnnnnnnngaaactcagtcatattgggttacaattaaatcacaggcatccaatatttggggcttctccagatgctatatctgaagaatttgtagttgaaataaaatgtcctcaatctgagaaaaccatttgaaactatttaacaaaaaatatggaaattacagcaaaatacaaagctcaaatgcagctacagatgtttctatgtaagaaacaaaagcattattttgtgttgcagatcctaattttgaggnnnnnnnnnnnnnnnnnnnnnnntgggtaccatatgatgaagaatacataaagatgttaatggatgctgcagaaaacttctggcaacataatatatttacacatttatgtaactcattcaaaaaatnnnnnnnnnnnnnnnnnnagcacgaccagtttcactttgtatttggggattttggatgcgaactggtgttgacattcgggtttttcnnnnnnnnnnnnnnnnnnnnnnnnnnaacgactcgccaaataaaatgcctgcccgggnnnnnnnnnnnnnnnnnannnnnnnnnnnnnaccgaacatcaaccacaggtgcggcatccggattctcaaaaacaaagggaattttggtttttggtgtataattatttgnnnnnnnnnnnnnnnnnnnnnnntacttggtaggaatggaccttataaattaatt

SEQ ID NO: 13372 - DNA, 804 bp, Diabrotica virgifera
  misc_feature (704)..(704): n is a, c, g, or t
  misc_feature (720)..(720): n is a, c, g, or t
  misc_feature (769)..(793): n is a, c, g, or t
ctttagatgagagtgaagttcctagtgattggattgttacagaaagtgatcagaacattttacaaagaaagtgccctgaaaattatgttaatgttaaacctgaagatattgttgtatgggtagacccgttggatggaacttctgaatatacagagggtcttttagatcatgttacagtattaataggaatagctgttagtggcagagcagttggtggtgtaatttatcagccttattatgagtataaaaccgttaaaaatggtcctggtagaactttttggggattagttggtctgggagtaggaggctttgaaccaattaaaccacctagcaataaatttgtgataactacatcaagatctcatcgtgatggtaaggtaaatgacgctttaaaagcactaaatccagacgatatcattagtgtaggaggagctggtcacaaggttatcgtcgtgttagagggaagagctcacgcatatgtgtatgctagccgaggctgtaagaaatgggacacctgtgctccagaagctgtgttagaagctgcaggaggacgactaacagacatccatggtaaacactacgattattccaaaaatgtgtcatttccagacgatcaaggaatattcgcaacagccagtggcgtcgaccatgatgctttgattgcaaagttacctcaggaaatacgtgatgcattcccttactanattaagaacaaaattnatatcagatgtacagtagcgatatgcgaaagttgaaaggttttaactgnnnnnnnnnnnnnnnnnnnnnnnnntttaagtctta

SEQ ID NO: 13373 - DNA, 1170 bp, Diabrotica virgifera
  misc_feature (915)..(932): n is a, c, g, or t
  misc_feature (1064)..(1077): n is a, c, g, or t
  misc_feature (1079)..(1096): n is a, c, g, or t
  misc_feature (1098)..(1123): n is a, c, g, or t
  misc_feature (1146)..(1168): n is a, c, g, or t
gttctgtatatatcaatatttttgatctcttttgaatatgtttgatgttaaaagtttctttaacccatagtatgccttatttgctagatagatacagtcaaaccttccatatccggatcaatatggcgacagaccgatccggatatgaaaaaatccggatgtcaagaccactaattcttttacagtctctgaaacgttttcttcttcatacattccagtaatcaacgccgtcaataactttcgtcgatagacacgttttatagattctataatacattatttcgccatcttttagttattcttttagtgcgttatccaacagcaggactgcctttctcggtagatttcggtagatccggatggcgcagaaccgtccggatatggcaggttgtactgtacgtctatttttgcagttatgttactttggttgatttgtagtcctagatacatgaactcttactccttcgaaattatatgttccatccgttatatcttcgggttttgctacttgcttattatatgtcaccgttattgtttgtcaccttcctatactttttttttactagtattaacgtatactcccattctttttgctgctgtttctactaccgagaacgattgtaccagttataaaaaagtggttagttatatttgataattcattgaatttcttgccacgtattctaagactgagaacgtttcagtggttcaacagtgtttttaatataagttgaaatgaaggatttcatacttttacatagctactatacgaatgaaaaagagtttaacctgaatcattttcccgactttttcccatgtgaagaaattattatgtaggtttcttaaaaacgaaataagttttgtttaacttcaatgtatgaccttttttatttgaataaaactaatatagggccnnnnnnnnnnnnnnnnnnctaagctttagtgggaataaagggaaatttgaagccgaatttttttgggtggtctcctttttcccccataaaagatttgggggaaagggtcggctcaacttttaaatttcggtagggccatttttaaggggnnnnnnnnnnnnnngnnnnnnnnnnnnnnnnnnannnnnnnnnnnnnnnnnnnnnnnnnnatttgtgtttttataaagcctcnnnnnnnnnnnnnnnnnnnnnnnca

SEQ ID NO: 13374 - DNA, 683 bp, Diabrotica virgifera
  misc_feature (77)..(94): n is a, c, g, or t
gaagaacctagcagtagcaagcagcttcagaaacgatcgaaatctactaaaaggaaaaggaaagttgaaaaatcgtnnnnnnnnnnnnnnnnnnggtatccgtgtccagtttgcaaaaaaagtttcacttcgactgctcccctacgaagccacttcagttctcatttcggatcaatctgggttgtttgctatttctgcggtaagctctcgtttaccaaagacgattttatccaacacttcttccaacatttcacaaagttacatttgaaagagctcaagcagaaaccggcgggtaatttcagtaaaaagaagaagatcgctaacggatcaagcaataaacgaaaaaaaagaatctgagtatagtagattagtgtttaaatattacataaattttgttagtaggtttaagaagaggatgttttcttttaaccagatgtttaaagatcactttgattttttcgcgaatctgatagctcctcctgaagattctgaagctgtggaagaagctcctgaagattctgaagaagttgtagaagctcctgagaaaccgtttaagtgcgaaatttgcgataaaggctactcacgaaaatgcatatcttaactgccacattgcaactctcagtattgtatatgatatagagtcttgtttgcacattgtataatttgtctgcctagccctctga

SEQ ID NO: 13375 - DNA, 120 bp, Diabrotica virgifera
  misc_feature (2)..(119): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 13376 - DNA, 805 bp, Diabrotica virgifera
gttgtatgtctgtgtgttttgtagtgttttagtgttcatttgtttattaattaattttcacatagaatgacgtggggatttgttacctgtggtcccaacgaggcactggtaatctcaggatgttgttacagcaagccactcttagtgcccggaggtcgagcttttgtttggccctccatacaaaaaatacaaaggatatcgttgaatacgatgactcttattgtagacagccccactgtgtacacaagtcaaggtgttcccatatcagtaacgggaattgcacaggtaaaaatccaaggtcaaaacgaagaaatgctcttagccgcttgcgaacaatttttgggtaaaaaacaagatgaaatccagctgatagcactccacaccctggaaggccaccagcgtgccattatgggttccatgacggtggaagaaatctacaaagaccgcaagaagttcagcaaacaagtcttcgaggtggcgtcatccgatctcgtcaacatgggaatcacagttgtctcatacacgcttaaggacattcgagatgaagagggttaccttaaaagtttgggtatggcccgaacggcagaagtaaaacgagacgcaagaattggtgaagccgaagctagagcagaagcaacaatcaaagaagccatcgccgaagaacaaagaatggcctccgtcttcttaaacgacacagagattgctaaagcaaagagggacttcgaattgaagaaggctgcttatgatgtggaagtgcagacgaaaaacgccgaggctgaaatgtgttacaagctgcaagctgcca

SEQ ID NO: 13377 - DNA, 202 bp, Diabrotica virgifera
  misc_feature (2)..(69): n is a, c, g, or t
  misc_feature (76)..(170): n is a, c, g, or t
tnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctaggggataaaccaggggaattttttttt

SEQ ID NO: 13378 - DNA, 267 bp, Diabrotica virgifera
catagctgctctgttgactgtattggctatgggaggcactgtttctaagatcgttaaagcgtgcgttcgatattgagatgaagcatacttcaccggtttagtctctagaactccaccgcatgaccgaagagccttaaagatctgagagatttgtagtcacttgtcaattccaatctatcgatatggaagttatctgctcgagccactctgaatattcaatttttagagatggaggaggagatgttaatgaagatcttgtggatatat

SEQ ID NO: 13379 - DNA, 196 bp, Diabrotica virgifera
  misc_feature (8)..(25): n is a, c, g, or t
  misc_feature (42)..(82): n is a, c, g, or t
  misc_feature (86)..(114): n is a, c, g, or t
  misc_feature (135)..(162): n is a, c, g, or t
  misc_feature (167)..(194): n is a, c, g, or t
ataatcannnnnnnnnnnnnnnnnngctggaatggaaagggnnnnnnnnnnnnnnnnnnnnnnnnnnnnnnnnnnnnnnnnnctannnnnnnnnnnnnnnnnnnnnnnnnnnnncagacgaaagacctatagagnnnnnnnnnnnnnnnnnnnnnnnnnnnnatacnnnnnnnnnnnnnnnnnnnnnnnnnnnncc

SEQ ID NO: 13380 - DNA, 247 bp, Diabrotica virgifera
  misc_feature (2)..(27): n is a, c, g, or t
  misc_feature (45)..(111): n is a, c, g, or t
  misc_feature (118)..(171): n is a, c, g, or t
  misc_feature (187)..(207): n is a, c, g, or t
  misc_feature (227)..(244): n is a, c, g, or t
gnnnnnnnnnnnnnnnnnnnnnnnnnncgagaaagacccaatagnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnngaaccccgtttttttnnnnnnnnnnnnnnnnnnnnncttaaagggataaccccccnnnnnnnnnnnnnnnnnnttt

SEQ ID NO: 13381 - DNA, 179 bp, Diabrotica virgifera
  misc_feature (2)..(43): n is a, c, g, or t
  misc_feature (48)..(105): n is a, c, g, or t
  misc_feature (109)..(145): n is a, c, g, or t
  misc_feature (148)..(177): n is a, c, g, or t
annnnnnnnnnnnnnnnnnnnnnnnnnnnnnnnnnnnnnnnnnggttnnnnnnnnnnnnnnnnnnnnnnnnnnnnnnnnnnnnnnnnnnnnnnnnnnnnnnnnnnagcnnnnnnnnnnnnnnnnnnnnnnnnnnnnnnnnnnnnnagnnnnnnnnnnnnnnnnnnnnnnnnnnnnnngg

SEQ ID NO: 13382 - DNA, 262 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (200)..(215): n is a, c, g, or t
  misc_feature (217)..(261): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttacaccggtgtgagccaggttggtttctatgctttatttattagtatattttagtacgaaaggnnnnnnnnnnnnnnnngnnnnnnnnnnnnnnnnnnnnnnnnnnnnnnnnnnnnnnnnnnnnnc

SEQ ID NO: 13383 - DNA, 211 bp, Diabrotica virgifera
  misc_feature (3)..(56): n is a, c, g, or t
  misc_feature (58)..(117): n is a, c, g, or t
  misc_feature (129)..(191): n is a, c, g, or t
agnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnaacccctatagnnnnnnnnnnnnnnnnnnnnnnnnnnnnnnnnnnnnnnnnnnnnnnnnnnnnnnnnnnnnnnncaatttggggggattaaaaa

SEQ ID NO: 13384 - DNA, 328 bp, Diabrotica virgifera
catcacgcccccgaaaaaccttagaagagaccaataagcttttgtagaaaacaggaatagaggagagagaaccaatacatattatataatagtaattacatcgatcgcagctaggaaatcgacattcatgtgtttgcaaatatggaggatacaaattacgtaacccaagcattgaaggaaaaacaaaataggattactatgtacactctgcgactggacatagtatcttgttacgcaaagacatagtctccaatgaatatggtgtcacggctcatgacgtgatagcaaaaacggtcatctcgaaaaagaccaatggcataaggattga

SEQ ID NO: 13385 - DNA, 420 bp, Diabrotica virgifera
  misc_feature (40)..(58): n is a, c, g, or t
taaaaaatccatttagttatgaacaaatatgttaatgccnnnnnnnnnnnnnnnnnnngatattaactactataaagaataagtatgagagtacctgtgtgatacacctcattttcatactcaacttcatattctgggtatttggagagtctactgattgataacggcctctacaatttcgttgacaaatggaagttgtcaggatgggtactagtagaaaatgtctatgatgtgattttaaatatatcgtaagagatggtcattatgggaggagtcgtttttatcgatagcttcggcggatgagtatgagcgcacaaagaaaatacatgcttgatcaaattttacttcctctggctattaatattcttcctattggaaatgggaatagccatcgttggattcgtcttcccccccttctat

SEQ ID NO: 13386 - DNA, 202 bp, Diabrotica virgifera; identical to SEQ ID NO: 8432
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 13387 - DNA, 922 bp, Diabrotica virgifera
  misc_feature (110)..(129): n is a, c, g, or t
  misc_feature (853)..(853): n is a, c, g, or t
ttctaattctactcctaagtattggaatgttcgtgcttgtttctatatttacttcctctacttttatgtttatcttttcttcttcttctttttcctccatgaccataacnnnnnnnnnnnnnnnnnnnngcgtcattccatattttttagtgtttcattccatatttctatatttctttgtagttgtttctcattttcggccaatatgacgacgtcatcggcgaatgctccttctgaaatgtatactcttcttaaatttctataacccacatgcatttttttcacttttactttacattctttaattatctcatccatataaattataaatagtgttggacttaatcctcctccttgtctcagtccctcgttcgtaataaatggttttgattttctgttttggctgatgatataattcacattgttgttgtaaatgttcttaattacccttatcactttgttacttatgcctctcttctctaatatttcccataattgttgccttggtaccgtgtcaaaagccttttcaagatctatgcaagccatatacatttttttctcctgttgctgatatttttctattatttgcttgattgtaaatatatgatcctgggtgcttctgccttttctgaaaccgctttgtgattcctctagtgtgctgtcaatttttccgattatttttttgttcagcattttttcgtgtattttcatggctgtgctttcatgacagtgttattcctctgtaagtaccgtgtcaaaagccttttcaagatctatgcaagccatatacatttttttctcctgttgctgatatttttctattatttgcttgattgtaaatatatgatcctgngtgcttctgccttttctgaaaccgctttgtgattcctctagtgtgctgtcaatttttccgattattttt

SEQ ID NO: 13388 - DNA, 69 bp, Diabrotica virgifera
  misc_feature (6)..(28): n is a, c, g, or t
tcgtannnnnnnnnnnnnnnnnnnnnnngatagaaaccaacctggctcacaccggtttaaactcagatc

SEQ ID NO: 13389 - DNA, 912 bp, Diabrotica virgifera
  misc_feature (110)..(133): n is a, c, g, or t
  misc_feature (349)..(372): n is a, c, g, or t
  misc_feature (385)..(402): n is a, c, g, or t
  misc_feature (436)..(458): n is a, c, g, or t
  misc_feature (683)..(703): n is a, c, g, or t
  misc_feature (782)..(801): n is a, c, g, or t
  misc_feature (868)..(911): n is a, c, g, or t
gaaggatagtagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtcagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtataacnnnnnnnnnnnnnnnnnnnnnnnnnnnnnnnnnnnnnnnnnnnna

SEQ ID NO: 13390 - DNA, 648 bp, Diabrotica virgifera
gtgccaccgtatccccgtggaggcctatttcttaaattatattaatttacctcaattcatatctataaacatggcgcaggaagcagttcgcgtcatacatgctgcagccgccgcgcacatcacatactccctactgtacttgatcgccaaggaagatgtcctcctacccaagctgaccttacacctccggcttttgtgtatcccagccatgaagggccagctgaaggcagactcaagggaactcgacgattgcgcccttccacttatgagacaacacatgccaactgctgctccttctgtgtcattaaaagacgtgtcaactgccttcctgtgcggagccttgcccacgacaaattgcatggaacactgatattcactcctggacaacgactgaatcatcaaagaaccaagtgaatctccatactcacacgccgaataagaagccaaattattaaccgtagacaatcctgcctacaccaatgctccagtttgatcctagtacgctccctccattcgagaacaaaatttcacagctatgatcaaattgaaccaatagaaaatccagcggcataaatcgatcaacattacatatatacatattgtaaaaaaggtactattttaactattttattaaagaattctttttgt

SEQ ID NO: 13391 - DNA, 295 bp, Diabrotica virgifera
  misc_feature (3)..(35): n is a, c, g, or t
  misc_feature (44)..(74): n is a, c, g, or t
ggnnnnnnnnnnnnnnnnnnnnnnnnnnnnnnnnnggtggtatnnnnnnnnnnnnnnnnnnnnnnnnnnnnnnngaaagtcaagaaaaagagaagaggcagatttagggggcgagggaatgaaacacaaaatttaaggaaagcaccaagatcgttgacacatacaaatgagaactgaggaatgaacaatcactatatataataaaacattgtaacattattaatatgacagaacagacaggaatgagcttgaagaataaagactgattaaaagtaaactgctccgagaaaaacta

SEQ ID NO: 13392 - DNA, 958 bp, Diabrotica virgifera
  misc_feature (861)..(862): n is a, c, g, or t
  misc_feature (903)..(903): n is a, c, g, or t
  misc_feature (935)..(936): n is a, c, g, or t
  misc_feature (949)..(949): n is a, c, g, or t
aaaccatattctggaagatgttaataaatgtgtacttgccttgcaagaaggtgattctgacacattggatcgcactgccagtggtataagaggaagatccaatggtgtgcaatgtagtaacagctgaaatggataattacgaaccttgcatttataccaaacgtgttcttgaagccgtcaaagtattgaatgatcaagtgatgcccaagtttactcaaagagtgcaagttgcagttcaagctttgggaaatagtcctcccaaagaagtggatgaaaacgattttatcgatgcttctagacttgtttacgatggagtgagagaaataagaagagccgttctaatgaatagagccgatgaagatttagatccagaagatgtcgaattggatgaaaactatctaatagaaacaagaagcaaatcgagcgctcacacaggcgaacatggagttgatgagtatccagatattagtggaattacaacggctagggaagctatgggtaaaatgccggaagaagataaacagaagattttgcaacaggttgagttcttcaggagtgaaaaactcaagtttgaccgtgaggtcgctaaatgggacgacactggcaacgatattatcgttcttgctaagcacatgtgtatgattatgatggaaatgacagattttaccaggggtcgtggccctctaaaaaccactatggacgttattaatgcggctaaaaagatttccgaagctggaaccaaattagataaacttactcgccaaatagctgaacagtgcccagagagttccaccaaaaaagatttgttggcttatttgcaacgtattgctctttactgccaccagatgaacattacatcannaggtaaaagccgatgttcaaaacatcagtggagaacttatntgtatctggggttggacagtgctacttctttnngatcagctgctangaacttgat

SEQ ID NO: 13393 - DNA, 785 bp, Diabrotica virgifera
  misc_feature (2)..(43): n is a, c, g, or t
  misc_feature (53)..(86): n is a, c, g, or t
  misc_feature (88)..(176): n is a, c, g, or t
  misc_feature (178)..(193): n is a, c, g, or t
  misc_feature (201)..(363): n is a, c, g, or t
  misc_feature (365)..(425): n is a, c, g, or t
  misc_feature (435)..(483): n is a, c, g, or t
  misc_feature (487)..(538): n is a, c, g, or t
  misc_feature (540)..(606): n is a, c, g, or t
  misc_feature (608)..(644): n is a, c, g, or t
  misc_feature (646)..(661): n is a, c, g, or t
  misc_feature (702)..(740): n is a, c, g, or t
cnnnnnnnnnnnnnnnnnnnnnnnnnnnnnnnnnnnnnnnnnngagaaaaagnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnngttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnngtctattagnnnnnnnnnnnnnnnnnnnnnnnnnnnnnnnnnnnnnnnnnnnnnnnnngagnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnncnnnnnnnnnnnnnnnncttctattgaaagctgccatgaaggagtggatgatacaatnnnnnnnnnnnnnnnnnnnnnnnnnnnnnnnnnnnnnnngctagagagcttaaattttgttacaagacgagaagacactataga

SEQ ID NO: 13394 - DNA, 218 bp, Diabrotica virgifera; identical to SEQ ID NO: 7300
  misc_feature (6)..(28): n is a, c, g, or t

SEQ ID NO: 13395 - DNA, 119 bp, Diabrotica virgifera
  misc_feature (2)..(84): n is a, c, g, or t
  misc_feature (98)..(118): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnncaccctatagaggnnnnnnnnnnnnnnnnnnnnng

SEQ ID NO: 13396 - DNA, 112 bp, Diabrotica virgifera
  misc_feature (6)..(78): n is a, c, g, or t
  misc_feature (85)..(104): n is a, c, g, or t
  misc_feature (106)..(106): n is a, c, g, or t
aaagcnnnnnnnnnnnnnnnnnnnnnnnnnnnnnnnnnnnnnnnnnnnnnnnnnnnnnnnnnnnnnnnnnnnnnnnnnattattnnnnnnnnnnnnnnnnnnnngnggtgat

SEQ ID NO: 13397 - DNA, 532 bp, Diabrotica virgifera
gccacgtagtcgagacgaatttattctaagctgcatatacatccttagagtaataaccacagagagtctattcagttgccagttaatcaacaatagaatgaaaacatcgtgcattaatatcatagtacaggtgatgatggggtcctgcgaccataagtggatcatctcagtaatcatatacccatcacatctcaaattccctagcagcaattgcgatagaatctaatattgctagtgacatcttagtgattggctactccctcatgccgtgcaagtgccagattaagatatttagtttactaataaatgtgctgtagatgtcactcaacagccttactaatgaaacctaatttaataagattgccccacacgtaccctttgacatgaactgtgatttcagtattatccaaagaggacgagtacatagacaactaggatcaaaatatgacaaacattagagacagataactatttccttaatcctatatccacttggtataagaaataaatgcttgatcaagatagacctacc

SEQ ID NO: 13398 - DNA, 459 bp, Diabrotica virgifera
acaggcaaaatttactttttgtaccctgtgtatcggggaaaaggcggcccagtagtaagagggctgccgcaccatctctttatggcgtttgtgtgcctcttgcttggtccacggtatcacctccccaacagatgtcacttgccgcccgtacgagatgtaatgttatccgcagatcctgaaccttcagctggcgctcgtgacggaccgagcacgcatgcgtagacatgcgtcgcctcacactcggccatcgcggcctgcacaaacgcggttcgctggccgtcgtttcacatcggggtcgtctgggaacgccctcgaggtccgccggcttagatggcttgcacgacgtcgccctttcctcccttcgcgctatagagaatacgccctcgacagccgcccttcccggctggagcacttgctgcagggtgaatgggaccccccctggagcggcaaattacgggc

SEQ ID NO: 13399 - DNA, 818 bp, Diabrotica virgifera
  misc_feature (795)..(795): n is a, c, g, or t
tacaccccgtagatgctaaacgctagtagatagaactaatattcaagttggaaactaaatgttactttgtaaatttatcgttctatattaagagtaggtattataagtcaaaaatgaatattttttatgctctctgctgaaataattattacaacttacaactaaatatcaaaatggtgatgaaatatgatccataattgtagtaattaactattttactttctgttttgataattacataatttttaagttcaaaatatagaagaatgcagaaaggtctttattacgacttatactcttagtaaatagcacgttagagatattatactatatatttggcgacacctattattttatacaccccgtagatgctaaacgctagtagatagaactaatattcaagttggaaagacgattttagatgctttacccaaaaatggcagtggccagatccagatgctatgcaaacttgatttcagcttttaagagtgttttgactaaaaaataaaagtaatgaatcattaaattaaggtggaaaagcactaaatacataaaatacaagttttcgttagtcgactcctttaaacggttttccttttagaatttactatatgtagacttgttgttttggggtatacatatcaacattctacactatattcagtatttttgtgtgcaactatttctatgagcatatgtggtttcagattaggttggtttttgtagttagagctttatttacattatgtattttattacttactcttgatactgaataaagcattttgctatccnaaaaaatgaattttaggatgaat

SEQ ID NO: 13400 - DNA, 964 bp, Diabrotica virgifera
  misc_feature (863)..(863): n is a, c, g, or t
  misc_feature (877)..(877): n is a, c, g, or t
aaatattgatttatttattcacatttttagttttaagatgagttttgaatttttagacaatacagaagaaatattctataacaatgccgttaattattggtcagaaattccagcgacactggacggcatgctcggaggcttcggatacatctcccaaacagacatcaaaggctccaaaatgttgttaaagcagctctttaactccaaagatcctccgggaagagagtatgccctagattgtggagccgggatcggtagaatctctaaattcttgttgaccgagatgtttgaaaaggtagacttagtagaacaaaatgcagcttttctagaacaagcaaaaaagtatttaggaccaaagatagcgaaagtaccggagtgttattctgtaggcttgcaaaactttgagccggagcccaacaaatatgatgttatctggattcagtgggtcataggacatttaacgaataaagatctagtcaagtttttaaagtcttgcagcaagggtttaaagaaaaatggtgtgataattttaaaagaaaacataacctctacagatgatatagaaaaagatgaccaagattcttcagttaccagaccaatgtatctcttccatcagttatttcaaaaaacagaattgaactgttacaggcagtccaagcaacacaacttccctaaaggtttattttctgtctatatgtttgtcttaaaacctattaaagatgatgtacctgacacaacactgtcaacagaagaatcacctgtaaaagaggaatctcctccattagttgagttatcaaaagaagctgagaaaattactgaacctgataaagatgtgaaaaatagtacagaagtccaacaattgntggaacgtgatctnaatgagctagaacaaactagaaatgttgaaacggaagctgtgactgaaagtgagggacaagtctacattttgagtttttttaggaat

SEQ ID NO: 13401 - DNA, 438 bp, Diabrotica virgifera
  misc_feature (16)..(17): n is a, c, g, or t
  misc_feature (24)..(24): n is a, c, g, or t
  misc_feature (28)..(30): n is a, c, g, or t
  misc_feature (52)..(52): n is a, c, g, or t
  misc_feature (54)..(55): n is a, c, g, or t
  misc_feature (57)..(57): n is a, c, g, or t
  misc_feature (59)..(59): n is a, c, g, or t
  misc_feature (63)..(63): n is a, c, g, or t
  misc_feature (67)..(69): n is a, c, g, or t
  misc_feature (72)..(72): n is a, c, g, or t
  misc_feature (133)..(133): n is a, c, g, or t
  misc_feature (138)..(163): n is a, c, g, or t
  misc_feature (322)..(341): n is a, c, g, or t
  misc_feature (349)..(371): n is a, c, g, or t
  misc_feature (401)..(427): n is a, c, g, or t
cccatcagggggccgnnaaaaaanaaannnaaacaccccaacctttaaaggnannananaaanaaannnaanacaaaaaaaacggataaagaaagagggggaggaagaaagagaaacagagaaggaaaagaangaacnnnnnnnnnnnnnnnnnnnnnnnnnngaaggagaaaaaaggacacgaacgaagaacaacgggagccaaagagcgggaagaaaagaagaaagcacccaagggacaacagcgaaaaaatatgggagagagcaaagcgagaacaaagaacgcgacctcgaagcaggagaaaagcagataagaggcggnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnagtacgaaagg

SEQ ID NO: 13402 - DNA, 605 bp, Diabrotica virgifera
ctgtttcatttatttgacaggctgaccccacaaaacagcaaaaaacggatcaaaaaaataaaactttctaatcaaaaaaacccaagcccaaatcgccatcttccctttcaaattcccccttcttcccttctttcttaaacccgggaggggggggaggggggggtggagctacaggagcagcagcaacaacaaatttggggggatccttgagggattctttgaggggcttggcttccttgaaggcaacatcagaaacagcagcaaaagccaacaagttcttgaatccattggcaatggtggggggagcaaaaacaactggggggtatccaagggacaaacaaacagcagccaaattggctacccccgccaaaaatttcccccccaaatcttctgggttgatggccaaaaaaggtggagcaaaaacagggcctgagtcataaacttgctcaacttgaaaaccatatgaaaagggaaaaatggttaacatggtgaggaatggggcttcggaagctcctactttggccccgggtttaaaaatggggacatcattgatgatttcaaaaatacccttggaaatcttgggggggacccccgcgtccgcgcga

SEQ ID NO: 13403 - DNA, 997 bp, Diabrotica virgifera
  misc_feature (852)..(876): n is a, c, g, or t
  misc_feature (917)..(935): n is a, c, g, or t
  misc_feature (946)..(974): n is a, c, g, or t
ctcaactgttatcaattccaagtaagattgttgggcctgcgggtttgttgtatgtcttgcaaagggagtttgctgcagtcaatcagcatgacaagaatgtaacaattctagggtccgatgatgctaccacctgcatacttgttattcttagacattccggatctggtgcagtcgctctagcacactttgatggattaggaacacatgaggctgcatcagccatggttgaaaaaattcaagaactggctgtgggttattcaggtggtagaattgaattacagttagttggaggattttcagataggctgggttattcggaagaacttttttacaacattatggatgcctttcataaacagctggttgaaattgatttaacgttagcttgcattggacaattaaacacaacaattgttaatggaataccagcccctattatatacggagtaggggttaacatgagaacaaatgaaatttttcctgcatcatttccacaaaaaggcccagaagagtatctccgtactgcgcgccatctgtttggttcagaaaattgcgaaattattaacatttatgactgtatcctaggtcagctaaaaatcggaccatttaattacaaaccgctcagaggagcgaatctttggttagaacaaaacgacgactttatcttacaacagctctctacttcgcctgaggtcgaaccgccacatttcgtttcaaacgttagaggtaccgtgaaatatatacaagagaacccttttcctgcagtaactgtttttagaaataataggccactgtattataaaaaaaacgaagactccggactttgggttccagaatattaacaaattaccnnnnnnnnnnnnnnnnnnnnnnnnnaaatgttgaattgcttaaagaacaaaggcggcgcattaacnnnnnnnnnnnnnnnnnnnctattaataannnnnnnnnnnnnnnnnnnnnnnnnnnnntccgttcttaaaggatcccaagc

SEQ ID NO: 13404 - DNA, 870 bp, Diabrotica virgifera
  misc_feature (338)..(355): n is a, c, g, or t
gtaaagtaaagtaaaacaacaaaagtacataacaccaaagtaacaataacaacacctaaactactaaaaactgtgcctaaacaccagtccagtgcagtgagtagtgagtccagagtcctcgttcgtcatcagtccattgacaataattacggttgtgtttatatgcgtcacaaattcgtgttaacaaaatttacctgtggacatctataataatacattggtgcattttaatgaatgaaacagctaggacgctaagtgcgtgtcaaatttgatagttttagtgggaagtgattttatttttatgctattttaatgtaaacaaatatggttgtgtgagnnnnnnnnnnnnnnnnnnctgtctggattactttttaccttataattgtttcctcatccagattatcgttatatcgtttcgaggggtgttgccctcgactccacgccactgaaaaccaacgttcagtaagatttccaggctggaaaatgcccttgcggcagctcttcctacttttttgtctgtgctttctttgtacttcgttaacaaccgttgaaagtcaggtgctgcctaaatgtttagatggagaagaagtcacgccgaaaaaatactttcgatctgatgggcaatccctgacgattatgttggaaacttcaagtagaacgactcacatgttggcaacgcatattttctacatttacgccaaagaagttttgggatatcccaaaattaatatatcgatcttggaggatgatttccaaatcgagaccgtgatgagcaggttgaccagctatgcttccatcggcgtagaatacctccggctatatcaacttggagtatggacagtcccgactaccataccttcgcaaaagatt

SEQ ID NO: 13405 - DNA, 128 bp, Diabrotica virgifera
  misc_feature (9)..(87): n is a, c, g, or t
  misc_feature (90)..(126): n is a, c, g, or t
cgagagacnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnat

SEQ ID NO: 13406 - DNA, 410 bp, Diabrotica virgifera
  misc_feature (57)..(127): n is a, c, g, or t
gttataggctgctgtattgtaaatgaaaataataataaaatctctttgtaataactnnnnnnnnnnnnnnnnnnnnnnnnnnnnnnnnnnnnnnnnnnnnnnnnnnnnnnnnnnnnnnnnnnnnnnnagatcttaaagatgcaagattttgtaggtgtgatgtctgaaaagaaatgaattataaagaagtttggatttagctgatgggacggcggttgacttgataatgatatgggaaaaaggatttgaactgaggtgtgcggatgctgaggacaaccagataagatatgtaggtaaatgcagcatggattcacaaagaggaaacattattctaagattgagtatgcgtataagcaaattgtgaatggttaggaggagacgtaggtcatctaggggggaatggttctgat

SEQ ID NO: 13407 - DNA, 800 bp, Diabrotica virgifera
  misc_feature (2)..(624): n is a, c, g, or t
  misc_feature (638)..(650): n is a, c, g, or t
  misc_feature (652)..(683): n is a, c, g, or t
  misc_feature (710)..(750): n is a, c, g, or t
  misc_feature (752)..(769): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattttgaccgannnnnnnnnnnnncnnnnnnnnnnnnnnnnnnnnnnnnnnnnnnnngagggttggatggaaaaagaaactggnnnnnnnnnnnnnnnnnnnnnnnnnnnnnnnnnnnnnnnnngnnnnnnnnnnnnnnnnnncgacgaaaaaacctataaagtttttaaaata

SEQ ID NO: 13408 - DNA, 965 bp, Diabrotica virgifera
  misc_feature (470)..(491): n is a, c, g, or t
cccacgcgtccgactattcgccagatatatacccatatctctatcaatctagttagcactgagacatacgcggtcgtcatctggttcctctcgcgtgccatcagttttagtgatcgtttgtttttcgagtttcggaaagtgtttatcgcatcgcggtctatcctgcaacagctatcagcaggaatattttgtgtgaaagtatttcaattgttgctttttttggagcgcgggtgccgttaatcgattgcttctgtcgttgcacaatttgttcttttcagttagttcaaaggaatttcttagtttctacgttggattttgttaccgagctgttcgtcgacgacatcacaaaaacaattgcaagcgcgtccatccgtagcaaccttgatccaaaaattgaaatgggtcactgcctctcacttgcgacgaatattacaacgtaaatgtgaatcttcaaagttctcggagtgtgnnnnnnnnnnnnnnnnnnnnnnagtattcaagttggactgaagaatacagtgcgaacgaaaaaatgatgagccaagaagtgctccaggttgtccacgaaaaggacccctgggtcgaagaaaccaccatcagccttcgcgaacacgataactcctggcccaatatcgacgaggatgtcccttccattttggacaaaaagggccgaaggaagtcttggcatgccatcaagtttgagaggaaacggagaaagggtgtcatcgatggatcacccgacggttccccagtcgaaatcagacagaaaagaccatcgtggtggaacatttttacgaatcagccgtggcctaggtcccgaagggcatcacaggatgttggaagggtcactcataaggaaggttttcctggaaatgcgagcaaaagcagaagcgtagaccacggcattacatccccattttgatttgaacgccttacgagcaaaaagtcgataagccagttttgat

SEQ ID NO: 13409 - DNA, 105 bp, Diabrotica virgifera
  misc_feature (4)..(4): n is a, c, g, or t
  misc_feature (6)..(41): n is a, c, g, or t
  misc_feature (46)..(103): n is a, c, g, or t
taangnnnnnnnnnnnnnnnnnnnnnnnnnnnnnnnnnnnnatttnnnnnnnnnnnnnnnnnnnnnnnnnnnnnnnnnnnnnnnnnnnnnnnnnnnnnnnnnntt

SEQ ID NO: 13410 - DNA, 874 bp, Diabrotica virgifera
atgatgtgactatgataacagtttttgaagaaaagaatcctcctaagaatgggaagtttcggcagcttgttttaaaagaagtgttaaatgtacaatacgaattgttcgcaaacatgtcaaacctcaatgacgaagattcgtacgcagcgaaaaatcctcttggtatgatgaaaattttcaatatggttggtttaactgtaacagaagcaacgttatcccatcctacagtgcaagcattgataaagtcaggagagaagtttgatatcatgatactcacacaatatgcagtagaagcaacaaaagctttggctgcacattttggagctcatttagttctgtataatgacaatgctgcaacgtgctgggtaaatcattttgtaggaaactcgggcctaccttcattgaatcctgaactaatattcgattatccacaattgatgagttttaaacagagactagctaacactttgtatacgatagcaacttatgtaaaccataatttggtacaatatccagctcatgctgagctaataaagaaatacgtgtcaaaagacatggacctgaccaaaattcaatatgatgtcgcattggtactatcaaattcgcatcctagcttaaacaatccagcaccatcagttccatgcatgaaagaaatagcagggtaccacgtcaaggaacctaaaccattgcctgctgatcttaaaaaatacttggatgaatctaagaacggagtcatttatttcagtatgggttccaatatttacagtaacagctttcccaaagaaaaaagggagagcatcatgaaagctttctctaaaagaaaagaaaacattttgtggaaatttgaagatacagacttgcccaggaaagccta

SEQ ID NO: 13411 - DNA, 952 bp, Diabrotica virgifera
  misc_feature (55)..(73): n is a, c, g, or t
  misc_feature (393)..(411): n is a, c, g, or t
  misc_feature (439)..(461): n is a, c, g, or t
  misc_feature (552)..(566): n is a, c, g, or t
  misc_feature (660)..(678): n is a, c, g, or t
  misc_feature (809)..(809): n is a, c, g, or t
ttcttgtttactttctgtgattttgttttattgtggattgtggtaataataatgnnnnnnnnnnnnnnnnnnngcgaggaaacgtgtaaaatagaaatagagaatagtgagatggatgatgctgttttggatagctttaaatgtgaaattcaggaggaggaggagtccaaaagagaaataattacccatggcacatacgattctttagacttgaagaaatgtcccataaaaactgaaatagaacaacatggaaataaacttatcccatttgaagaacaccaaaaaactgaaaaaggttatctccaagaggaaaacaaaacggaaattatggagaaactcgttgaagattcagcctaccaaggaaatgatatgactcgacacactcgaggaaannnnnnnnnnnnnnnnnnnaacgttgggactggaaaaagacaatatnnnnnnnnnnnnnnnnnnnnnnngtgtattactgcaattaatttgaaaagacatatgagattacataccgaggaaaaatcccacaagtgtgaaatatgttttaaacagtttagnnnnnnnnnnnnnnnccaagacgaacacaaaatggcaattatgaagacactaattcaagattcatcctatgaagcaaattacatcagtcagccctctgagggacaaacnnnnnnnnnnnnnnnnnnngtagcgactgtacaaagactttacagatgcgaaatttgttttaaacagttttcttacaaaagttatttaaaaatacatttgttttcacacactgaggaaaaacctttcatctgtgaaatttgtcttaaggngtttagtagatcaggtgatttgaaacacatttgagagtacatactggggaaaaaccatacaagtgtgaaattttgtttaaacagtttagtactgcaagtcaattgaaaagacattttagactgcatactgggggaaaacctta

SEQ ID NO: 13412 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 13413 - DNA, 135 bp, Diabrotica virgifera
  misc_feature (2)..(27): n is a, c, g, or t
  misc_feature (29)..(60): n is a, c, g, or t
cnnnnnnnnnnnnnnnnnnnnnnnnnngnnnnnnnnnnnnnnnnnnnnnnnnnnnnnnnncattatttctatgaaataaaaaaatcttctggccccaattttttttggcatttcacaaacaaaaatcccccttac

SEQ ID NO: 13414 - DNA, 392 bp, Diabrotica virgifera
  misc_feature (245)..(274): n is a, c, g, or t
  misc_feature (365)..(390): n is a, c, g, or t
acacttcttgtttctggatttttcttgttaatctagcgggatgcattctcatcacgtgtccataccagttcaattgtctcttcttatattcgttatttgggaaaaaaggcgcttaaaccagaaaaatctttagtaggaaaatcggcatcttaaaatcccatcataattttttaatagaccacgaaaacgatggaacgacaagttactggaggcacattgaaaaaacagacagagtcatgtctatnnnnnnnnnnnnnnnnnnnnnnnnnnnnnncagttaccatgttttgttaacgataatattagatagtgttcttaaagctttaattttgccagtcaatcgggcagaaagtctcaaatctctnnnnnnnnnnnnnnnnnnnnnnnnnnca

SEQ ID NO: 13415 - DNA, 821 bp, Diabrotica virgifera
  misc_feature (304)..(363): n is a, c, g, or t
caacgattatagcggtcatacaacttttcaataccatttttataatacaatttatactcaaaagaatactcaaaataagcctcagtttcggcgattacctcttcgttggtgctaaatttcttttcagcgagcattctcttgaggtcagcgaacaggtggaagtcgctgggagccagatccggcgaatacggtggctgcggaagcaattcgaagcccaatttatgaaattttgccatcgttttcatttatttgtgacacagtgcgttgtcttgatgaaatagaactttctctttctttaaatggnnnnnnnnnnnnnnnnnnnnnnnnnnnnnnnnnnnnnnnnnnnnnnnnnnnnnnnnnnnnttgatggtttttcccttttcaacatagtcgatgaatattataccatatgcatcccaaaatactgatgccataaccttgccagccgactgttgcgtcttttcccgctttggagtcggttcatcacgtgaagtccactcggcagactgtcgattggactccggtgtggaatgatgaagccatgtttcatccatcgtaatatatcgacgcaaaaattcggttctattatgattgaagagcttcaaacacttctcagaagcatcaatttcgttgttgtttttgatcgattttgcacaaagttttcgtatacccaaatattcatgcacaatatatccaacacgttcctttgatatctttagtgcctcagctatctcgaataacttcactttacggtcatccaaaattattttttggacttttttgatgttttcgtcggtaacagactctttgggacgtccact

SEQ ID NO: 13416 - DNA, 898 bp, Diabrotica virgifera
agataatttagagaaggacggaagaggtggatttttagcatccctaattgaaaacaacgatgaagaaaacccagctccattgttcctggtgtcccggtttcctcttgccagaaaattcatttgcagagtctttggcatcgcccagcttgcttttgaaactttggatagatactatcccaatgaatttgctcaaaaggctgtacattatgttggtcactacaattctatagctggaaaattaccttctaagcgtgcaactgttcttcgtctttctaataatggagaaatagttgaagctctccacacaagtaataaaaatgtgtacctgatgtctgaagcttatccctttaaggatcacttgtatttaggaagccctggaaatgattttattgctagagttcctttcgagtccatgggttggccaaaagcgaaaactgttgccgaacctaaagtagaaactaagcaagtgccaaagcaggaagaagcacctaaagtaagaactacgtcacctccacccgtaaaacaacaaactactaccaccaccactgccaaaccaccaactaaacagacagaagcccctaaagtgaaaaccactcctcccccacctgtgaaacaacaaaccacaactcctccaccaaaaccgactaccactacaaaacctccaacaccgcaacccactcaagctccaaaagtaaagcccactcaagctcctaaacctcaaactacaacaccaaaacctcaagctactcaagcacctaaagcacaaccaacaaaagcacctacacaacaaacaccccaagttcccaaagcgcaacccacgcaagctccaataaaggacagtaaagcaccacctacacaacaacagaccactcctccttctcagaaaactactcccccc

SEQ ID NO: 13417 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (172)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnncgttcgannnnnnnnnnnnnnnnnnnnnnnagtttaaaccggtgtgagccaggttggtttctatctttannnnnnnnnnnnnnnnnnnnnngaaagg

SEQ ID NO: 13418 - DNA, 596 bp, Diabrotica virgifera
  misc_feature (2)..(438): n is a, c, g, or t
  misc_feature (440)..(595): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 13419 - DNA, 525 bp, Diabrotica virgifera
  misc_feature (333)..(347): n is a, c, g, or t
  misc_feature (349)..(364): n is a, c, g, or t
  misc_feature (368)..(385): n is a, c, g, or t
  misc_feature (402)..(426): n is a, c, g, or t
  misc_feature (477)..(495): n is a, c, g, or t
cgcccagcgctgtactcgtattatatactaatatcatagaataatttatgttatatagtattatgggtcacttatcagttactatagaatagtatgtatatataaatttagagagtacgaataccaatacttggctcacaccgaatttatactcatatcatgtaaaatgttataagtataatcagacttaatattatatgatgctacaccaattataatctttaatccaacatcgatggacgcaaactttattatcgatttgaactctcctatagtaattacgctgatatccctaaggtaatattattcttatattctgtaaaattggatccnnnnnnnnnnnnnnncnnnnnnnnnnnnnnnnaagnnnnnnnnnnnnnnnnnncaccccaattatatagnnnnnnnnnnnnnnnnnnnnnnnnnctaaattaacttataaataatatttatagaatctctatattcacatctcgnnnnnnnnnnnnnnnnnnnaaggtatgtcagttctataatatcctagta

SEQ ID NO: 13420 - DNA, 119 bp, Diabrotica virgifera
  misc_feature (3)..(94): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaggaaaaaaggggggaattttt

SEQ ID NO: 13421 - DNA, 995 bp, Diabrotica virgifera
  misc_feature (766)..(766): n is a, c, g, or t
gtgcagcaagagtcttgcaagtctcgaagttacccattagccgattacatatcttagaacaacgtaacagagtagataaattttaagcttgaaatatttattcgttaacaatatcgctgtcataatattgtttctaaaaggtaaattgtcgttgtataggtaccggataccgtaccggtaccaataagtgtaccaatcaaactgtatatttttctcaaagttctcatcatcctgtggaatattctagcatttaaaaaatactgaaatttaaaccctactacaatctgttattttcttaacatactgtttttttattcattcgcttgtgttggataacaacaaagttaggtattttaacaactagccatgtttttcatcaatatagactgttttggaataagtatggcaaattttaaggggtaattctaaacaaacgagttacccgtatgcgcgacattggtgaaaattaaaatcttaatttttatgtcaaaaatgcgtaataattacctacctcttaacacctaccaaattttaccagtttgtaagaacaattttaaaatcccctatttcggaaacgaagcatttgcgaacattttcgtgcagagtaattacctctcaaagtttgccatatttatttgaaaacaccctgtattgatgaaaaacatggctagctcaaaaagtacctagctctttattatccaacaaaagcgaatgaataaaaaacaaaatgttaaaaaatatgatggctatagttggggttttaatnttaatattttataagctagaatattccaagaatattccatagggtgatgcgaactttgagagaaaaaaacacagtttgatggtacacccggtatataagtaacccggtaataggctatgacatattaaaagatactatcggacaacgggtttaggaaattgaagacttcaaaatgacccggttttaaaggggtgtgtaaattttttggaggagggttatccccaacccc

SEQ ID NO: 13422 - DNA, 733 bp, Diabrotica virgifera
  misc_feature (285)..(361): n is a, c, g, or t
  misc_feature (680)..(696): n is a, c, g, or t
  misc_feature (699)..(715): n is a, c, g, or t
aattaatgtgttatcaccgaatcaagatgtttttaaaaaacatacttgtcgtggtttgtccttgtatatgattttagaacctacacactgtgaggattatgccaaagaagttcaagaattatttggattaagaggtacaataccaactttaaatttatatcatagaggaaacaaaagctactacatcggtaatatttttaaaggcaatctattacatgccgaacaattctgtaggtaccacgacatgaatttggtgaatatagaaacgcaagaggagaacaactnnnnnnnnnnnnnnnnnnnnnnnnnnnnnnnnnnnnnnnnnnnnnnnnnnnnnnnnnnnnnnnnnnnnnnnnnnnnnaaactttggatttctttaacaagtggaaaatcacttaaatatttcaactggaaaaatggtgaaccaaacaatgtccaaaaagaagaacagtgtgttgttgtgcgaacagaaaataaacaattaaaatggtacgacgtcttctgctggaatactaactatttcatctgtgaagttatttggacaaaaatggaccaaaaattattgcaagttttaaaagataaactcgaaaaacaaattgaagcgcaaggtaatgttagcatgaccgtaggaatgccgactgttcattaaaacgaaaatgttacactccaaaaagttaccnnnnnnnnnnnnnnnnnagnnnnnnnnnnnnnnnnnagaacctttatgttttac

SEQ ID NO: 13423 - DNA, 695 bp, Diabrotica virgifera
  misc_feature (412)..(426): n is a, c, g, or t
gcccctcacccctcccccttatttattttaatatactaatatatttttgattatacagctctatcaatagagatttattgacagtttatcattattgccagattttatctcatctttattaataaaacaatctctttttttgaccccggcgtagggtaaacgataaactgatagcgttattacttgttgctgaactgcgacacaccagaacaacaataattatactactttgctaccaaggagctaagaggcatccactcatgggaaattaatcacaccgctgtgggaccacactggatattccaatgcattattcccgagggtcctgctaacaacagccactgtatatatagggatataatgtaagccctgcgctgctgatggaaccagagggttaggtaaacggaggagnnnnnnnnnnnnnnntcattcatctcttgaacgaagccatcgtctgacaagatgaacaagccaatgatggactgcttgaagaatagacgatgaagatgcctaccactacggacgttggatgcacttatatgatacagacaatggtcgaactctttgttgattagcccgatcacctaagccaggtgcttcctccagagccgacgcacacttggatgtccaacacccctctcgacccggccagataaatccccgcagaacaacaaaaaagaactccacccccccac

SEQ ID NO: 13424 - DNA, 963 bp, Diabrotica virgifera
  misc_feature (2)..(759): n is a, c, g, or t
  misc_feature (766)..(802): n is a, c, g, or t
  misc_feature (836)..(858): n is a, c, g, or t
  misc_feature (866)..(888): n is a, c, g, or t
  misc_feature (920)..(951): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnntgggacctcgatgttggattaagtttataattgnnnnnnnnnnnnnnnnnnnnnnntggtcgannnnnnnnnnnnnnnnnnnnnnnaggttaaacccatgtgaagccagggttggttnnnnnnnnnnnnnnnnnnnnnnnnnnnnnnnnaaccgaaaagga

SEQ ID NO: 13425 - DNA, 161 bp, Diabrotica virgifera
  misc_feature (2)..(37): n is a, c, g, or t
  misc_feature (87)..(142): n is a, c, g, or t
  misc_feature (144)..(158): n is a, c, g, or t
cnnnnnnnnnnnnnnnnnnnnnnnnnnnnnnnnnnnnctaagattctatttttaagctaaaaagcttcaatttttttaaagacgagnnnnnnnnnnnnnnnnnnnnnnnnnnnnnnnnnnnnnnnnnnnnnnnnnnnnnnnncnnnnnnnnnnnnnnnggg

SEQ ID NO: 13426 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 13427 - DNA, 60 bp, Diabrotica virgifera
  misc_feature (2)..(23): n is a, c, g, or t
  misc_feature (53)..(53): n is a, c, g, or t
cnnnnnnnnnnnnnnnnnnnnnngcttacatttttttaaagacgagagacccntatagag

SEQ ID NO: 13428 - DNA, 52 bp, Diabrotica virgifera
taacagcgtaattttattggagagttccaatcgataataaagaatgcgacct

SEQ ID NO: 13429 - DNA, 865 bp, Diabrotica virgifera
  misc_feature (28)..(55): n is a, c, g, or t
  misc_feature (302)..(327): n is a, c, g, or t
  misc_feature (439)..(468): n is a, c, g, or t
  misc_feature (478)..(498): n is a, c, g, or t
  misc_feature (500)..(513): n is a, c, g, or t
  misc_feature (519)..(536): n is a, c, g, or t
  misc_feature (680)..(698): n is a, c, g, or t
cgggtccacccacgcgcccgatatttcnnnnnnnnnnnnnnnnnnnnnnnnnnnnttagtaacagcaacgaaaaagtttatttaatgatcggtaattacgattgtgagagaatattactatcttcttcataaaagtacccattcatctcctctgtaccttgagcatcccggatcatcagctcctactcctatatttattattctcgaagttgaaagagctgtccaattacaattttacattgtacaatcaccatcttaaacaattttcttggatcgcaatgatattctctctttaagtatcnnnnnnnnnnnnnnnnnnnnnnnnnncttatttattcccactatatttatcacctatagcatcttatatcactctaacattcactattctaagggatgagcttgatcatcatcttttattaaaatctaattcctaacnnnnnnnnnnnnnnnnnnnnnnnnnnnnnnctcactctgnnnnnnnnnnnnnnnnnnnnncnnnnnnnnnnnnnngtatgnnnnnnnnnnnnnnnnnnccatctaacccatttcagcttcgtcatgacgcctccagttgtattaccaccttgtatgtttaggatgaatatctaggcttaataacggacttcgtctacatcttttttcacctgttcattagaaacatgagtgtttgtatcagnnnnnnnnnnnnnnnnnnngctgattaattcgaatggtcgaggcattttgaccgtgctcagagtaccataatcattagtcttctcattgattgccggaacgaatggttggatgaaataaaactgtcttttatttaacttatccagaatcttattttgaatttttaaaggtctatatttttttaaaa

SEQ ID NO: 13430 - DNA, 461 bp, Diabrotica virgifera
attgagcctaatttccttggcacttgttgcttgcgatgattcagttagtacttcgacagacactccggtaatatcaacagaggtaccagcaccgatatcgacaagccttcgtgaagatagagtttacgtagacacttcaaatgttcccgacccagtctaccagatagatgccgtggaagcattcaaagaagctaaggcacttcatccagttgacggtatagctttgttaaaaacattctccgagttgtttaacgccaaacataaagtatctggaggatggaaagttgctgaaaaatatgactacttttacaatccaaatataaactacgtgtatgttgcattgggagttatagatgctaatggagataggcttgttctgatatttaactaaaaaaataaaccattttaattgttaactctcagcttttatttcgactttccaaataaagaaacataattcg

SEQ ID NO: 13431 - DNA, 568 bp, Diabrotica virgifera
ctctgtgggtattaaagttcttaaagatcttaaagttggttataatcttatggatcatgtggccactggaggattaactttcgttatagacaaaccttactctatcagaattgatagagtgatcaccagggagaatctagatatgtatctaaatcatcatcagggtcccttaaccatagctggaggttgtgaagtactaatattccacgacttttccaaccccggtaatcctaatgggcacccagaaatggaattgctgtatgaagctggttctgtggtgtctgattatacttttcgaagaagtttcggtattactgatgagatatacgatgctgtatacactccgatacaaaacaaagatacgttcatggtaatgcccatgttgatgaggccgaaaagtaaaggaaaagttatgttgaaagatgctaactacaagagtaagcctttgatataccccaactatttcgcttttaaagaggacatggatatattgattataggtatacgtttggctgataatatcacaaaacaaacagccttaaagggcatatgagatagattgcatgac

SEQ ID NO: 13432 - DNA, 228 bp, Diabrotica virgifera
  misc_feature (12)..(64): n is a, c, g, or t
  misc_feature (66)..(100): n is a, c, g, or t
  misc_feature (102)..(196): n is a, c, g, or t
caatttttttcnnnnnnnnnnnnnnnnnnnnnnnnnnnnnnnnnnnnnnnnnnnnnnnnnnnnncnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttagggaaaaacaggggaaaattttttt

SEQ ID NO: 13433 - DNA, 352 bp, Diabrotica virgifera
gaaaatgtaagaattaaataaaaatcacgattaaaaaatatcgtatttgaaaatatgatattatatataaatattcatatattatatttagttaggatttattcataattactaagatattaatttttttacaacagtatattaaagacgatcaataggaatattctttgatcgaagacccctatttgtttgagatggagtgaatacagaaatccttcttctattttctttaagagttttagctggatcttttactatattccttttcagatcggaattttaatacatcatattttgatccagctggcggaggggatccaattctctatgaacttttattttgatctttgtg

SEQ ID NO: 13434 - DNA, 1044 bp, Diabrotica virgifera
ccgcgtacgtagcttttattactaataactagataacgaaaaagattataaataaaatattgagtgaaatttaaattagggtcattttaatcgtatatgttaagtaaattaatttaaaacaagtagttgcgattcggttttgcaatacaataagttgacgtgaatgtgataccatatagttgcacagtgattaggatattttggtgatttttgttattcgacatgggtttgaaagacaagaattttttaaactttggaagtaacaatattatgaaaaatgagggtgataagcactcagcactactagtagaaagacccgtttaccaaatagaagaattaaacagagattacgaatatgaaaaaccatatcacacattaaaaaccagatgcaaacgagcctgtcagtcattagatccctgtgcattccttaaagagacaatacctttattatcatggttacctgaatatagctggaaaaaaagtttctccggagacatagttagtggtattactgttgctgttatgcacattcctcagggtatggcatatgcaatgttaggtaacgtaccacctataataggtatatacatggcaatatttccagttctagtctattttatatttggaacatcaaggcatgtgtctatgggtacatttgcaggagtatgtcctcatgacaggaaaaggaattagttcaagtattccgcacataaaaataaatgcaaaattggaaacgcggtatttcagtggcacctggaaaaataatgatttcccggtttaacctccccgaataacaaatggacaagaaagccaattaccgggtaacccttccccgagggctgttaaacaacctagggaggtatttcctacagaaattgggatggcctcccccgattgtggcctgacaacccaacaaaatgggatttcctttgggcattcggcattttccctgggggtgggaaccccaaccttccgtgatattcccttggccccccataggggggacaaaccataaaaaggaaaaattttgtctatttttccgcc

SEQ ID NO: 13435 - DNA, 118 bp, Diabrotica virgifera
  misc_feature (2)..(58): n is a, c, g, or t
  misc_feature (61)..(74): n is a, c, g, or t
  misc_feature (85)..(112): n is a, c, g, or t
annnnnnnnnnnnnnnnnnnnnnnnnnnnnnnnnnnnnnnnnnnnnnnnnnnnnnnnnggnnnnnnnnnnnnnngttgtgagagnnnnnnnnnnnnnnnnnnnnnnnnnnnntgttcc

SEQ ID NO: 13436 - DNA, 122 bp, Diabrotica virgifera
acccacgcgtccggttgaaattgtttaaatggtacaaaaaataaggttttgatttttctgtttcttaagctgacattttggttataaaaacgttaaattatataaataaagatttaagtttg

SEQ ID NO: 13437 - DNA, 416 bp, Diabrotica virgifera
aattctacaggccaccaaacagttatttgctcaaaattcctacaacacgtcgagaaattatgacgaaaatctaaggcatttaagagaaataatgggaattatgcaacaccatgatgctataactggaaccgagaagcaacacgtggcaaacgattatgttagaggaatacacagagcaattactgatgttgaaaaagaaatgggagaagttttcgacgaacttctcaacacggatcttaaactggaactggcttcatgtttattaacaaatgttagcatctgtaaagtatcacaagaatcagataaatttgttgtagcagtgtacaatcctctgggatggagtgtaacacattatgtaagattaccagtggataatggggattatatgatcaatgaaggtgaattatacgatctta

SEQ ID NO: 13438 - DNA, 400 bp, Diabrotica virgifera
aaggcgagctcgtccacgatcgaagcactgtgccaagtgggtcaaattgaccacattctactggctgagggagttggtacgcgcaagatcaatccacagacgcacaagtcagccagatccagatcagcgcaatacccagttctgtgttcaggaacgctcataaagatctcggatccatttgtcgacaacagcgatcaggtccattggaaagctttggtacaagtctgtctaaaacatgcagttaaagactaacctgcaccattaaacagtaatttggcagtgtgaagttcaaacttcactgtcggtcaacgacaaatggtgtgtcgagcaatagctgtagtaagatccaacatgatcacatgtaagatgaagctacagcaaatctgtatccgcacactga

SEQ ID NO: 13439 - DNA, 377 bp, Diabrotica virgifera
  misc_feature (120)..(227): n is a, c, g, or t
  misc_feature (255)..(277): n is a, c, g, or t
atgaattgatggttaatgatgctaatggagaaaggagggttatgatatttaactaaaaaaataaactgtcttaatagttaacaattattgttaactcttagttttaatttcgtctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtataaggaacaaacgattataggggcnnnnnnnnnnnnnnnnnnnnnnncacaaaaaggataagccaaactttgccatgtaggatacgaaaaagccttcaaaaagggtcccaaaaattcttccacggggcttcctttaaaacatgggta

SEQ ID NO: 13440 - DNA, 416 bp, Diabrotica virgifera
  misc_feature (138)..(155): n is a, c, g, or t
  misc_feature (252)..(271): n is a, c, g, or t
aacttttccaataacctatttgttcatcacacatctgtcattctagctatgtgtcctgcccatctcaaatttcctgctcccttcatttgctgcccaggtgccccgcacccccggccatatgtctaaatatactatagnnnnnnnnnnnnnnnnnncacaagtgccttgggtaatattatcttctaatacttttgatactttgtgctcaccattaccaaactatttttaatgtttgtcgatcccaacattacnnnnnnnnnnnnnnnnnnnngagattatctgtctacaaattacaatttattgaaatgagattgcatttctcatttcaaacctaaaatgtgatgttaaagtgattgaagatgatttcaattttaaattgaaaaagtaatatatattatgttagtaataattttaac

SEQ ID NO: 13441 - DNA, 412 bp, Diabrotica virgifera
acccacgcgtccggttggataataacacataagggttacaattgtaatcagaatagtgttgtactttatttaaatggtatatcactgacttaatatatgctaggatcgtatttattcttatgacatatgcattgacatatgggaatcttatttcattttgagttccaaattgaaagtttttaataacatttagctattatgatttagcatcaggaattcgatttatgtttgatgaagcttttctgatagtattgattatgtctcttcaaatttatatgtggtattgactacgacaaacgtatacattcatgtccaaagaaatgagactgacctttttcgggtgtagtgagaatgtcttcacataagacccgtttccagctatccttggctgcaatcagaacctcggtctggc

SEQ ID NO: 13442 - DNA, 385 bp, Diabrotica virgifera
  misc_feature (7)..(38): n is a, c, g, or t
  misc_feature (81)..(81): n is a, c, g, or t
  misc_feature (123)..(123): n is a, c, g, or t
  misc_feature (272)..(300): n is a, c, g, or t
accacannnnnnnnnnnnnnnnnnnnnnnnnnnnnnnngagttgtaaggcagactacagtgaatacttacgtattgaatanactcgttatatttataacatcaatcagaccatcaatacaaanacaacatgaagtccgtagcggtattcgtatttttggcttgcttcgcaggtttacaggctgtccagctgaaatgtgcccaccaagaactggatatcccaaaagattggatcgacatgaacaacgtttgtgtgaaaaagatgagaggccannnnnnnnnnnnnnnnnnnnnnnnnnnnnaatacatggccatgggtgcatatttcgcaagagacacagtgaacagacccggttttgctgatttaattttcaaatcagctagtga

SEQ ID NO: 13443 - DNA, 252 bp, Diabrotica virgifera
  misc_feature (186)..(205): n is a, c, g, or t
  misc_feature (215)..(240): n is a, c, g, or t
aacgtcagcccacgcgtccgggaaagtatatcatattatgatacctcagcttttgaaacactgattacaaaaatgtatattactttaatcctttttgagtgcgtaggcgcaaaatttcggtcgaattatcgatggtcgaaagtccctgagaaattctataatgtttattttaataagtcacagggnnnnnnnnnnnnnnnnnnnntttagtatgnnnnnnnnnnnnnnnnnnnnnnnnnngatgaggtagat

SEQ ID NO: 13444 - DNA, 397 bp, Diabrotica virgifera
attctgttaaatgttgatataatctgtatactattaataataaacggattatacgacatatgacagaagctcgaaacaagtgacgttcgttgaaaagccctattgaggatcgctaaatatctaggatggccctctagtatgttaaatcaattaatttgtagcaaaatatacaagatatcagttattttacacctcacttaatctggaagaataattttcttttattgataatataaacaggatctacgccgattttaaaaagtcaattttgtgaaatctgcgctgtgctgtatttaaaagatgatacaatgtagtgtgtatactgtatacctataacattttctagaagaaaatgtttactgttgttactacggcaatagttctctacacgtagttt

SEQ ID NO: 13445 - DNA, 192 bp, Diabrotica virgifera
  misc_feature (10)..(135): n is a, c, g, or t
acccaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaaaaggttcaaacctaacttacccttgaatgcaacttaaaacccctccaaaag

SEQ ID NO: 13446 - DNA, 411 bp, Diabrotica virgifera
  misc_feature (237)..(254): n is a, c, g, or t
atcagcggacgcgtgggttcggagccaaataccctcattgactgccctatatgttagtgcaccatagattgttgcgcatactaccgaccgcacatcgcacaaataattcaatactagcagaacttaatataaaagctagaatcaccacaactttcgatcgaaatatactgggatatgtattattatgctctgtattttctctctgttatgagattgatcggcatctcattatttcgnnnnnnnnnnnnnnnnnnttgattgctactcatgaaaacaaaaccaatttcagtaaaactttacaatagaaaatattctcagggctaattaattttaatgtattacctttagtttgtggcttgtagtatttctcgttgcttactttatccaggacaaaagagggaaaacaaatat

SEQ ID NO: 13447 - DNA, 233 bp, Diabrotica virgifera
  misc_feature (2)..(21): n is a, c, g, or t
  misc_feature (23)..(78): n is a, c, g, or t
  misc_feature (86)..(117): n is a, c, g, or t
  misc_feature (127)..(153): n is a, c, g, or t
  misc_feature (156)..(186): n is a, c, g, or t
  misc_feature (209)..(231): n is a, c, g, or t
gnnnnnnnnnnnnnnnnnnnngnnnnnnnnnnnnnnnnnnnnnnnnnnnnnnnnnnnnnnnnnnnnnnnnnnnnnnnnaccaggannnnnnnnnnnnnnnnnnnnnnnnnnnnnnnnccaatttaannnnnnnnnnnnnnnnnnnnnnnnnnnggnnnnnnnnnnnnnnnnnnnnnnnnnnnnnnntgaaatggtaatccgttttaaannnnnnnnnnnnnnnnnnnnnnnaa

SEQ ID NO: 13448 - DNA, 409 bp, Diabrotica virgifera
actttgataccctctcagtagaacctttgttctgcgtttcgcttgaccgaccgcagtgtgtttctgtacacaatcacagtggtcagctgtgaagggtctagctttggtaaattcaaggagatttttcaaagctgcctctccgtctataaccctattatactatattcgtgcattttaaattgtgtatgattataaaaatgctccatcattttttcattagggcatatttgtctgttgttgttttagtatccagtcaataatggaaacaatattgctgttacgtcaaataaatatttaatcgagatatacgctgtgagctcgtacgtacagcagccattagctgtcatattactgtccaatcttgacaagaacacaattaaatattttttctttatagattcaattgttc

SEQ ID NO: 13449 - DNA, 408 bp, Diabrotica virgifera
agcagacgcgtgggttcaaaatgctgccacagggcttttgggtactacttggatgtttgttgtactacatttataggtgctattaatgcatcgttcatcattgttggcaaagaaactggtgttggggatgttggtttagcaataacacaagcgtttatgttgaatggcattgcccaatacgccattaagctttgggcagatattgagaataaaatgacatcggtacaacggattttggaatacgttggtataaacacagaagacaatgaccttagggacatatttaaagattggtcttcaaacaatataatccaatacaaatatgtacattttcgttacgattatagtcaacagtatattttaaaagacattactattacaattaatgaacgagaaaaagttggaata

SEQ ID NO: 13450 - DNA, 366 bp, Diabrotica virgifera
aacagacgcgtggggggatccatacgttcaattagtcaatgtacgtacgatatcgctgtgatagacttcatgtggatccatactgttgactccaagttataaggcttcacattattatacacaatctgcacagattgtatcagtagataaactctacatgatttcacagatctagatctctttagcagaatagttctgcactgagaattatactcgcaccgattagatcatcgtcactttagagaattacggcattatgttgggtgcgaaatatcgcattttaactacaaccttagtacccaacgcactgtaatttcatgtgatgtagacaagtaattgatacatgtatctgacacattgcactct

SEQ ID NO: 13451 - DNA, 413 bp, Diabrotica virgifera
  misc_feature (10)..(10): n is a, c, g, or t
  misc_feature (142)..(176): n is a, c, g, or t
aagaacgtangtgtaataatacttgaaggttgttcaatcgaattggcagaggacgatgctcagtttagtttcaaaatagattttcatggaacgaataataggagctacatattgggggcagagtctcaagagtccatggaannnnnnnnnnnnnnnnnnnnnnnnnnnnnnnnnnnttacatgaaactaatggttgcagaactccaaaggcaattagatgatgtagaagaaactccaatgcccatttcatctccacagcctgttgggtcacctgtcccaccgcctagaacaaggcataacccttttaatagaccagagaataacccccatcagagatcatagtttaaggtctacaggatcagcagcaagtcggttgggtgagaacagaatctcagacaacaatgtagcatcat

SEQ ID NO: 13452 - DNA, 212 bp, Diabrotica virgifera
  misc_feature (30)..(30): n is a, c, g, or t
  misc_feature (51)..(69): n is a, c, g, or t
agattttgttgctggtacgtaacccctagnaagaatcctaatagaaacggnnnnnnnnnnnnnnnnnnnccgtaaagaaaggatattaccaaaataaaaatggatttccttaactttggcattggcatttacaccgtaaataattggaaaaattaattatcaagagagactcattttaaaacttttacaaaaacccgtaggctcaaaatttt

SEQ ID NO: 13453 - DNA, 412 bp, Diabrotica virgifera
  misc_feature (390)..(390): n is a, c, g, or t
agcaaattgtatgaggaactcgaacgagaaatggagaagttacctagagaagacacaatactggtaatgggagattttaatgcccaaataggtaaggaagactacattaaccaagtagcaggtaagcacacaatacacgaaaaaactaacgacaatggccaacgattatgtaatctagcatctagtaccaatatgattatcgttagtacaaaattcgaacatcccaaataccataaagtgacgtggatttccccagaccaaaaaacatggtcacaaatagaccatattctgattacaagaaggaagcaaacatcggtaacagacgtgaggtcctacagaggtgcacatgcagacacagaccattttatggtgactgcaaaagtaagacanaaagtcaaaagaacactaaaaa

SEQ ID NO: 13454 - DNA, 223 bp, Diabrotica virgifera
aagaagtactgtaagcaccactgattatggactcaccgatcccgcactcgtgttcatgagatcagttttaatgatacaaaatatgcagttaatgaattcactacgtcaaacgctgccatcccgcacaaacgtggacacttcattgacatcgacgagcagttcaacttttacaaggaactgttcgatcacttcatgatgccatctggattgttagtgggactat

SEQ ID NO: 13455 - DNA, 405 bp, Diabrotica virgifera
  misc_feature (9)..(59): n is a, c, g, or t
aatggccgnnnnnnnnnnnnnnnnnnnnnnnnnnnnnnnnnnnnnnnnnnnnnnnnnnnaccataccattatgtactgacagcgtcagtactatcaagttcgattccaagttgttctctgttttcctccgcatttttgatttccacactgcaggataccaccggggtgacatatccatctctttggtgtgcttcatcactgagttgtcttcagaggatttcatcgctatccttaactccaattacattcacaagcctaaactagagagtacatcccgctttgtacatgatcctcatgtgaatgttactgactcacgtgactggcgagaaaaatgatcaattaatcgcgtgttggactataagcaattctgatcatgtcatgcatttaatgcagcaggttcacatg

SEQ ID NO: 13456 - DNA, 102 bp, Diabrotica virgifera
aaaattagtcggattataccaaaacttgcctcatcaatatttgttcggagtataactctacatacattacattgggaccatacatatcttaatccacaacta

SEQ ID NO: 13457 - DNA, 405 bp, Diabrotica virgifera
  misc_feature (230)..(250): n is a, c, g, or t
  misc_feature (357)..(357): n is a, c, g, or t
aggatcttttgtggcgcgtgttactttaagtttagcaaatattgtggcaaaatttttgaaagtagatctagaattttgttttcgatcaaagtgaagatgcatttttgcgccacgttatgttcatatccgctagctggagtattctgtgcgccgctcatttttacgacgtttagcggttctttattcttgtttacatgatacagtgtataatttacacatacatggaaatnnnnnnnnnnnnnnnnnnnnngcatacgacgcatttcctagataagagctatggtcatgtgtgagacagaaataattggttcctgagaagtacatttggctgacgaggtttactgtcagagaaggtanagaaaggaactcatatttgcggatgatattgtattagtggaagagagc

SEQ ID NO: 13458 - DNA, 379 bp, Diabrotica virgifera
ctctaagcatgtgcacttaatatctttgctgttcgcggtattttgaccctgactgggtcccatacgcattaatttttttcatgtgggcagttctacagggtttggtaacgattcgtctgtccttggttaatttagcctgccttttaatttcacattaggaatcttcgttttatttaggctcctacaatagcccataggcttgtagctggttcttatatagcttgtcttaatgtgtccatcattcatgtaccatatttatttacttgctgtgcttagatttaccctctaacatttattagctgcatgtcttaatctcagatttgctggtccagttgtattgctgatagatcatagattaccttacggatcactgcgttca

SEQ ID NO: 13459 - DNA, 408 bp, Diabrotica virgifera
agattttatgtcatcacccatgtctgcatccataactcgcattataatgttttcgttaataagtccaaatacattcctcagcacttttcattcaaagacttccagctttctttttgtattttctttcatcactgatcacccatgtctgcatccataactcgcatactattggtctgataaaaatttttagaccctaaattttaatctccagtgtgtgtttttgaagcggaatacatgagtgaaaagcaagctttatttccctttactattattctttaaaatgtcctgttcttctgttttatgcatttcaactctcagttatgtgaaactttctactatttcgatatcgtcctctaattcaactgggcgtctgtttcccctagctcttgcctgtgttagcttttttgt

SEQ ID NO: 13460 - DNA, 408 bp, Diabrotica virgifera
agatctgcaagtaccgcgatacatacctagtagagagaaagaaaccatttaactacatcaccaagttcagcatagaatccctacaagacgaaagtactaagtatctctaccgtaagagacttgagaaaaggatcaatcttagccctattgaaatcacagacaatataaacgaagcatgggaattaataaaaaatcatataaccactagtgcatgagaaggcattggagaaagaaagatagacttaaacagcggcaaaaagcaaaaaccaaggttcacacaggaagtcaaagagttagcattagagaaaaaagatgcataattaagatatattaacaataggaccccagaagagtatcaaagatatacatcagaatgaaatagatcatctaacagaatcagagacctaa

SEQ ID NO: 13461 - DNA, 367 bp, Diabrotica virgifera
  misc_feature (68)..(104): n is a, c, g, or t
agcaaatttgtaaggggactccagctgtcggacgtaccagaatttagaaaaattattagtatgattannnnnnnnnnnnnnnnnnnnnnnnnnnnnnnnnnnnncgaaaattttccgaaatagaaaagttctccaactcgacattaataactgagtaaaaaagtctcattatggaggtaatattttttttaatggtggtccaaagacctgtaaatttacctccaaaatatttaagaatataaaaatggttctaaatatataaattctaattagattatctgcacccgggggctctcctataagtcattggtacttttgcatatatattctataaaataagcgtgcatagattgtaacatgtatgtat

SEQ ID NO: 13462 - DNA, 393 bp, Diabrotica virgifera
agggaccaccaaatgtagcgattttagacgaatcagtttgatgagtcacaccctcaagatacgtttacgtattatacaaaaccgagtattccttctatgcgaaactagaatggataataagcaatttggatttagaaatggtgaaggaactagagaagcactattttgtatgcgcgttctcttacaaaaaagttgtgaattccgaaagaacgtttatgtttgtttcatcaacttcgagaaggcattcgactgagtacaacacgatacatttttcgattgcctgcagacagcaggacttgaccgctacgatataagactgctggaatacttatattacaaccaagtagcctctatccaaattggagacagtcgtactgaaaaactaacgattaa

SEQ ID NO: 13463 - DNA, 389 bp, Diabrotica virgifera
agaacaaattcactataaaactccactttaaccctgataaaacaagaagagaacaaaataaaaaatgacctgaaacgtcaaacaggtaaacagtaacactatgagaatggcgcgcgcttggggtatgcaactagtgacgtcaggccaatagagaagcgttcttgaaatttaaaataatgctagatttctaataaagattttttatagaaaggctttttcagttttgttgaaattttggacaattattcctagggtgtttcttaatcgttttacatgtttgaaatgactttttaattttttgtgaacatccctattgtgcagctcttacaagaaaagagatattccgataatgccaggaacaaaatcttagtgatgccccggggataata

SEQ ID NO: 13464 - DNA, 353 bp, Diabrotica virgifera
aagtgtctttgcagcattttggatgtatgtaccgatacaattgttacatgtattatttcggagtatctaataaggataacaattacgaggattttcggatactgttaaaattggtaataatatatggtgatgccatagttggcccaagtgcgttgtgtgcacatggcagtgtttgctgtatccatgatactcatttttgcatgcctatcgtatctcaatacgaatcagctatatccatcagcaatctcacaacatacctatgaagtataactagtccaaagtaatcaaaatgtgatccatttagattcagaattgcagctgtcactgggtgttccctcgaatcctgccacaaa

SEQ ID NO: 13465 - DNA, 363 bp, Diabrotica virgifera
agggtggaaacataaggattatccgaattactcgactgaatcaattaagaagaagaaaaaatgtgtcaagtgtacgttgcatctgcaatattaattctcgcgattgttgattgcggttttgcactgcaatgttgggattgtaagtctgaattcgatgttacatgcagagattacttcaacgtttcaaggatagaagaaaacaacagaatttatgaaaactttaatttccaacaaagtaatagcagacaattttcaattggtaacagaaacaatcctcgaaaaatacattgtgatggaagttacgtcaatagttataatcaaaaaaccgtctgcttaaagacagtgtccagaggtttttccggc

SEQ ID NO: 13466 - DNA, 244 bp, Diabrotica virgifera
  misc_feature (60)..(77): n is a, c, g, or t
ctcaaggttttaggtttttttttccgttgtttatgccttttattccctttttttgggtgnnnnnnnnnnnnnnnnnngggcccttttttttaattcctgggggggggaatcccccggttttccccggtattcccccttttgaaaaaactccttttttcgtaagggggttctcccttttaaggggctcgcatttttcccttttcccaaattttgttcccctttatgggattttggaccccccttt

SEQ ID NO: 13467 - DNA, 374 bp, Diabrotica virgifera
  misc_feature (355)..(355): n is a, c, g, or t
cgacagacttccttactaaaatagaccaccttcagtgtgtacaaaaaaactgggggagttatcagaaattatatacggatggttcaaaaatggaaggaaaagttggatatgctatatattacccacaaaaaagtataaaaataaacaacagattacctgataaaatgacaattttcacagctgaactcattgcaatcaaagaagcatacaaaatatgtattaatcaaaaagaactcaattatgttatatttaaagactgccaaagcattgttaagacattgaaatataatgtacataattttgcagaaaattatatcatcagtgacatcatagcaatgaacagtgaagctttganatcgggcaaaaatataata

SEQ ID NO: 13468 - DNA, 393 bp, Diabrotica virgifera
agcccacgcgtccggaatctttggagaaaagcttgtaaaactcaaaatttgaatgaggttaagtaacttctttttgacacattttctatttatttaaggcaaaatggtatcgtatgctgaagaggaccccattgaggacgaagtagaagttgaaggggaagtggactctgatgttgaagcgacgactccagatgaagaagtggatgaagatacaaagtcactttcatcaccatatgctgatactaccctgttgtttgtgaagcctgaatctactggagcctctcaactagaaattccggctggccttcctgtcgaattccttgtaggattccgcaacaaaggtgatcaagattttgttgtagacacccttgaagcttccttccgctatccaat

SEQ ID NO: 13469 - DNA, 224 bp, Diabrotica virgifera
  misc_feature (24)..(47): n is a, c, g, or t
aggaaataaatcccaatgttttgnnnnnnnnnnnnnnnnnnnnnnnngtaattgttttgatcgaagcttattctttgggctttactccctgagtttataagacacttagataaatttaataacaattaagataagggaggaacttaaaaaaaagattaaaaagagcaatgaaattgtcgaaaaaaaattaggattagcaattggcagatattaaacatatgggg

SEQ ID NO: 13470 - DNA, 253 bp, Diabrotica virgifera
agcagaattatcgtagggcatgactaaatttatttttctgcattcacgacgtttgttgcacacaatgtcattctctccacacgcaaattttttcccgacgatgggctaagcatattgaaatccatacctgatagcagtcacacatgtctgataatactcgtgatcgatataggatacggtctcaccagagcgagcacatgatcatagtccatacattatacaggtatcgtattgttataactgtaacgcttgc

SEQ ID NO: 13471 - DNA, 356 bp, Diabrotica virgifera
agtgtagatttgtctgtactgttttgctatacgtcactcattatcaggattgtcttacaaatgtgattagagcgagtatgtctatgtcatggataaagtattatgcgccaacctgagaaacattgattactgctgctgacaatcttaggaccatagcattcaaatgactatagcatccaaagtgcgacactgtatatacgaagtatccagattgacacacattgtagaaaatggctcaatctgtcagtgattgtagttcgtttgagcgagtagttaatccagataagcatttcatggggttgaaagcgaggtgatcattgatacataaagctatcgcaaaggcacaatatatgcgc

SEQ ID NO: 13472 - DNA, 134 bp, Diabrotica virgifera
cgtccaattctagatcgcgagcggtcgccctttttttgtttttttgtctgttttaatatttatctacatggagcaattattttagatatgtgggcctttcgtacgagtatacagggatagattaatgattgtca

SEQ ID NO: 13473 - DNA, 416 bp, Diabrotica virgifera
  misc_feature (73)..(99): n is a, c, g, or t
cttttgcgttatttttccggttattggcgcgctcgccactgtatagtaataaatatgtgtactctaaattagnnnnnnnnnnnnnnnnnnnnnnnnnnnctaaattactacattttttttttcatattatacagataaattaataacttatgtatgcttttcagttgtgacatcacctgcataaaataaagacataaaataaactaaacttttgttctgtcatatacagtgatgagcgcgctaataaccggcaaaatagcgcaggggatggaaggcatcatgcattgtgacataaaaggagatgaaactattagaggtggaagtggtcgatataaacgtgtaaattaacataacattacagagtttttcacttttagacgcatcggaggagtatggcaactgtcgctgtgacagaa

SEQ ID NO: 13474 - DNA, 190 bp, Diabrotica virgifera
atgggacactgcactatcagtaaccactgttgcaggtatcatctcattacccttcgagactgtccttcagcgtatagtcactcagtcttagacgtacataagacgggattcttcaacattggcaatgatcagtgatgagggacaatctacatgaccatgtgtaactgtgacttcatgaacggaactttca

SEQ ID NO: 13475 - DNA, 423 bp, Diabrotica virgifera
  misc_feature (81)..(104): n is a, c, g, or t
acaaaatagacagttgacaaagacaaaaaaattatttgcttttttcaattttcaacagctcaataatttgtactgtaatcnnnnnnnnnnnnnnnnnnnnnnnnccttcttaaaacttacaaatcatccataaaatgactgacaaagccaaactggatcttggagttttggaagaggatgacgaattcgaagagtttcccgtcgaggattggtccggcaaagaaaaggacgaacaggatattagtgtatgggaggataactgggaagacgataacgttgaagacgatttcaacaaacagttaagagcccaactcgagaaacagaaagcaaagcctccagcaaaatagaatttataagtgatctaattccatctaaaatgtatatttatctctaattaatgtgtttgtaataaaataataaaaa

SEQ ID NO: 13476 - DNA, 277 bp, Diabrotica virgifera
agacacaagtccgagctttatgtcagtaatctgaagtacttcaagggatgatgcataggattaacatatcatatgcgatttaaattgtaccgtatggactaagttcacaacgtctcatatttgagaatatgtaagtacatacgttgatacaacaatggatttagttgttacaactttttgtaggacaatacgaatttaaactagttaaatttactagtgatgattgtactacgattctccaattgaatagatacgtgcattcaatacgtttaccaat

SEQ ID NO: 13477 - DNA, 181 bp, Diabrotica virgifera
cacggcatatctagtcatttctaccatggctgttaaaactgtcattgtggtacgcccgcatatatgttgaatgacataatatgaactcttatgatatacctctttatatgtaatataaatactagattatattgatacatttttagtataccgattttctcttctctggtaaattagtcat

SEQ ID NO: 13478 - DNA, 408 bp, Diabrotica virgifera
aagtccacccacgcgtccgactgatcccattagtttattacaaacatacacaacggatatacccaattttatttacatgttaacaacaattaagccatattttacagaaaaaagcatgaaaaccaaatgcactaaattaataaacaaaatcgaaaaaatgctagacgatcccgcttatcaagatagtgattgttcgacaaattcagctccagaaataaactaaaatcttcgaaccgatactacaaactcctccgccctggacctttcctcccgcaatatgtgatctaactctttctaaatacaataagcttgataccccttatgcaacaattaatcaatcttttctcaacatacttgcttctttcccagatcattgttatatttatacagattcatctaagactgctg

SEQ ID NO: 13479 - DNA, 189 bp, Diabrotica virgifera
  misc_feature (65)..(112): n is a, c, g, or t
  misc_feature (117)..(141): n is a, c, g, or t
ccgggccgacccacacgtccggttttacttactgttgaatgtacaataaatttttattgagaccnnnnnnnnnnnnnnnnnnnnnnnnnnnnnnnnnnnnnnnnnnnnnnnnttgtnnnnnnnnnnnnnnnnnnnnnnnnnggaggccgctcaaaaggtgtcaacttgtatatcagggagcatgaaata

SEQ ID NO: 13480 - DNA, 385 bp, Diabrotica virgifera
cacatgcgtcaggccccatcacaacatcatggcagacgcatccaacgcacaaactctgaagttagcaaattcacggacaaggtttaaacaattacaaccgcttaaaacctagaggtctgccacagcgtcagttgaaaactccaaacaagatctaccttcaacaactacaattgataacccatcagattcatcacacagttcaattaacacataaagtgaacttccaaatgtaacacacactcaattgccaacctatttcatgaacactgcacaatccgatccaggatcattttttgagaatttgtctacggctaagaccaatgctggagactttgggaacatttctgaagtagtatcaagtccaaggtctgcacaacatgtaacc

SEQ ID NO: 13481 - DNA, 145 bp, Diabrotica virgifera
cgttcgagagagagaattttatgtgtatatatccatttgtttgatcgtctgtcgtgcagttgtaatcccaacatgagcctttcgagttttctctgggttagttcgattgtggttatgttgggctttggtaatgtcacgggttttt

SEQ ID NO: 13482 - DNA, 330 bp, Diabrotica virgifera
aaaataatacaaaagaaaaaaatgatgcagattaacaggaagctgcttcccattaagggccattacttcttttttatggcagcaatgggcccaatccttccacagctcaacgtcatcggtaaagaattgggagtatcctcctttgtgatgggtataataacgggtaatcctccaatgttgtttctcctggctaaaccagtattcgggctgatcttggatatatttagggactacaggaaatcaatttttatcgcattaatcgttgcaaacacagttagcgtctggggcccggagtacatttcccagaaaactggactgcgaatagcgttt

SEQ ID NO: 13483 - DNA, 436 bp, Diabrotica virgifera
  misc_feature (75)..(109): n is a, c, g, or t
  misc_feature (140)..(167): n is a, c, g, or t
  misc_feature (196)..(213): n is a, c, g, or t
  misc_feature (217)..(247): n is a, c, g, or t
aatagtgaattaaaatacatcagtaattgtgactaaatccaatataaacatcattcttaaaaaaacttaaatttnnnnnnnnnnnnnnnnnnnnnnnnnnnnnnnnnnntaatctgaaataaaataaattcaaataaagnnnnnnnnnnnnnnnnnnnnnnnnnnnngtttctatattcaaaattctgcaaatccnnnnnnnnnnnnnnnnnncagnnnnnnnnnnnnnnnnnnnnnnnnnnnnnnnttttagaaagcactgattctgtaaagaaattgatttcttgcatcgaagaacaagaaaatggcatcatggcacttcgcgtcaatttcgtagcaggcgtcggtaagtgcataaaggacgatctcgtcgctttggttaagactgtcgcacctttgctcaaagatctatctggtatccatgaagatgccaaaa

SEQ ID NO: 13484 - DNA, 393 bp, Diabrotica virgifera
atctgatttaaccaaaaaaaaagatcaacattttgagttatgtcacttttctttaaaacagttggtcacttttttaaatattaaagaaacatactagggagcttctctaaatacaacggttttcctgataaataccgattcgttctcgtcaaatgtcttaaaaccgtcaaatgtcttacgaagttggaagtaaacatctatgtgacacttttcctggtaaaagtatcgaattttcggagccaatttaacaagataactgcaaataactggacttatgcatttttgagttgtgtctttttcttccggaccagcgataggtaaatgttcacaaacgacacacgattttatcaaattatttttatttaacttagactccctttgcagatcaaaatt

SEQ ID NO: 13485 - DNA, 412 bp, Diabrotica virgifera
  misc_feature (2)..(2): n is a, c, g, or t
  misc_feature (189)..(208): n is a, c, g, or t
cngatatttttcgaacgatcatcggataatctagagaaatgcgattggcaacactgccattgacacaggtacataagcgttttgagtattacagtgttggtataaagacagtaacttacatcagatgaatacagttatttcgtaaagatacagttgttacaatattattttttttaacgaacaatgatnnnnnnnnnnnnnnnnnnnncgatgatatattttgcaatcttttaaaaagtctattagggcactgtacacatttggcgaactaagtatttgcttgaggttaccgtttatgttatgcgctagtctatacgagctgtaataactacactcaacaagtaagtgttccactgtaagccggtgagagttacaatgttcacaaacaggtggattttcggaagtcatcaag

SEQ ID NO: 13486 - DNA, 369 bp, Diabrotica virgifera
atcccttacaagttcaaatagtggcaaaattaaaggatggtcctttgctgactattaagttttcctacctaataaaattaaaaatcattacagtcatgtctagcacgaactgctcagcatgtaaaataactggcaactcagctagggaagtgttaaccggagagaaccttctgagtgagttggtagaagatgataatggcctagaaagtccaaatccaataacgaaatttcagattaagaagatcggacttacttcttttcaatcgttagtgccacagatcggatacgcataccattgggctcaaagagtatgcggaagagattttcttaataaaaaaatggattcggatgaattaggcagaactaatg

SEQ ID NO: 13487 - DNA, 367 bp, Diabrotica virgifera
  misc_feature (202)..(229): n is a, c, g, or t
gttggatttttaccaagataaattgacgtatcgtgcaatgcatattgtagactccccatgtctatccatttatcgtctgttgctttgtaaattgtagaaggctcgtatataggttgtaaccagaatttgttttccagcgtaacgaatcttttgttctccggttccttggatttattttggctctttatacattttaagttgnnnnnnnnnnnnnnnnnnnnnnnnnnnnaggagaaatcttgtttacgacaatcttttatcgggagtgtctatcaatgttcgtatgccaccgggaggatattttaatagacccataacgtgccttcaactaattgatcgacagggaaactctgtttctccaaaagat

SEQ ID NO: 13488 - DNA, 65 bp, Diabrotica virgifera
aacataaaaggggaggccactccaaaggtcctaaactaaggtccccgtgattcagatcatcaaac

SEQ ID NO: 13489 - DNA, 380 bp, Diabrotica virgifera
  misc_feature (97)..(114): n is a, c, g, or t
tgcaatgttggtgaattaattaaactgatttttgtgtttatttttattgcaacttctaataaattataaaatatcgattcacataataataatcaannnnnnnnnnnnnnnnnngtggaagaaggaaatatattgcaatcatgtagatggaatcccgcattctttaagaaaaaaaaagcaatttccagaaggaaactaccaataataaaataaagtagataatgcaagaaagaacaaagccattatttaacatagctcaacaacttcacatagaaaaagatgaggaaagggcgcaacagaagtatgccaaataaaagggtagaagggagacacagataagaagtggatttattcaatttaaaaattaaactgcaaatgac

SEQ ID NO: 13490 - DNA, 309 bp, Diabrotica virgifera
tattttttaacggagttccagttgtatattgatgagtatcaatttacattctaaaatatctgacataacgaggtactcaacttgtaagtatcaagattctcttagttgtagacaatcaaactttatttcttactaattgaattacagcgattactcatttctggttatagatttattagttacatattatagtgagccaattatattctcaattttactgctaaatacatattttaaataacttttatgtaatgcaatgtatattcgttattaaatatacctaattttttaggaagtacattccattta

SEQ ID NO: 13491 - DNA, 415 bp, Diabrotica virgifera
  misc_feature (325)..(345): n is a, c, g, or t
cacacgcgtccgattgactttctagatagagaattttatgtgtatatatccatttgtttgatcttctgtcttgcagttgtattcccaacatgaagctttccatttttctctgagttatttctattttgtttatgttggcctttgttaatgtcacgggtttttaggtactgttgcatctttatgctttttagtatccatcttaactttccaaacgctgcccacgccaatctgattcttctttgtacttcaattgtttggttctctttattagctttgattatttgacctaggtatatatattcgtcaacaacttaaatatttacgnnnnnnnnnnnnnnnnnnnnnctctcatttggtatgccacattctgtcatttggtcaacgtaccacatgcattgctaaaatctcctcgatg

SEQ ID NO: 13492 - DNA, 439 bp, Diabrotica virgifera
  misc_feature (328)..(345): n is a, c, g, or t
atattttcgcgggcaaaagaagtgatgatttgaatttgttaaagaatatattaaacactttctgcccaaaaatttcgcccggcacccttctgatatgtttataggggatattttttaacaagaatccacatagaaaccgaatcagaacagtcagacacaggcagcataaatcctgaccccggaagtatcataggttttcgaaacggaccctcagggaaactaattggtgacccctgccctagagcacctgttgcccagggtcatcttctggagtttcgagggattgcggcactaaagtgatactaactcaggggattttttgggggtnnnnnnnnnnnnnnnnnncatcagaaccgactctcagagcaccagtgaccagagtgaatgatatgcacgtcattttctggaattttgaggccttccgacactaaaatgatgc

SEQ ID NO: 13493 - DNA, 95 bp, Diabrotica virgifera
  misc_feature (2)..(20): n is a, c, g, or t
  misc_feature (25)..(71): n is a, c, g, or t
cnnnnnnnnnnnnnnnnnnnatacnnnnnnnnnnnnnnnnnnnnnnnnnnnnnnnnnnnnnnnnnnnnnnntaacatgtcattttgtattaaata

SEQ ID NO: 13494 - DNA, 358 bp, Diabrotica virgifera
ctctaaattgagtcgtaatagcaggaattattatattaatggttttaaaagttgacaagtgcggacatcatgtaaatttttatgcgagagtatttgagatacagctaagccagtttaatatcatgtaccatgtgataccaggatgaatctcagttgcggatcaaggactaaaattcacctaatttttactttcaatttttttatcgtgatatgctggtataattttatttgcagttggtgcgattagacatagtctaccatacataatatgatctaatccttaacagcgatatatttttcattaccatatatgattattgctactggaacatttatcattcttatatgctttttggga

SEQ ID NO: 13495 - DNA, 121 bp, Diabrotica virgifera
ccagatatcttttagcatgggtgtcgagcgctttgactgagtgatagctagttcatattgtgcgagagtatttgagtttcagctgacacatcttgggtttatgtcccctgcgtagccggga

SEQ ID NO: 13496 - DNA, 215 bp, Diabrotica virgifera
tgactcgttaactaatatcgagagcctacaattatcacatggcactgggctgtaagtgccatataacattctcttcagttggaaccttcagttactatggagatcagatgtgttaccataactttgtgatcaaacagaatcgttcaactattatcatcttgtcaatcacgtggcatgctacatcacatgtgaacaatcacatggatgaattaact

SEQ ID NO: 13497 - DNA, 346 bp, Diabrotica virgifera
gaagtagcagccaatgaggaatctttaagacaagcagttggtactgttggtccaatttctgcagcaattaacgctaatcccctccaattctactcaagtggtgtttttgacggccagtgcgcaaatagcaggaatgacttggatcacggcatcctggtcgtaggttatggtgaagaaaacaacaagccttattggatcatcaagaactcatggggtgcagattggggtgagcaaggttacttcagactggagagaaatgttaatatgtgcggattggatttagtgacaagttacccagttctgtaaacatattctcagtcttcataattgaataaaatgtttttat

SEQ ID NO: 13498 - DNA, 430 bp, Diabrotica virgifera
gacatgacttcacacttcacttgtcggccttaaaatcacttcgtattttgctatagtattaaactatcttatgttagtatatcagatattctctaccatatacagcagctctagcaaattgctactaatgtgttgctggattaacacaaaattattgggacagtttgaaacactcgcttggttgtataaggcacacatcagatcggcctccgcgtcatcatgagtgtgccacatgacttaacatcagagttaacgctcccagcggataaagattgagttttagtgattacactaagtgtgttctagcatgtagtttggtatgatttgacaccagattattgtactgcattacagcgcatgttcagtccagaaactgttgtttgacagaacgcttgtatagctgactagataccaacgtcgaatgtgatat

SEQ ID NO: 13499 - DNA, 406 bp, Diabrotica virgifera
aaagcggatgctaggatattgacgaaacatatgccacgatagtaaaaatcggcaggttgaataaaggtgatacggagcacgttttccaccagactatttaagagaggacattctgtaggacataaaaattcgctcatacccgctgatggattagaatgagccatgtaaattgactctgttatggtaagatgatcagtggatgaaatatcgaatgctgggataaagggatggatgatcataagcctgtcttaactgatgttagaaagaactaaatttataggttaacaggcgaaaaattttttagcataagatcagacggtaaagtgtataataaaatcacttttggctcagtttaatatggtgtttaattataaaattcaggtattaaagtggtgtgagcaaaatg

SEQ ID NO: 13500 - DNA, 358 bp, Diabrotica virgifera
  misc_feature (259)..(296): n is a, c, g, or t
atctaactcatattactaaaatcttcttcatcatcagtaccatcattttggattcaacaacagctttatcataccgtgcaacaatatgttattttgacaacatcatcatttatgtcttgcaccttctttaacacggattataaatgattaaatagatagtcactatttccgcgattcattcaccgacaaatttgacaattttattgctaaattgctatttgatacaatgttcttgcatacgaatgtctactcattctcnnnnnnnnnnnnnnnnnnnnnnnnnnnnnnnnnnnnnngttactagcaatacatttataaccagagacttttatcacaatactaatctccacttttacgg

SEQ ID NO: 13501 - DNA, 230 bp, Diabrotica virgifera
  misc_feature (87)..(177): n is a, c, g, or t
atgttaaaagactcgacatgtttgtataagtaattcttgtaaatatgtacctacatgtactatattatttctattaaatctcgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggataaatgataaagaaagcaagaatagaacataatataaacttcaatagagt

SEQ ID NO: 13502 - DNA, 86 bp, Diabrotica virgifera
  misc_feature (14)..(34): n is a, c, g, or t
agttagattagacnnnnnnnnnnnnnnnnnnnnnaatgaaaaagagttagatgatacatttaaatattttaagaaacaatgaaaag

SEQ ID NO: 13503 - DNA, 263 bp, Diabrotica virgifera
  misc_feature (2)..(15): n is a, c, g, or t
  misc_feature (25)..(252): n is a, c, g, or t
annnnnnnnnnnnnngtaaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccatccttt

SEQ ID NO: 13504 - DNA, 374 bp, Diabrotica virgifera
  misc_feature (139)..(156): n is a, c, g, or t
  misc_feature (176)..(195): n is a, c, g, or t
  misc_feature (267)..(286): n is a, c, g, or t
gttttctcaggattcgaaaaaaatgaatccccatttgaatagcattgcaggcgaaaatacgtaccgatcctcttaataacattgcaatttttataagtaatttaatagatctatacagaaaaaaaacgtagaattacgnnnnnnnnnnnnnnnnnncacaaaaatacgaatttacnnnnnnnnnnnnnnnnnnnncaaatagttttaagtcatcttcatcaagatcgatattatcttcgtcttctttcgaatttgcgggctattcgnnnnnnnnnnnnnnnnnnnngttttataaacatactccttcatttttgaagataaaaagtttttccacaaatgattttgtaggggttttgaagagctatcagaatatg

SEQ ID NO: 13505 - DNA, 334 bp, Diabrotica virgifera
  misc_feature (23)..(161): n is a, c, g, or t
  misc_feature (200)..(229): n is a, c, g, or t
  misc_feature (254)..(276): n is a, c, g, or t
  misc_feature (319)..(332): n is a, c, g, or t
acggacgcgtgggatcgcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctaaataaaggaaatttttgggaaaattacaaaatnnnnnnnnnnnnnnnnnnnnnnnnnnnnnncggttggccctaccaaaaaagggcnnnnnnnnnnnnnnnnnnnnnnngggtaccacaaggggaaaaaattttagccaaacttgagccagnnnnnnnnnnnnnncc

SEQ ID NO: 13506 - DNA, 444 bp, Diabrotica virgifera
  misc_feature (243)..(262): n is a, c, g, or t
  misc_feature (433)..(433): n is a, c, g, or t
agatttcctaggcccggtttttcagcgagaggttaaaattttggttagctaacctagtttatattttaaccaatattttaaccctcctgacgtttttcagtgctttataccaagttaacaaaatctcggttagttaaccacttattttcttctgttggctgcagttattgtgcttgcgcatgtgcaattcgagaaataatgatcaatttgacagaaaaataaatagaaacaatttcataaccnnnnnnnnnnnnnnnnnnnntgcaatatcaagttcgaagtctttatttagttcattgttcataacatctacctcggtttcataacaaaagagaccattacaattactgggtgattgtaaattgtgtcttggcaggttgcagattaaattaaaaactttctacccttttctcaatgagtacacaatgggtcncaaccatctta

SEQ ID NO: 13507 - DNA, 321 bp, Diabrotica virgifera
ccaaattcccaacgggcggcccaaagggttcaagccttacttacgctgcaaggcaagttaaaacccctccaaaatggccaccaaattcaattcaatgggccgtcttttaaaacgtccgtaatgggaaaaccccgggggtacccaacttaaaccccctggaacaaaaccccctttccccaaccggggtaaaaaccaaaaaggcccgaaccattgcccttcccaacaattggccaacctgaaagggcaatgggaacccccccggtaccgggcaataacccccggcggttgtggtggtaaccccaaccgtaaccgcaaaacttg

SEQ ID NO: 13508 - DNA, 390 bp, Diabrotica virgifera
caaacatcacgattttcctgctgttcctggttcaagattaccagacgtaaagaggatagcaccggaattctacgacaacctaccgcagcaccacagctggagtgcagtgttatacgacttcgtgatggatccagatgtaggaccttacgccagaatcaggcgacaagccaaaggcctatcaacgtagttcccatcgacacaacaccaaattacctataattttattgctcgcgtctcattatgattgtctgtgacagaatgagacgaggacagtaacatcttttgcatatgtgtggttaaaagtagcctttagttgactgtacataaccagtgacgtatgtcctttttagatatagtttatctataatataatacttaatttaaaaatgt

SEQ ID NO: 13509 - DNA, 262 bp, Diabrotica virgifera
  misc_feature (213)..(253): n is a, c, g, or t
acgacaaaaggaaatatggcgctttataagaggttagtagtaggtttaagaatggagttaaggaactgatagaaccaaaacatatagaaaaggccacatggattgactgtctagaaaaagcaagccctatgcagatgataaaataccagatataaccacaaatgaaaaagttaatataagtacacaaacagttatcataaaacacaattaaannnnnnnnnnnnnnnnnnnnnnnnnnnnnnnnnnnnnnnnnaacactaga

SEQ ID NO: 13510 - DNA, 412 bp, Diabrotica virgifera
  misc_feature (24)..(46): n is a, c, g, or t
aaaaaatagaaagcagctgtaacnnnnnnnnnnnnnnnnnnnnnnngaactaaagtgaattatcgtattaacatgcacaacaacaacaaattcttcctttacgccgctggaatattcctgtcatacttttattttggaatagtacaagaaaaaattaccagaggaaagtatccatatgaactgactaaggaagatggtaccaaagttgtagaaaacgaaaaatatacctatgcggttactttagttctagtgcaatgtatactaaattatttaatagctaaaatagcggctactatgtggcctcaaggggaagataccacccgtacattatattatgcaagtatgtctttcacttatttactagccatgatctgctcaaatatggcactgcagtgggttgcaatacccactc

SEQ ID NO: 13511 - DNA, 315 bp, Diabrotica virgifera
aactcattcatattgacccttcacccatataatgatctaatgtagccagctttaaaatgatatggccaataattaggattcacttcctgagacgacattaatggggaattggtcattcgattacatttttacttaacaatcacgggttaataatatcttgttcgagctagttcgtcttaccgtatacaaacgctattagatgctactagcttacattcctcaataatcttagtgataactgcaagagtgttgctagctacagttctatatttccgattcatacatgcatgatcagcatgttacgcattgtttcag

SEQ ID NO: 13512 - DNA, 425 bp, Diabrotica virgifera
  misc_feature (2)..(28): n is a, c, g, or t
annnnnnnnnnnnnnnnnnnnnnnnnnnctgtttatttacaacgagtttactagttttgacaactgaagcatttaaaaaaatgagccataataaactgttagatctgcagtcatgtgaaattaacaggaggataataaaaatcggcaattttaagcgctcgagtgtactttggtaacattatttcatgaataaaactgtattataaataatttttactaacatttgatttagatcttcatccgaataattgctaaactgtgctgttgacattgttaagttgaaaaatttgtgtcaaattaaatggaataaatgttactgcatgtatttacacatagacttgaaatttgtaattaagtattgaaaaataatatgtccaacatcatacgatagtaagaataggtttaaaaatattgctccaattttg

SEQ ID NO: 13513 - DNA, 415 bp, Diabrotica virgifera
  misc_feature (4)..(175): n is a, c, g, or t
  misc_feature (177)..(296): n is a, c, g, or t
  misc_feature (300)..(318): n is a, c, g, or t
  misc_feature (326)..(396): n is a, c, g, or t
aacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccnnnnnnnnnnnnnnnnnnncaaaaccnnnnnnnnnnnnnnnnnnnnnnnnnnnnnnnnnnnnnnnnnnnnnnnnnnnnnnnnnnnnnnnnnnnnnnncgagaaaaaattcgtcccg

SEQ ID NO: 13514 - DNA, 435 bp, Diabrotica virgifera
  misc_feature (107)..(133): n is a, c, g, or t
  misc_feature (135)..(149): n is a, c, g, or t
  misc_feature (271)..(294): n is a, c, g, or t
acaattagcggcaaattctcattctattttcattcttttacgaaatccctaaaatcattttatggaagcgtgctttgccaactttatatcaagttagcaaagcaccnnnnnnnnnnnnnnnnnnnnnnnnnnngnnnnnnnnnnnnnnnacaactaattagcgactaattagcggcaaaaactaatcctattccgattctcctacgaacgctctaaagtcatttttcggaggtgtgctttgctaactttatatcaagttagcaaagcaccnnnnnnnnnnnnnnnnnnnnnnnngacaaaatcggtattttcacaactaattaacgactaattagcggcaaattatccacctactttcgaatcgatttgtgataggtgtttagctaacttgatgcgtgagaatgcggacgatcgtgtgttatttaatttccgtga

SEQ ID NO: 13515 - DNA, 122 bp, Diabrotica virgifera
  misc_feature (49)..(73): n is a, c, g, or t
  misc_feature (75)..(99): n is a, c, g, or t
acgagggcggctacctatgtaactatgtagatatttaacataacatccnnnnnnnnnnnnnnnnnnnnnnnnncnnnnnnnnnnnnnnnnnnnnnnnnnatcaaataaattttcttcataat

SEQ ID NO: 13516 - DNA, 420 bp, Diabrotica virgifera
  misc_feature (62)..(117): n is a, c, g, or t
gagaaaagtgcgatacaccctacgacggtaaaaataaacataagtgcaagaaaacaccactnnnnnnnnnnnnnnnnnnnnnnnnnnnnnnnnnnnnnnnnnnnnnnnnnnnnnnnngcgaagcttgtaatcgtttctgttttaatacagaatgctttgataaccacacagaagtttgtaaagaagtttttaaatgtccaagttgtaataaaacttgtaaaagagaacatcgtcatgagtgtggctactctgtgtgcaaaaactgtaaaacgtttgtagaaatagctacccatcagtgctacatggtcaaaaaacccgccaaaggaggattttgtaccgtatcctgtttatgtaataagaaaaccataactgttaataaaggttgtcaaatacacactaaatcacaaacaatatgcaatg

SEQ ID NO: 13517 - DNA, 425 bp, Diabrotica virgifera
  misc_feature (297)..(324): n is a, c, g, or t
agattcttaagcatttttgatgtgtgtgttttaatttcacttcttaaaatatacattaataaaaataattgtataaattcaaaacgtcagaaaattcatatttgattattgactagaatttttcacaaaatgcgtcagacaggtgttttatgaaagacaattttacaattgaaatataaacgtgaaaataagacaagttacaagttagtaccaacttaatcgatggtattttagtaaacttgttaaattgttttacctattttgacatattatttataaacgtaaagcaaattatcnnnnnnnnnnnnnnnnnnnnnnnnnnnngaattcatcgttttggctatatagtttgttattgatcacgttagacggagttagtaggaaaaaagaaacaaattgtatagcccaatggctggtgtgacttt

SEQ ID NO: 13518 - DNA, 432 bp, Diabrotica virgifera
acgattaggaatggtgatactggccctgttaaagtaaaattattatgtggtgctgaccttttagaatcatttgggacaccaggtctatgggcaaatgaagatttagaagaaattgttggaaggcatggactggtagttataactagatcaaattcaaatcctgcagaattcatttacaattcagatttactgacaaaatatatggcaaacatcacaattgtaacggaatggatagcgaatgaaattagttcaactaaagtaagaagagcactaagaagaaatgaatccgtcaagtacattttgcctgacaaagttatagattatattcacaaaaatggtttgtatggatcacaaaaaactattaagtatttgcacgttcccaactcagtattccttacgccttcaccgacagacatcatcatggactcaccg

SEQ ID NO: 13519 - DNA, 381 bp, Diabrotica virgifera
acgggtttaggagagacgcgacctcaagaattacccattttttagggtgtcctatgacgcgcagtgtagataaccgtccatcttcctatttcagttatttacctaatatattctagtcagtcataatggtcctttaattgaccagttatacctagatacttgcattcttccacttcaacaaagcagtaaatactctgcttccattatctatatcttttcatgtttagagtttatattagctttaagtaataatcaattggtttaaatagtctcagtaagctgttgctcgttcttgtgatcaaagctacatcatggccttagtcggtgaagtaactcaacttctgttatcgtagatcgtcctttgtatcctgattttactta

SEQ ID NO: 13520 - DNA, 335 bp, Diabrotica virgifera
gtacgcgtccggaaactctcacgagtcacatctgttaatgtttgtggacgcactaattggaccgttcgaaggtaatctcgacaacacatattttattgctggctactctggagggtcggcatcataccctacggtctgcacatccctacgtaagaactgtatctttatgttgaagtccataccatgctttattgttggagtgtccacatccagagtttgataaacatagtcacgctatttttccacttggatggtatatgtatcttcacaggttatttaattgaggagatttgtccttctattcaccttatggtagtaccccatgttaatcatga

SEQ ID NO: 13521 - DNA, 101 bp, Diabrotica virgifera
  misc_feature (31)..(96): n is a, c, g, or t
ggtccgcacctcccggggtcacccaagcgtnnnnnnnnnnnnnnnnnnnnnnnnnnnnnnnnnnnnnnnnnnnnnnnnnnnnnnnnnnnnnnnnnngacac

SEQ ID NO: 13522 - DNA, 219 bp, Diabrotica virgifera
aacgaggtttacgtgaacactttcgataagtcagtctcgggattaagggtactggccaactatccactgtgtactatttactcactggtgcattgctgatcaataggtggttgacagattcgtagccaggaacttgtttccattagtcgtttcgtagttagcagctgtcatataatacgtgcccatcacgaaatacgcatgggtccttatattggtgct

SEQ ID NO: 13523 - DNA, 357 bp, Diabrotica virgifera
  misc_feature (104)..(126): n is a, c, g, or t
  misc_feature (128)..(140): n is a, c, g, or t
  misc_feature (157)..(172): n is a, c, g, or t
  misc_feature (174)..(186): n is a, c, g, or t
  misc_feature (271)..(298): n is a, c, g, or t
ccatcgcgtccgatttttatctgggattattagttttactttatatcgtatgcatatattgttaagattattatgtttataatttattgtcattgctttatatnnnnnnnnnnnnnnnnnnnnnnngnnnnnnnnnnnnngaagaattattttctannnnnnnnnnnnnnnnannnnnnnnnnnnngttctttatggttagcaattttacatataatagttcgtgttaatggtaatgattatatattaacattttcatctttaagatatgnnnnnnnnnnnnnnnnnnnnnnnnnnnncctttatgttttagatgaaatttttgattaaatcaatgtgtaggatttgtttttacatt

SEQ ID NO: 13524 - DNA, 449 bp, Diabrotica virgifera
ccaacgcgtccgattctttacttgtttctcctcttaatgtcaaacctaaaataggcattccgacatactgtaatgtagtttaactggattaccaaagccactgttttcagatttaccggtaaataataataatacttactcttacgatattatggagaatgatttgcgttcagctgagcctgtagtatttatgccaacgaccatcgagaaaccaagaaggcttgctgataagctagaagttttaaagcaactcacgttttataaatcgcttttgacagtgttgactacgaaattttctatgttcatattttatactttatttccattgtatgtttaccaagaagtggaacgtttaactttaagagaaatgtcagtgatggttggactgctttcgattagtggtttactgttcactggagtctcccattggatcaatatcgacaaaaaga

SEQ ID NO: 13525 - DNA, 298 bp, Diabrotica virgifera
  misc_feature (66)..(87): n is a, c, g, or t
  misc_feature (266)..(289): n is a, c, g, or t
attaacaatatctttattttgaaatgtaacatatacctatgtgaaaacaggatgtgaagcatcccnnnnnnnnnnnnnnnnnnnnnncggttaaacttgggggcatgtagcttttttctttttgatatgaattttacaaatatgcacaaatgccagttaacatcttggccagacttaactttttcaaactttgtatctttggaattcaggtattttttcagatatttagattgacctcaatttttttagagtatgtgtacagtagnnnnnnnnnnnnnnnnnnnnnnnngattccatt

SEQ ID NO: 13526 - DNA, 110 bp, Diabrotica virgifera
  misc_feature (10)..(81): n is a, c, g, or t
cccacacgtnnnnnnnnnnnnnnnnnnnnnnnnnnnnnnnnnnnnnnnnnnnnnnnnnnnnnnnnnnnnnnnnnnnnnnnnggacacgtggaccgcttccatatgccaat

SEQ ID NO: 13527 - DNA, 409 bp, Diabrotica virgifera
  misc_feature (16)..(49): n is a, c, g, or t
aaacagagaaaattgnnnnnnnnnnnnnnnnnnnnnnnnnnnnnnnnnngggaatacatattaaagaaatttaaccagaacatataaacaaggagatcgaaggctacataaacaagtatctgaacatcaatagtaaaataacagcagtaaccaaaataaacaatgaagtttgcagagtacagctagacaatacccaatagaaacgaaaaatactagcaaataaaaataaactaagaagaataagcgaagctaggatttatatcgatgaagatttgactttgaacgaaagatacatacgacagatcaaacacagggcccccgctaccatatgtgcaaagtgtgcaatgcacacgggcgccatcctttataggcgccaaaacccagggtcacaaattgaaaaataatttgc

SEQ ID NO: 13528 - DNA, 384 bp, Diabrotica virgifera
  misc_feature (13)..(59): n is a, c, g, or t
  misc_feature (61)..(88): n is a, c, g, or t
  misc_feature (90)..(112): n is a, c, g, or t
  misc_feature (114)..(139): n is a, c, g, or t
  misc_feature (166)..(224): n is a, c, g, or t
  misc_feature (243)..(267): n is a, c, g, or t
  misc_feature (269)..(283): n is a, c, g, or t
  misc_feature (330)..(383): n is a, c, g, or t
aacacgcgtccgnnnnnnnnnnnnnnnnnnnnnnnnnnnnnnnnnnnnnnnnnnnnnnncnnnnnnnnnnnnnnnnnnnnnnnnnnnngnnnnnnnnnnnnnnnnnnnnnnngnnnnnnnnnnnnnnnnnnnnnnnnnnacacgaaagagttaatttttgtatcannnnnnnnnnnnnnnnnnnnnnnnnnnnnnnnnnnnnnnnnnnnnnnnnnnnnnnnnnnctaacaaattacaatgtcnnnnnnnnnnnnnnnnnnnnnnnnncnnnnnnnnnnnnnnnctgttattcgttttgaaatatatccaaatttttaagaaatatgtttnnnnnnnnnnnnnnnnnnnnnnnnnnnnnnnnnnnnnnnnnnnnnnnnnnnnnnc

SEQ ID NO: 13529 - DNA, 428 bp, Diabrotica virgifera
attttcctgattttaatgcgtcttatcgggttctctagctgtggttcttttccagctattctctagtctactggcataagatatatcgtgctgtttgttgtcacggcatataagtcggtgttactttcaaggctcttctttttcttccagttccacgaccgttatcgatagttggatataatgttggctaccaaattcgctacagtgcctttttggacagtagctctgaacaatgatgtcgattttccgtaccattgcctttttgaatttttgagccatgatgttctgcttctaccagaaccacgtttaccttggatcttagcgtgaccgaagtattctagcttgcgtctctttattatattgaccagttgtgttgtttcaatgctcaccaatagattttagcgtatctttaccgattcaatgatacg

SEQ ID NO: 13530 - DNA, 358 bp, Diabrotica virgifera
agcagactttcgcaaattcttgcttacacatagtaagagtgtatcaactcttgcaatctttaagtacatttaccattttttacaccgtgaaatgatcccgaagcacgggccactggggttatctcattctaccatcatgcattagctcactcttgaacataatatccataattgcatgtagatgcattaataccactatgattgttgatattttagagatttatatacagatgattgtttcaccatctttgaaattcacagttatttcagttaccagtacctttacatttcacattggatatcaccgacttatcatgtagtgccctgatatgattaacacatttgccgcatacgcaaa

SEQ ID NO: 13531 - DNA, 382 bp, Diabrotica virgifera
aacagactacttacagagctgacatttcatcactatcatcacttgactgacagaacatcgcaaaggcgcagacattgtgtcattcagggttcactaacctacatgacttgagagtggttctagctcgactgagatcgcaggtgacctcgttgctatgtgctgtcgacatcgaccgcgacttaacttgtagcatccaacgcgacctacacctccacctcgacctacttgttttgttcttacccttacagtgtcatactgtgcatagacactccggtcttcgctacactctgtatcgtctgtcatcagacagcttacggtatctatgatccatctgtgaacattattattcgccattcgtcattattctgcaggacatgttcga

SEQ ID NO: 13532 - DNA, 240 bp, Diabrotica virgifera
atagtacatgaactactacagtctgaaacaggtgaactacaaatcaagaaatcaatgtttacgaatacttcaggtggaattcctcttcataggattgatatagccaaagcattaagagaaggaaatggaacattagaagtcagcttttaatataatgttgtattttgtcaatattatatgagcttccatcattttttaccataaaatattccagtcattagaaaagaaatcacacaaagc

SEQ ID NO: 13533 - DNA, 233 bp, Diabrotica virgifera
tgcatctcgggacaagggacttgaaatattagctgtcaacgataccttccttgatgtcaaccacatggtatacttattcaaatttgactctatacactgtctctacattggatatgtcaatagtgaatataaatacttaattgttgatagcattcataattcagtggaacactatagagactcatctgatattccatcttgcaaatctcgtgcagattacgtattacaattta

SEQ ID NO: 13534 - DNA, 207 bp, Diabrotica virgifera
aataactatcatttcttgttcaaggtatgataccttttcatgcaatgtgacaaagtctgcagattctgggactcaggtcgtggtatctatcactttgagaactgtagcttcgtagtaaggtgtaacgaataccatcatcgacgtcacatcactatgcatatgggtggtaacctgggataagttcatagatttctggttaccgctatc

SEQ ID NO: 13535 - DNA, 112 bp, Diabrotica virgifera
  misc_feature (10)..(66): n is a, c, g, or t
cccacgcgannnnnnnnnnnnnnnnnnnnnnnnnnnnnnnnnnnnnnnnnnnnnnnnnnnnnnnnnggacgctctacaagaataaaaaattatttactcaatcataaaacaa

SEQ ID NO: 13536 - DNA, 450 bp, Diabrotica virgifera
  misc_feature (200)..(217): n is a, c, g, or t
cccacgcgtccgctacattattagaagacagaagagatgcctgtagagctattaaagccctttccaagaaaaatagactggaggttggggcccagggtctagacatattgagacaagtattagaactggacaggagtgactgcgaaatagtaggatactgtttggataccttatgcaatataacatcaaaagaaacattnnnnnnnnnnnnnnnnnncctaaatcgacaaattaatgtaggagaacaattcacagagatgttccttaaaaattccgaaaatgtgacgttaatattaggatttatggaagaatacgattttagggttagatggccagctgtaagattaatgacgtcattagtagcatctaaaccaaaagatgtgcaagatatcatactagtcagccccatgggtgtgtcgaagttgatggatttgctgtttagagaatagg

SEQ ID NO: 13537 - DNA, 315 bp, Diabrotica virgifera
  misc_feature (3)..(17): n is a, c, g, or t
ggnnnnnnnnnnnnnnnaagcttaaatcaaaaaaaggggagacaattctatagacaaaaaaatatggggggcccgcccaaggttttacatctttctttctcggtaaatctctgtcgttacccttcctacgggtccccaaagttctattccgtgggctcctttttaaaatttgctaatcgggaaaccctttggttttccccatttttccccgttgtgaaaatatcccttttcccccagcggtcttcgccacacttggcccccccctttttcccttttccacattttgccccgttaaaattgaattggtaccccccc

SEQ ID NO: 13538 - DNA, 105 bp, Diabrotica virgifera
tgcagcaagctcatctattgaagcatgccactataatacagttattttcattcactgatcaagtcacatcaggaatacagacaagtgagtatgtacacaagggta

SEQ ID NO: 13539 - DNA, 271 bp, Diabrotica virgifera
tgatttgtagcctattaccgatagtctattaatttcttagatcaatggtcgccatacattatagaacttttataatgaattatacccgacagtgtccaaaggggccatgtaggaaagattatcaaagggttcgaacagaaatgattccgtcaatatacactgaaattcaagtatccttctgaagaacttttggtttagcactattctgagttatctggcatacctctcttcgcaagtctagtagtttacataggctcagggccagtggagc

SEQ ID NO: 13540 - DNA, 447 bp, Diabrotica virgifera
  misc_feature (89)..(125): n is a, c, g, or t
gaaaaatccagaccctttgaaaagaggattcccttccagttagtctaaatacgaggactggccaagtacctaagaggtggaggccatgnnnnnnnnnnnnnnnnnnnnnnnnnnnnnnnnnnnnntgtattttgcttgcagtactgcattttaataactaattttatttactacatacaattagcataggccgttccaacatgctgtcaaaattaaatcaatatggctgctggaagtaaaatataaatgttattctataggttcttaatgtgttttagatggttttagttcatttttgttgtatttctttgtaattttgtgttgtacaaagattaatttaacattttgtctggaagtattaatttagaaagataatatgcttcattggtgttgtgttttgaagtgtgaaatgcaaagtaatcctgatcaagtcaagataaagttcac

SEQ ID NO: 13541 - DNA, 118 bp, Diabrotica virgifera
caacctactcatcaaatgggtaatgggtataatactactggtatttttggcatgtagatgatttcgtccaacagattgtcaatggcgcatctctgaagttttacctgatgcgaattta

SEQ ID NO: 13542 - DNA, 446 bp, Diabrotica virgifera
gaattctcagacgatcgacgatagtgcatgtagaaataaaccaaaatgaaaactattttgagtttgtttttgtgcgtcattttggttagtgtaaacgcgtgggtggctattataccagctgatccggcaaccgctcatcttggagactgttatacaacgagtcataatcttggagctttcacagcaggcgaggagaaaagaattgaaggaagatgtgctgtggcagtatgtagtgctagtggggatattagcctaagaggttgtggagttagaagagcagcctatcctataagagtactacctggagatttatccaaaccgtatccaagatgttgtcacaggatagtgggacctaacaatgacaccgacagtgacaacgaacgaactccggaatacggaaatgtagtcctggcggggtgctttttgaatcctatgctctcaagata

SEQ ID NO: 13543 - DNA, 98 bp, Diabrotica virgifera
cgcgtgacccgggaactttcggaccagcttggcatcagatcaatttgcaggctggtccattgctgctgtcaaagcttaggtcaattctcagagggtca

SEQ ID NO: 13544 - DNA, 293 bp, Diabrotica virgifera
  misc_feature (13)..(74): n is a, c, g, or t
  misc_feature (116)..(137): n is a, c, g, or t
  misc_feature (190)..(224): n is a, c, g, or t
  misc_feature (251)..(274): n is a, c, g, or t
cacacacgtccgnnnnnnnnnnnnnnnnnnnnnnnnnnnnnnnnnnnnnnnnnnnnnnnnnnnnnnnnnnnnnngataagtgaatagtatatatttgctgaattagtagatgaagnnnnnnnnnnnnnnnnnnnnnngtacaaaatattatattctatgttacctgtgacgctatgcagtggacataggnnnnnnnnnnnnnnnnnnnnnnnnnnnnnnnnnnncagatttcgaaatattagctagaagcnnnnnnnnnnnnnnnnnnnnnnnnatagtaaatatattataat

SEQ ID NO: 13545 - DNA, 66 bp, Diabrotica virgifera
atcctgctattactcggtcgacgcggaatcgtccgtagcttaacaacctgaagcagtttcaaggat

SEQ ID NO: 13546 - DNA, 56 bp, Diabrotica virgifera
  misc_feature (6)..(38): n is a, c, g, or t
tgaaannnnnnnnnnnnnnnnnnnnnnnnnnnnnnnnnacgcacaagaaggataaa

SEQ ID NO: 13547 - DNA, 227 bp, Diabrotica virgifera
ctgatgctgcatcaggatgcatctccggatcattaggagtccgatctataggatctcaccttatgtgacgcccattgagcacgtaacattcatgacctccgtacaagatgacgtttattggaggttgctcacatttgcagtgatgttggatatggctcattacgcagagcatgacatgctcatggatcaccaattcttgttatctcttaatctgtcaatattagtca

SEQ ID NO: 13548 - DNA, 257 bp, Diabrotica virgifera
  misc_feature (167)..(209): n is a, c, g, or t
atcatttgcgaccaattggaattgcctataagccagcattaccagaaaatcttgacacgataaatagagatactgccgattgataaaatttaacagaatattaggcattattaaggcaggttactgttaataagatacccagataattctgcaactgtacaagtgtnnnnnnnnnnnnnnnnnnnnnnnnnnnnnnnnnnnnnnnnnnncacaaggaagaaaatacttaccccgcaccaacaaacgtaaaaataaaa

SEQ ID NO: 13549 - DNA, 52 bp, Diabrotica virgifera
atttcttagtattcacttgtggttaggtcggagcttcagctccgctcgcagt

SEQ ID NO: 13550 - DNA, 369 bp, Diabrotica virgifera
acccacacgtctgcacaagcgtccgcccactcatcggcgcacacgtcaggcatagttgacggcttcggttcccgatcattgcgcaacacatggatgtattagcataggcgacattttggtagagaacgttgtcccaatagtacatatctgtcatataatatactactaatctattccactgtcactgacatctgctacatgcattctaatcgatcgtgttgtttcacagtagcttacagcacgtttagagagagcataggaagtgtgttcactgagataccagcgacggatgttgtggaagcgtatatcaaaattacgacagctgagttaagcacagattcaacagtaaatttgctgaaatcatgtggg

SEQ ID NO: 13551 - DNA, 400 bp, Diabrotica virgifera
  misc_feature (310)..(326): n is a, c, g, or t
  misc_feature (354)..(354): n is a, c, g, or t
acatgtgcggcattacgtaccgcagtgtgtccactcatgtaatggtagccaagcggggatttttgcagtaactcgagcgcatcagattctcatatggggagaaacatggtaccctgtagatgtacctctaccatatattggctctaaacacagcggagttcgttaagggggtccgaaaaaaatctatccttagaaaaactcgaaattgccagattaagataagaagcgggagttgatctgagaaggtgttacgtctcaggaagaaagtgcatcagtcaattgaaaaatataatcaatacgacggaaaatnnnnnnnnnnnnnnnnnatctacggccaaaagggtactggaacangctaataaaatggttgtggaaattaataatggcagagggaacaaag

SEQ ID NO: 13552 - DNA, 406 bp, Diabrotica virgifera
gtggattaaaggagacggaatcacgattcaaggaacagaaagtcatttgctaaatggtcgtggtgaactatggtgggacggacatggtgaccacagcaataaaaagaaacctcaattcatgttaattcaggcaacaggaaattcacttttaaaagacattaaagtaaagaattgtcctcacacatgcattggtatatcggattcccatgatattactcttcaacactggactattgattgccaagatggagatacaaaaggaggagctaataccgatggatttgatattgcaaaatcgtacaaagtaacaataaaagatactacagtaaggaaccaagatgattgtatttgtgtaaatcaaggtcagcatttggttttccaaaacatgcactgcattgggggccat

SEQ ID NO: 13553 - DNA, 388 bp, Diabrotica virgifera
  misc_feature (375)..(375): n is a, c, g, or t
aactatggaaacttaagttaagttgtttccccttgtatggaattacatgcgtgtcttgtggtgtgataagaaaccgttgataaacttcccttgtcaatgtgatctttcataaacgcaatctgagaatttttaaataaacttacagttatatgaaattatcgtccaacgatcttgatttttgtaaaataatctttggtgtatttactgtcactttgaataaggcgagcgtttgtatacagagatatacagtgggaatgatgttttttttatcgatcaggtatttaagtttttttatcaaaatagaagttttataaccaagtttttttgtctctaagatcggctagtgtgttttttaatatcaaatgttaaatttanataaaatatttta

SEQ ID NO: 13554 - DNA, 411 bp, Diabrotica virgifera
  misc_feature (336)..(336): n is a, c, g, or t
acacaatagtgagtcagactcattggattgccatcatcaatagctcctcttttaatcgtaacaaatgagaaatttgcgactcgagttacgaaacttgacttgtatccggtagaagctttctctttggattgagattccagaagttccgggaaaagagattcaagcacagaatccaccaggaaaaagatattcctgcagagcagctgtgggccaagagtcaaagaatgaatttggcctagacctagcgtcaaagtaaagaattgaagcggaagccgacttggacttaaacttagttgagagtggtctcttttttaatctcgtatgtatctcctgcanggatcgggctagttgcattactcgaaaaggaagcataatcggaagaacctgtcgtgtagtgcctgcgtctattgt

SEQ ID NO: 13555 - DNA, 445 bp, Diabrotica virgifera
  misc_feature (102)..(162): n is a, c, g, or t
aagtggataaagatcataacgttggtggtatttgccacttaggtgattgtttatgtgtttatcattaataatgttttattagttaataaataaagttttagnnnnnnnnnnnnnnnnnnnnnnnnnnnnnnnnnnnnnnnnnnnnnnnnnnnnnnnnnnnnncaaccacacaaaaaaataaaaacggtacatccccctacatactacaacacacctcacccgtacagtcaccaaaatacccctcacaggccgtcactaaacaccatctcaccggccaaaaccctacaaccacccacctgaaacaccctgcaccacaccccccttacgccagttggaaaaaacccccacttggcccaaccccgcgtttccccccccaaaaccccccccccatctaacaccccaaaatgggaccccccccctcttaacggccaaattagcccccccc

SEQ ID NO: 13556 - DNA, 400 bp, Diabrotica virgifera
  misc_feature (142)..(160): n is a, c, g, or t
acccacgcgtccgggagtaccgaaaattcataaagcgaacataccacttagacccatttgtagtaccatcagttctccttgtagtgaactatcaaaatttttattaaacattataaaaccatttgctaataatgatgacacnnnnnnnnnnnnnnnnnnncattttgtaaacaaattatcaactattgagtttaatccaaataatattttagtaagttttgacataaacagtttatttacaaatgtgccattcgataaaactttaaacataatcaaaacgaaattagagaatgatgatacattgacaactaggacaaaactaaatgtatcagctataatggagttattgacattatgtactaataatacctattttcaactaaataatgaattttataaa

SEQ ID NO: 13557 - DNA, 374 bp, Diabrotica virgifera
gaatttaggtttatatctttaattattatggcttctcacggaaaagcggaaactgaaaaactaaagcaaaatttggagaatcagttggacagattagtggagcagctgcaggatttggagaattgcaagctgaaattttaactgcattgagacaattaaacgaacaattgaccacagaggaactaagatttttggaacaacataaccacattgcgaaagcatttttagattttaactttatagaagtgccagatgacgaataaacggatttgatgtttaaatatgtacttttatacgtaaccaaatatataagccattgggtagaataggaagtaaatacgaaaagtgaatttttaatcataaataagaaacta

SEQ ID NO: 13558 - DNA, 371 bp, Diabrotica virgifera
  misc_feature (143)..(174): n is a, c, g, or t
  misc_feature (224)..(249): n is a, c, g, or t
acgccacgcttacatagcgcacaagcatagattacgagacatcatcgtttaaccattatgtcgttggacctctggataaaaatgttaaaataaatcgactagggcatttagtttttaattaaaaactgtaataatgtactagnnnnnnnnnnnnnnnnnnnnnnnnnnnnnnnngactcatattgtctcttatttactaacccaatgcattacaaagagtgtcnnnnnnnnnnnnnnnnnnnnnnnnnnttgggtcgtacataaaatagaaaatgcaacacgattattatcacactgttaaaaataaataccagctacgcttggtcgtatataaaatataaatgacagctacgcttcaatggataatggtt

SEQ ID NO: 13559 - DNA, 387 bp, Diabrotica virgifera
aggtctagagtcatgtgtctagtcaaagctattgtgattacttgtattctactaattaagttggacggaagtgatagcatacaagaagtaaatcaatttgatgatggaggctctaatattcttgtagctgttgttcagatttatcgtcacggaatacgaactccatattcattttacaaaaatgatcctcattttaacttatcaatatgggagggacttggtgccaaacaacttatgaatgaaggaaaacgtcagcactattcgcttggtcaatttacaagacagcggtatgcagactttttaccggagaggtacgacaaagatgtaataaccgcatatacaacagactccgacagaacccacatgtcaggtcaatgcaatctatat

SEQ ID NO: 13560 - DNA, 327 bp, Diabrotica virgifera
cgcctatgaggcgaagacaactaatttgttttaacataaaatcaaacacaataaacaccataataatttttgacacagttcattactctcctaacgcaatgacttagtgggtctgttcctatgctttaacattttaacattgttttaattgtgacatatatttgtgtacttgtttcaaaactaaatttacgatggcttggtaagtcgattttcttttaaattgtattgtagctttcaataaataatgttttagtcaatccttgaaaaaagcatggatttcctgctgaagtgtcggataatatatcaataaaaatgtcataatatcat

SEQ ID NO: 13561 - DNA, 350 bp, Diabrotica virgifera
  misc_feature (203)..(221): n is a, c, g, or t
  misc_feature (223)..(236): n is a, c, g, or t
ctattctataaaactacaacaaaaaattttcgtgttaaaaatatgtaaaatattacaaaactaaaataataaaaacagattttaaaaattcaacaaaattcaatgtatcagttgtcaatggttcccactgcaagttattagataaataaatatcattttacaatgacgacacagtcttggcaataaaaaaaggtatagatgtnnnnnnnnnnnnnnnnnnntnnnnnnnnnnnnnnctctatttagatatttatacccttttatacaaataccaacttcgcaagtgcttgggcacgctcgtgtcgagtcgagcgcgtatattaaggggttaataatttttaaacgtgtca

SEQ ID NO: 13562 - DNA, 337 bp, Diabrotica virgifera
  misc_feature (7)..(27): n is a, c, g, or t
  misc_feature (92)..(92): n is a, c, g, or t
acccaannnnnnnnnnnnnnnnnnnnncgcagcagccctattctagtgctcctggtgctcctcccggtggacatggccatcaaggatctcanggaccttacggagggttttcgtatacacagcacagtgctcctcaaagttatgcagctcctcgcaggacccaggcatacagttccgttttggtaagagaggcagacaaggctctagatgacgccacacgaatattcaaaaactgcaaggattacactgtggttaaaacagatcagtgtgtgcgcagtggaaatcgccagattgataaaattgtaaagagcgttcgacacaaataatacatctacat

SEQ ID NO: 13563 - DNA, 412 bp, Diabrotica virgifera
acggaagcgtggggaaagatttaagaaagaggttcgaaaaaaatcagcccaaaaataatatagtatccagcttaacggctagaagtttatcaaagcaaatgaaagaggaattacgaaattgaacatagaaatattcaacaattcgactgtgccactcacccgtttatcaatataccaaaaattgaaaaagacttcagcgatattacttaaatgtttgttttattcaattttatttatgtacatattgttttatattaatatattgtgttacttatcttcatttacattgtacttacataaagaattaaaagttaccattaagagaagtgtactccttctgcgttgaacgcatgtaacaacctgtaaagatataaaaattggtaattaatgggaataaaattaattacacttt

SEQ ID NO: 13564 - DNA, 308 bp, Diabrotica virgifera
gctttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagaattggaaaaattgtgcgaggacaagttaattccagcaatcgaccaaatgtacaaccagatggaagacactcctcctagagatttatgcgtagagttggaattctgtaattaatttgtttgttagaatattataat

SEQ ID NO: 13565 - DNA, 378 bp, Diabrotica virgifera
  misc_feature (205)..(223): n is a, c, g, or t
acccacgcgtccgatttcgaatcaagttttaagtttgggtaatcgattttttgaggtttgtggggtaagtgaccagaatttttaatgcaatttgttttcctaaggtatttgacaataacaaggtgctccatacaataatttaatcttgtaaagcagttttcggtatacatagaaacgtatctttatcaacataatatatcaacgnnnnnnnnnnnnnnnnnnngtaattataaaaatagattttattgatatattaggatttattgctagttcaagtgagacttaatgtttattttgaatatatttcaactttattaatataaaaacatatactgacatgagtacctgatgtgattaattaaaatctccgaattgccc

SEQ ID NO: 13566 - DNA, 412 bp, Diabrotica virgifera
aggaaaaataatttggatgaccatctgtaatcatccgaaccatgcgaattcaacgtatcatgtgtagaagctaatgttgtggactgattgtgctttgtggtgtgtgcctgtcttaccaaacaacccaaatatcaaaaataacaaatataaaatataatctaaagtttgtaagacaaagatacatatggagaaaatattagcgacacaccaacaaatcaaaatgccagcaaaatatataaataatcaaatcaataaagtaaataaaatacctaaatactgaaaataatttctagttaggtgtaaaatataaccacactagaaaaaaaaatatatgcatacagtcaataattaattgtacatgcaaacatactaccattggtagaaggactaaaaatccataataatagaacat

SEQ ID NO: 13567 - DNA, 289 bp, Diabrotica virgifera
  misc_feature (133)..(155): n is a, c, g, or t
  misc_feature (238)..(273): n is a, c, g, or t
aatccctttaaagtttattctgctgttataaaaattatgtgtaatattgttttaaataattatacaaaaaacaagacagccatcaaagtgataaattttcaagaaagtataaaaagaaaaataatgctaaggnnnnnnnnnnnnnnnnnnnnnnngttatctactctgaaccctaagactgcacatcaaactatgtgagcaattgttgttatagttatttctagcgatattttgtatnnnnnnnnnnnnnnnnnnnnnnnnnnnnnnnnnnnngtattttacacataac

SEQ ID NO: 13568 - DNA, 387 bp, Diabrotica virgifera
  misc_feature (14)..(386): n is a, c, g, or t
acccaagcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 13569 - DNA, 99 bp, Diabrotica virgifera
atttcagtatgatgccgtgcatccttgctgctgccctcattgtaaccataagtgccgctctatgtgccttcgacacgtggactacttttaaggccaatc

SEQ ID NO: 13570 - DNA, 247 bp, Diabrotica virgifera
  misc_feature (7)..(37): n is a, c, g, or t
  misc_feature (47)..(115): n is a, c, g, or t
  misc_feature (117)..(133): n is a, c, g, or t
  misc_feature (135)..(171): n is a, c, g, or t
  misc_feature (177)..(228): n is a, c, g, or t
ccagggnnnnnnnnnnnnnnnnnnnnnnnnnnnnnnnccaattttannnnnnnnnnnnnnnnnnnnnnnnnnnnnnnnnnnnnnnnnnnnnnnnnnnnnnnnnnnnnnnnnnnnnannnnnnnnnnnnnnnnncnnnnnnnnnnnnnnnnnnnnnnnnnnnnnnnnnnnnncattannnnnnnnnnnnnnnnnnnnnnnnnnnnnnnnnnnnnnnnnnnnnnnnnnnncccttaaaaataatatttt

SEQ ID NO: 13571 - DNA, 132 bp, Diabrotica virgifera
  misc_feature (81)..(98): n is a, c, g, or t
acccacaacgtccgggcaagggttcttcatggttgaaaaaacatgttaacatgaccttgcccgcagaaagttgaaattggnnnnnnnnnnnnnnnnnnatatttggacggattgttaacaccaaacgccatt

SEQ ID NO: 13572 - DNA, 415 bp, Diabrotica virgifera
  misc_feature (170)..(192): n is a, c, g, or t
  misc_feature (201)..(225): n is a, c, g, or t
  misc_feature (254)..(274): n is a, c, g, or t
  misc_feature (277)..(298): n is a, c, g, or t
attccactaagtcttatttaacatcggctaatgatcgaaccttccgcgaacaacgataatgacctattatcgatttcacttgagtcttatttaatcacttcttaaaattaaatataacaatttgttgtatacaggttgttctaaatttatatgcccgtggttgagaaaannnnnnnnnnnnnnnnnnnnnnngaattttgnnnnnnnnnnnnnnnnnnnnnnnnncatatcaaatagaaatataacaatatagnnnnnnnnnnnnnnnnnnnnnccnnnnnnnnnnnnnnnnnnnnnngattataactttatgaaatacatacgtccaccgaaaatagctatttcctatttattagattcattgacaatagatacaaattcagggttataattttctggaaacgaatggaacttg

SEQ ID NO: 13573 - DNA, 415 bp, Diabrotica virgifera
  misc_feature (7)..(40): n is a, c, g, or t
  misc_feature (65)..(82): n is a, c, g, or t
  misc_feature (357)..(357): n is a, c, g, or t
accacannnnnnnnnnnnnnnnnnnnnnnnnnnnnnnnnnctggttttttgtttatggccatctnnnnnnnnnnnnnnnnnnctaaacaaaagtatttaccatatttaatatgaactaattttctaaataaaatttctaacatgggtatatgaattaaattacatatttttttgccaatatatactccagtaatatatgaggggtgtaaaatcaaaggcggcaatctccactttttcatgttttgagttagggacgccatttgttgcgtttttttattatctgttagataaaactatttgtaaaaaaccaaaagcggtcttaactgtataaaaatcgcagttaaaaattcatgttangatcaaaagcggcaatatttatagctgagtgcgtaccaaacacggcaatctccgctgc

SEQ ID NO: 13574 - DNA, 397 bp, Diabrotica virgifera
  misc_feature (50)..(83): n is a, c, g, or t
  misc_feature (179)..(199): n is a, c, g, or t
  misc_feature (255)..(284): n is a, c, g, or t
atcagttatcgctattttatatttgccgagacggaagaaaactattggannnnnnnnnnnnnnnnnnnnnnnnnnnnnnnnnntcttataaaaactatggaaactagagtaattttgatagtggatttagcatctacgaaaaaaattcgtctctaaatggtatgtaatatttttcttcnnnnnnnnnnnnnnnnnnnnnctcaagtagctctatattttacgagttacttattccgactcaaaaacctttgtaannnnnnnnnnnnnnnnnnnnnnnnnnnnnnccctgtattaacaagtagtgatgaagaggaacaaattattacttaaattaaattatagcgtacagttcaaaaaacttataaaaatgaatctcactgtaatgaaacacttaaag

SEQ ID NO: 13575 - DNA, 415 bp, Diabrotica virgifera
  misc_feature (195)..(217): n is a, c, g, or t
  misc_feature (363)..(380): n is a, c, g, or t
atattgttccggtttagtattatattggatatttcttgatgatgtattgaaaaaatgaaaagtgcgtgtagagatgttttatatttctgcataggaactatgcaccatatgaaaaaggacaggaagggttttttatcataaattagacgtggaatttaaaaatggttttagttcgaagtatctcagtggcgtgcnnnnnnnnnnnnnnnnnnnnnnnagaccattgcccgtaggcgcgccgatgatgaatacaagattcttgattgtatgtcggaggatgcgtagtggctgcatcctggaactcgccaagtttcattttcgtggctcaactggtcttggagcaatgaataaattggcagtttnnnnnnnnnnnnnnnnnnccccgtatctcggaaacaaagcatttgtggacata

SEQ ID NO: 13576 - DNA, 403 bp, Diabrotica virgifera
  misc_feature (41)..(82): n is a, c, g, or t
accacgcgtccgggacaatgtgaaagcactggtcgtttcannnnnnnnnnnnnnnnnnnnnnnnnnnnnnnnnnnnnnnnnnattaaattatggaatctaggatcgcaaaggtgataatgacagatttaaaaaatatatccaacagtattacagtgtgtgtagaagatgctccaattttaaaaatgtgttttactgctgatcaccaagccgtgtgggtatcaacatccgattcgagtattagatgttggaaattaccaaccgaaaagcattttaaagaagaagttcggatgcccaccaatccgttatctttaatacaaggaggtgcggcgattaagcaggcagtagttttaaacgacaaaaggcacatcctgactaaagatgctcaagataacgtagcgatat

SEQ ID NO: 13577 - DNA, 349 bp, Diabrotica virgifera
  misc_feature (159)..(174): n is a, c, g, or t
  misc_feature (288)..(305): n is a, c, g, or t
aaatttactctctttcttttggcagctgtctttgtagctgttttagctaccaaagaagtcagctcaattgatgctaaagtggttgatgttgcagcagctttcaaagacgatgaacctactgaagcgccaattactgatgcacctgctgcgtgtgactgnnnnnnnnnnnnnnnncattgcacagatgaaagcatattagacccaaccaaaaactacgatggaggagtctgtgtagataataaatgtcattgtgtcgaaattgtttaaattatattcctttatattatnnnnnnnnnnnnnnnnnngaaagaaatttaaaattaaatagttttacagtaataataataaa

SEQ ID NO: 13578 - DNA, 393 bp, Diabrotica virgifera
  misc_feature (7)..(26): n is a, c, g, or t
  misc_feature (235)..(263): n is a, c, g, or t
accacannnnnnnnnnnnnnnnnnnnctgatgtcatagaagagttcctttatatagtcttcccacatgtttatttgttcttcagggcttgaaatcagtttgccttctgctttgattagattatttggcccttgtgagtatgtcgtgcctgtgaattccttgagtttcttatacagatggaaggcataatgtttttttatataagttttcgatttcttcacattgttctgttatcnnnnnnnnnnnnnnnnnnnnnnnnnnnnngaatggttctatttaatgctttgtacattgctttgtgctgtttgaattttcttccttcatccattaaatccaatatctcctctgtcatccatccttgcttccatggtcgctgttttgtgagcatttcaat

SEQ ID NO: 13579 - DNA, 294 bp, Diabrotica virgifera
ggacgcctctcaacacgattcaggctaatgtagtcgtgaatgccaagtcagaacactgctacagggtcaccaagtttcaattcaatggccgtcggatgacaatgtcgagactggaaaaaccctgacataaaccatcttaagcaccatgcagcacatcgcccgtttcgccaccaggcatgttacagaagacgcaggcaatgatagcccttcacaacatctgcccagcatgaatatcgaatggcacgatccatgtagcggcagcattaagtactgcagatctggaggagacaggtc

SEQ ID NO: 13580 - DNA, 222 bp, Diabrotica virgifera
cccttgaatgcaactcaaagcccctccaaaagggcccccaaattcaattcaacgggccgccttttaaaaactccttaatgggaaaaacccggggtttaccccaagtaactccctttaaaaaaaatccccctttcaaaacctggcttaataccaaaaagccccccacaaatccccctcccaaacatttgcccacccaaaatggcaaatggaacgcccctttta

SEQ ID NO: 13581 - DNA, 410 bp, Diabrotica virgifera
aaacatttcctctgtgaccataattgtatttaaataaaccaaacttgtattgagagacaataacgtaaaagtgacatctttgagaactaagcgttcgaaaacatagcaactctgaaagatttcacagaggaaaagtttgtcggacatgtcgcaaggaatgcaaacacaaagtttaaaacttatatgtatcactgaaattttaggtccttgtactggggactatatagtgtaaagttaaacaatttttaatggcaaacattttgatttctcttataaacatttatttaaattgcaggtttgttcgatttgtttatcacctaaaagtattttacttatttattgtaagttgatattttaaaggtttgtattttagctttagtaaagttctcagtgtattatataatattttc

SEQ ID NO: 13582 - DNA, 106 bp, Diabrotica virgifera
  misc_feature (2)..(64): n is a, c, g, or t
annnnnnnnnnnnnnnnnnnnnnnnnnnnnnnnnnnnnnnnnnnnnnnnnnnnnnnnnnnnnnnctatatttctatcggtcgttctatatgatttaagctatgttg

SEQ ID NO: 13583 - DNA, 399 bp, Diabrotica virgifera
  misc_feature (287)..(310): n is a, c, g, or t
  misc_feature (312)..(327): n is a, c, g, or t
aagaaatttgggtgaaacgcttaacgaaacaaatcaaaacttgtaataaagtaataaaaaaacgcactttgcctataggtacaattagaaaactgcaaacgcatgtaggacattttaaacattttaaacagattattttcaatagacatgtcggtatggggctagacaacaaactaaaacatagagttaaatgggaaaatgtagtttccgcgtttaaaagtcgaattaaaactggagttatagttaatttatggcataaggacttagcacatttcctaaatgattgnnnnnnnnnnnnnnnnnnnnnnnncnnnnnnnnnnnnnnnncagataaagttgttaaagttaatgtttgtttttgtggagaatttattaaaaaatcgggggaagaggaaattg

SEQ ID NO: 13584 - DNA, 372 bp, Diabrotica virgifera
  misc_feature (344)..(362): n is a, c, g, or t
caactatttaaaatatcctccgttgaagactgtctttttatatagggtttttaaggttacaagactgacaaaatcatttttttttcatgtaacaaatcactatatagagagttttcaaatgcgtttaaacatatactattgtatgaccaagagataaacttttctaatcaccaatgatcttcttacacgagaatagcttgaaaacgttgtgttgcaaaatatattgtggctgtaaacaagcaattttatttaacccagcctgtgagatatattcaccccttaaaaatgacattcgggtgtaacaattcattggagcgaggtgtattaactcgtgtatatctcgnnnnnnnnnnnnnnnnnnnattgtatttg

SEQ ID NO: 13585 - DNA, 428 bp, Diabrotica virgifera
  misc_feature (397)..(397): n is a, c, g, or t
gagcaacataaagacatcgaacaacacgcatttaacattaaaagggaagtagattcggtggatgatttcgaacatttaggacacgactcaagtcctttacaggatttgttgggtttgcaacaagacaaagaggtgacagcacctgaaacagtccatgaaatcaataacacgcccaagactgcggtgagtcatcaggccggtgcttccaaattattacattctttgcaaaatccactgattcccgaaaaaatgaatagaaatctactggaagacgatttcctggatagaggcgaaggtaaagaaaaattagatcaatttttacaggatgcagcaataccccctgctacttctgtcttcgatcacggaaataataaattattctctgcaaatctaatanaagctgaaaaattcaatgagcctgagaaaaa

SEQ ID NO: 13586 - DNA, 245 bp, Diabrotica virgifera
  misc_feature (158)..(178): n is a, c, g, or t
tctgtgttgacatcttttattgattgactctttcactaatattgtgagagactaatttacttttacacttgagtcttttattttctgttccttgtgtttcatggattatttgttgtacattagatgtttgatattttcgagtttatgggtgctaaagnnnnnnnnnnnnnnnnnnnnngtgaatattttacataatttttatgttttgagttgttattcatttggaagtatacccagttttttaa

SEQ ID NO: 13587 - DNA, 339 bp, Diabrotica virgifera
  misc_feature (70)..(104): n is a, c, g, or t
  misc_feature (293)..(314): n is a, c, g, or t
atcgcatcactgtttgaatgggacggggccattcgggacgttgtattgacagttcgttgatattgatagnnnnnnnnnnnnnnnnnnnnnnnnnnnnnnnnnnncatcaagtaatgacttatgcattattccattcaaatactttaaattttcacttttttaaagatcatattcagtgagtgtttaaaagttgttatattttttattgcttttgtaatacttaacatagctattttgtttttcaatttaaatttgaagtttaacggtttgggtttttaatttaagtctaaaannnnnnnnnnnnnnnnnnnnnngatgtcagaataaatagtttttatt

SEQ ID NO: 13588 - DNA, 108 bp, Diabrotica virgifera
tttcgcatgcatgcgacttcatatcccttccatggtgtcacgtggattcacttcaatggccgtcgcattaaatcgtcgtgacatgggaaatccctggacttacccaac

SEQ ID NO: 13589 - DNA, 406 bp, Diabrotica virgifera
agcggtcaaaatgcggcatgctatagaattattctggtctgatctggcgcgatctagtctaattcttgtttcgaattactaggattttaatgttcctcttgcttgttcctaaattacgcccttgcctctaggttatactcatctcacagaattacctaggacgacccagcatgaatagcccttccactatgacaagatcgtttggctttcttatggagaggaaagtattttataatacaaatagtttttatgcaattgaggagatagttaaataatacatcaataaaaaccgattttgcagttgaagataatatgttctgccatttcctctctattttcgcagaatcttcatgttgcattgtctactttgcccatttgtcaaatatatctgagtcagcagtgtata

SEQ ID NO: 13590 - DNA, 406 bp, Diabrotica virgifera
agctgatcaatgctgatgcccacattgtggccgcaaatgccaatctatctgcatgctaacactggatccattttcaatgcaccacagcatgactcgtaccacgtgattgatgaacaacttcgtttcggagttttccaggagaagcttcgcaaaatcaagtaccatctgaccatatatgaactctgtgaatagacctactatctctccgtgaatcaagttgccgattggtccaccactcacttgatagctatgttagactctcaaatggctcagaggctaactctattggttgctgacacattcgatgccgatctctatattcaaggtccaacagaggttgattggatgagatggaaagctgatttggcagttaggattcatggaatctgtggatcctgctgggctt

SEQ ID NO: 13591 - DNA, 389 bp, Diabrotica virgifera
  misc_feature (334)..(352): n is a, c, g, or t
  misc_feature (357)..(379): n is a, c, g, or t
tacccacacgtctgcccacgcgtccgatcgctagtatcaccatatcatccgcgtagctatgcagtgttccttgctattgaaaatagtcctgtttgtgctcatatttgatcttctttcgatgtgttctaatactaggttgaataaattcgttgttagcgcatccccttgttttaaacctctattcactgtgaactatcttaacctccggatgaccaaggggggtaaatttggactccaatgtatgttttatttaataaagtcagaaatattttcaattttaaactcattatttttctatttgactttaatatcattctagataccctcatatttnnnnnnnnnnnnnnnnnnntaatnnnnnnnnnnnnnnnnnnnnnnngaatttgggg

SEQ ID NO: 13592 - DNA, 391 bp, Diabrotica virgifera
  misc_feature (279)..(296): n is a, c, g, or t
  misc_feature (368)..(387): n is a, c, g, or t
gggtcgagcccgcgtctacatttaatcgaaatatcaatttatagatgcaatatccacaattgatttgtttttatgcatataagatgtgacaactgtcacatttgactaaaatgtcatgttagaataaatgttataaatgtatagctactatcacggactgtaccttttttctatcatttgtgacgcactgaaaaatgctcatgaaaagacgcatataatattaatctaatagtagtatagcaccacttgattcatattccctaataattagttttaccnnnnnnnnnnnnnnnnnnacacacctatgtatgtaaccgattttaataaagtgactttacataattaaacacttttataggattaaaagnnnnnnnnnnnnnnnnnnnnacat

SEQ ID NO: 13593 - DNA, 253 bp, Diabrotica virgifera
  misc_feature (25)..(51): n is a, c, g, or t
  misc_feature (73)..(94): n is a, c, g, or t
tttaagcctggtaataattaattgnnnnnnnnnnnnnnnnnnnnnnnnnnnaaagttttaataacatgagaannnnnnnnnnnnnnnnnnnnnncaggatgatcatatgagtagtcactgacactgtatgttcagtttgagtatggacgttcaacataggaattcggcgacattactacagttaaatagtttgaatttatattttacgatcggatttgtcagtccacaagtagcatatcgactgaaactcgtg

SEQ ID NO: 13594 - DNA, 371 bp, Diabrotica virgifera
acgctggccccttgggcaggtgtcagttatgcaatattatgtcaataatgatctaagtgacgctaatttaacgaaatctgcatatgattgtgtgttaccatcataattatacccaaggccaatatatttattatcaccagcgcctaacggactaccaagtaaccattgcctctatatgactttccggttgccctaaactacaaacttcccatttctccagcaagctaacgatctaaactaccattgtcttgtactaagctgttattcgatttcaccaacacctcatttattcagacgtcctataccatttatttctccaccatacatttatccttaactatctgtacctcaaccaatacatactactttta

SEQ ID NO: 13595 - DNA, 247 bp, Diabrotica virgifera
  misc_feature (54)..(68): n is a, c, g, or t
  misc_feature (201)..(224): n is a, c, g, or t
tacagtgggtttcctctacacttctttgcgccagtgattgctatatcaaacacnnnnnnnnnnnnnnnaatcggcagttctaagaggtgaaaaagattgaaatgctcaacaatgattcattgtaaatatatgattaagaatttatacataagtgacgattttattttaattctttttgacaacttggaatttatgttttannnnnnnnnnnnnnnnnnnnnnnnattaaactttatttttttatatt

SEQ ID NO: 13596 - DNA, 411 bp, Diabrotica virgifera
agcaaaatgtttggatggcctggggttacagttgggttttagtttcaatgttttatatgcgctggaatattcgacagggtgttccaaactttgaggagggaacacactgtcattgttgcacccggtatgcaatgacacttgtctgttcgtcagcaatattattacatcgatattcttgaggaataaagctatgacatattaaaaaaaaagcactagaatcgaacaataggtttaggatatatgagacattggaaatgtcccatttttgaggtgatgcgataattttgacgcttagtgtattaactccgggtattcttggtttattgattatttattgactattttgcagattatcttgagcctaaaaattgtataaatattgtatattaatttatcttatatttgcgattt

SEQ ID NO: 13597 - DNA, 402 bp, Diabrotica virgifera
cccacacgtccgcatcacgctcagatggatggcgtcactggtatgaaatacatatatgctaagaaattgtggtttaaaagtaaaaagtcgacctgtttcgggatgttcctccaaagtcgtccatttgagagaaaatgaatttgttccgtgatttggcccttctctgtataataaacctgtctattttggaatcaatgtatctttcccgaaacattagctaatgtaaaatacaagagtatgataccacaaaaaggtttgttcccgtttccaattgcattaccaatcaatttgttctttctcaattttctattcagtataagctatacgtttcaaatgagcatcttttttttttggtgattactgtcataattgtttgagaattgaaattttttatctctaagc

SEQ ID NO: 13598 - DNA, 393 bp, Diabrotica virgifera
aatgaacttcatctgagtataattttcataaactaagcagttaaaacagaatgttgaaaaacagattgtaaccgtcttctttgtaaaaatgtacttaaatatctcgtttaaatatttaaaatagaatgtagattatacattgtgtgagcataaaactgtaaaccctgaaattcttgaaaaccctaaacttttggaattattttactgcttcagttgtgcaaactataacgaaacagtttagttaagtcgatatctaattattttagatgttgaaagtattccaaaactgtaaaattaaagattttatatatgcccgacataacgtcacattgttaaatagatgaagaacctataagaacctcaattcagcacaaaatgagatataaagacata

SEQ ID NO: 13599 - DNA, 365 bp, Diabrotica virgifera
aactgttacgtgggttagtttatctgtttataaattgatatttaattcagtagtcagacaaaaatattgaccaaggtgatattttctattcaacatagtgtttcaggttcgccggattatttatgctttagtatacattaattatacacgcgcaagtgaatactgtatgacacatgctgataatcggaagatattatctttaccctgctaactgtgtcacaattcattagtctcaatgtgctatcgctgttttcatagtatgtccggtaggtttaattatcaattgcattatcacaaagtgtgactggtaaaccaatagttctctctcatttgaatgatgagcttccacgaacgaggttatcaag

SEQ ID NO: 13600 - DNA, 350 bp, Diabrotica virgifera
  misc_feature (11)..(64): n is a, c, g, or t
  misc_feature (84)..(125): n is a, c, g, or t
  misc_feature (143)..(175): n is a, c, g, or t
  misc_feature (185)..(212): n is a, c, g, or t
  misc_feature (214)..(246): n is a, c, g, or t
  misc_feature (267)..(308): n is a, c, g, or t
aaattgagtcnnnnnnnnnnnnnnnnnnnnnnnnnnnnnnnnnnnnnnnnnnnnnnnnnnnnnnggaaagtaaataagaatggnnnnnnnnnnnnnnnnnnnnnnnnnnnnnnnnnnnnnnnnnngaccctggggaacaaggnnnnnnnnnnnnnnnnnnnnnnnnnnnnnnnnnccaaattaannnnnnnnnnnnnnnnnnnnnnnnnnnngnnnnnnnnnnnnnnnnnnnnnnnnnnnnnnnnnaaatggtaatccgttttaaannnnnnnnnnnnnnnnnnnnnnnnnnnnnnnnnnnnnnnnnncaatataattaacaataaataattttaaactaataaaaataa

SEQ ID NO: 13601 - DNA, 364 bp, Diabrotica virgifera
gctcatatgagagacatacacccatgcaaaaatgaacctattgatgagttcagtgaaccagaagatctcatggaaggtataacaatggtggtcgatacaaatgaacctgaaccatatgaagatgactccaaagcatggtacagggaagaggaaatccatcagactgaagaagacttaaaggagctggaatctggaaatgatcatatttgccacctctgcaatcagccattcccattaagggccatattattgcagcatttagttacctgtagagcaacaacaggcaatacagaatctgctcctttggctgtagttaataaaatcatcatatagaataaatagaaagccactcataattgtaacg

SEQ ID NO: 13602 - DNA, 89 bp, Diabrotica virgifera
  misc_feature (56)..(75): n is a, c, g, or t
aatttaaatattttgattttgttataatataaaaaacttcttttttgaagagttgnnnnnnnnnnnnnnnnnnnncattatatgtacat

SEQ ID NO: 13603 - DNA, 401 bp, Diabrotica virgifera
  misc_feature (380)..(380): n is a, c, g, or t
acgaacaaccggcccttagatagtttgtgagactatacatcttaggaactttttaacaaatacatgtattatgtgactactgacaaactgctaatttttaatgtattttcgactaaaaagtattaattgacatgtagctatcgccagatctgctaacacagagtgaaagtaaaaatcacatgtaactcaaattgagaataggtagaacgatttttatttaaaccaaattgtggatttgtgctagtttagcttatttattgacgtttgataatcaatgtctctctgtaatgtccggcagcacttggattgaattttgattctaatcctctcttttaagttaaccgaagaattattttgttttattttagaatgatacgtanatacttaactcgagttcacct

SEQ ID NO: 13604 - DNA, 345 bp, Diabrotica virgifera
atgtcagcgtgtcaagctactgtctccttgagttgtctgattatgcccatgggtccagttctatgtgacaatgttgtgtcataaagatggccaacatttagtgtaacatctcttgcacttgcaaagatagtatctaccatgcgtgattacgcagatttcgagtgagctcctgatcaaaatcgacgaatctacagcatgtggacgcaagcattttgacggctcataaggtgcatgataaacttgtcgatcatatggttatagatgcttgtccattcggcggacgtgcatcctacactcacattgcccatggatcactcgattgagctgacgtactcaatcctcaag

SEQ ID NO: 13605 - DNA, 266 bp, Diabrotica virgifera
  misc_feature (80)..(118): n is a, c, g, or t
  misc_feature (151)..(165): n is a, c, g, or t
  misc_feature (167)..(181): n is a, c, g, or t
  misc_feature (198)..(247): n is a, c, g, or t
  misc_feature (251)..(265): n is a, c, g, or t
aattgttctagatctgataaacaatctttaagaaaagttaacgcataatttaattaatggtcagttaataataatggggnnnnnnnnnnnnnnnnnnnnnnnnnnnnnnnnnnnnnnnggtacctggggtgccagggattataaattatcnnnnnnnnnnnnnnngnnnnnnnnnnnnnnngacctaaaaaattaacnnnnnnnnnnnnnnnnnnnnnnnnnnnnnnnnnnnnnnnnnnnnnnnnnncacnnnnnnnnnnnnnnng

SEQ ID NO: 13606 - DNA, 375 bp, Diabrotica virgifera
  misc_feature (12)..(43): n is a, c, g, or t
  misc_feature (45)..(59): n is a, c, g, or t
  misc_feature (70)..(82): n is a, c, g, or t
  misc_feature (85)..(106): n is a, c, g, or t
  misc_feature (297)..(317): n is a, c, g, or t
taatatcttaannnnnnnnnnnnnnnnnnnnnnnnnnnnnnnncnnnnnnnnnnnnnnngaaattctagnnnnnnnnnnnnnttnnnnnnnnnnnnnnnnnnnnnngccttaggtggattacccgcgttctgaggatatcggtcctaattgattagtagttaacaatttatattgtcaataatttttatgctgtaagattaattttaattatgtgaactttaaatacaatatggttttattgacgagttacgttatccactatcactattataagatatgttatttattcaatttcnnnnnnnnnnnnnnnnnnnnnataaagttatttaaatgcatatacttaagtctaattagttttatgtatagactttttc

SEQ ID NO: 13607 - DNA, 297 bp, Diabrotica virgifera
  misc_feature (79)..(118): n is a, c, g, or t
  misc_feature (139)..(171): n is a, c, g, or t
  misc_feature (183)..(233): n is a, c, g, or t
  misc_feature (241)..(264): n is a, c, g, or t
acgcggtcgcgtgggttatttgaaagctggtatgagtggttggatgatatattaaactgtcgttatttaatttagtgannnnnnnnnnnnnnnnnnnnnnnnnnnnnnnnnnnnnnnngacgaggagaacctagaatgnnnnnnnnnnnnnnnnnnnnnnnnnnnnnnnnntaaatttagttnnnnnnnnnnnnnnnnnnnnnnnnnnnnnnnnnnnnnnnnnnnnnnnnnnngtaaagtnnnnnnnnnnnnnnnnnnnnnnnngtacaatttttttggttaaaagaattaattaac

SEQ ID NO: 13608 - DNA, 389 bp, Diabrotica virgifera
agacaaattggactccaaaaaaaatttttgggtcccttttggaaaaaccgaaaaagaaccccgtttaaaacttcaagcctcttcaaatcaaatcccctggtaatggaaatatcaatctctggagtgtacaaattggtcacccggtacaaattttactcaaattcaagtgcctcgtgaaaaagttcttctctcgattgaaccccagtatactttttttattgtactcgttgaaaaaggctacaaatatatagacaaaagcaaaactatgttacaaaatttcttaagaatatttttatataacctgttgtgcttagatattttataatagtgtctttttacacaagtagcatgatgcttagactgatagtaactgtcctgttccacttttg

SEQ ID NO: 13609 - DNA, 406 bp, Diabrotica virgifera
  misc_feature (122)..(142): n is a, c, g, or t
aacaacgcgtccggttggaataaaacaaaccgacatatttatgtttcgtagacattaagaaagcatttgacagggtcacattaaaggacgttatccatttgttatagtcaaaagagacaccnnnnnnnnnnnnnnnnnnnnnctaaaacatctaccagaacatcacaataaaagtaaaagtataagatgaactaactgacccaattgaaaccggcaataggataagacagggggattccttgagtcctttattgttcaacctgatcatggacgaaataataaaaaaagtaagaactaaaaaaggataccaaatggatggatccaaaaggataatctctcaaaatgaagatgatttacaacgtatgcttcataaatttaacaaaattgccagaaaatttaacaatgt

SEQ ID NO: 13610 - DNA, 388 bp, Diabrotica virgifera
acatttacgggcttattttgaacacgcgtttttcgcccccgaggaggggtgactgtcaccccccaagtgggagcggccgacgacacggattcaactttgaagtggagtgtgagtggagccggaatccgggttttcatgcggttcggagttgcccctgaaaattacactccaaaacggtcatttattgggctattacagagacgctaattgtatccgaacatctgcgtttcctccggactttattttaaattgaaaattcatttaaacttcttgacatttcctgacatccttggtacttagagagcaacaagcgaagtgaaacttggacaaataacgccaccttcgcgactattaaaaatactgaccgttttctctgctttggaccaag

SEQ ID NO: 13611 - DNA, 438 bp, Diabrotica virgifera
acacccacgcgtccggatttttgaaatataaataattgttttgcatgtttttctaaggatagattttttttcgcccccccccttaacgaacttccctgcattaagagccaatatatggtagaggtacatttacagggtacaaaaatccccgtttgggctcccctaccatcatgggataccagatttattacggcagtttatgcatctgtcaaaacctaccatgatatgaaattttaaaaggcaatgagggtatgatattacgtacagtcggagggatggaggagtacccatgaacgatcatataaggcacgctgtgttttcctgtcaccgtgtcacaacgaaagttgcccggcgcaagtacatgtaattataattattgcatgtgcttgcgctggccaattttttgtgtgacgcggtgacatgagggtgcaccgtgtt

SEQ ID NO: 13612 - DNA, 393 bp, Diabrotica virgifera
  misc_feature (59)..(101): n is a, c, g, or t
aattctgtgggattcccagaatacactttcaaggttggaatgaaattttatgtatttcnnnnnnnnnnnnnnnnnnnnnnnnnnnnnnnnnnnnnnnnnnngtgaatgacaaaagataatttcacatgaaaacatcgatttttgtccatttaagcgtaccattgatttggaatatttatgcaaacctctaaatttggcacctgtttttgaaaaattggtagatgcatgcattgacgcattttttaaacagtttactgttagtttttagtttgttaggtcggttgtttgtgctgcgccctggatttgggcgttgtctgttgcatcatatacaaatttgtgaaagtgaagttagtttatcgggtgggttgtattgcgctcagcggtcaaatacct

SEQ ID NO: 13613 - DNA, 171 bp, Diabrotica virgifera
  misc_feature (17)..(36): n is a, c, g, or t
  misc_feature (38)..(50): n is a, c, g, or t
  misc_feature (68)..(91): n is a, c, g, or t
  misc_feature (93)..(127): n is a, c, g, or t
ataagtaacacaggaannnnnnnnnnnnnnnnnnnngnnnnnnnnnnnnnccagaattaaagagaacnnnnnnnnnnnnnnnnnnnnnnnngnnnnnnnnnnnnnnnnnnnnnnnnnnnnnnnnnnnataatgaaaaggtatatccggttttataaataaaccaaaatttt

SEQ ID NO: 13614 - DNA, 377 bp, Diabrotica virgifera
agtatttttaaaaaactcacaaatgttttagatcgtatagcagaagacagcacagctgcaggtaagaaactggctaaatgtttcgaagactccaacattaattcagtgcctgttttatttgtaaacctaaccttaagttgcattgaagacgatgtgattaaagtagccgagtctttaggaccgctggtaaagcaacttgcagaagttcaaaagaaggctaaagcagcaaccgagaacattgatgagtgtggagataatatcactgatattggatgtgttcttaagcattttgtaacttgttacctttgacctgaagatgctctacaaagtttaaagagcgaaaccggtcgtcggaagttataataaagattgagagt

SEQ ID NO: 13615 - DNA, 427 bp, Diabrotica virgifera
acaacgcgtccgttaaaagattcgtttggaggataatttaaaggtaaaccattttttccattacaacagtccaagaagttttccaataaaaagtttaacaatttttacttttgtttaatgttaactatgtcgaaattagacaagttagcacaagcagactgatacaaacgctgttttaacgtgcattttaagtagttcatatttattttcaaaatgttttacccttttgggacttctcttttacataaaacctaagagtaaggcgtggatgctattttgtggatgctgagattaacacaacctcttaggcaacatcatttttaggtaatttttcattgtttatgtccatctttcatttatatcggtcataatttatttttaatgtaattttagtaagtaaatcatttactttgaacagtgaaataaa

SEQ ID NO: 13616 - DNA, 166 bp, Diabrotica virgifera
  misc_feature (2)..(44): n is a, c, g, or t
  misc_feature (46)..(58): n is a, c, g, or t
  misc_feature (62)..(83): n is a, c, g, or t
  misc_feature (85)..(100): n is a, c, g, or t
gnnnnnnnnnnnnnnnnnnnnnnnnnnnnnnnnnnnnnnnnnnngnnnnnnnnnnnnngagnnnnnnnnnnnnnnnnnnnnnngnnnnnnnnnnnnnnnnggacttatatatctattattttcgaatttagacgagctttgtccgcaatacttgtaacgtcgcaat

SEQ ID NO: 13617 - DNA, 227 bp, Diabrotica virgifera
acttttaattctgttctgtggttagacaactttattttgacaatttttactgaccaggcactaaaagtatctatcaaatccgctacagatcttgcatcatacgtcaatctaaaaattgacgatgggtaagacgcatcttaatttatatactgcccactcatgtgcaaataatcatattgctttcaatatcattaacatcaaattttgtaccaatgatgctacataaa

SEQ ID NO: 13618 - DNA, 427 bp, Diabrotica virgifera
  misc_feature (403)..(403): n is a, c, g, or t
agattaaggcccctaaatgctaacaaccatattgtcatcgagagagctcagttgccacaattatctcaatataatacaatgtatgtatttatgaatctaaatatgtacaatgtatgttccctatgtccagctgaacgatttacgtactgtacatatgacatcggtaacaaaatcttaaaaagtacaattattgtattaaccaggatacacatttagagtaacgaggatgtgatagttgtatttaagaaattaccgttaagttttaaagacttcttgtcttctttttttaaagttcacctctacatacatttagtaacttacaaaaaatcagatacttttaggaaagacctgcgatatgtgttaagtttaaatattttacgattagattaggttaagttctgtngtacttaaattcatcgagtgcaat

SEQ ID NO: 13619 - DNA, 415 bp, Diabrotica virgifera
  misc_feature (404)..(404): n is a, c, g, or t
aagtttttcattggcatattgtagacgatcagagttttccttacgtcagcaggaaatttcctgagttaagtttaaagggtgcctacacgtcgtactatacatattcgtagaaagatattcaaaatataacggaatatgcaagagtaagaggtataagagtaattccagaatttgatacaccaggacacacgagatcttggggtgtagctcatccagaaatactaaccgcttgcgaaggagacctaaaatgaaaatacggacctattgatccaactcaaaataaaacctacacctttttggacgatttttttgaagaaattagtaacacatttgctgatgcatacatccatcttggcggtgatgaagttgagtttgaatgttggagtagcagtaccattattaanaactttatgaa

SEQ ID NO: 13620 - DNA, 305 bp, Diabrotica virgifera
  misc_feature (149)..(167): n is a, c, g, or t
  misc_feature (219)..(236): n is a, c, g, or t
acttgactccaaagtttcatgttttagtacatgtgttagtagatgtatcatcaccgtttaatatatagttatgtgattgacaatgtgatacattagttcatttagataatattaatgttcatgtgtagccacgagtgattcattggtcnnnnnnnnnnnnnnnnnnncgatatcatcttcgctgtcaaattagcgattttattggaacttttatagtcnnnnnnnnnnnnnnnnnnagtgctgtgaaacgatttgaaatacgtctaaatctatatcgaagtttttaacgtttcttttaaacttaa

SEQ ID NO: 13621 - DNA, 60 bp, Diabrotica virgifera
  misc_feature (7)..(48): n is a, c, g, or t
tgagtcnnnnnnnnnnnnnnnnnnnnnnnnnnnnnnnnnnnnnnnnnnggaagcacaaaa

SEQ ID NO: 13622 - DNA, 247 bp, Diabrotica virgifera
  misc_feature (13)..(110): n is a, c, g, or t
  misc_feature (117)..(189): n is a, c, g, or t
  misc_feature (191)..(229): n is a, c, g, or t
aggacgcgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattagnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnncagattttaaaataggtt

SEQ ID NO: 13623 - DNA, 321 bp, Diabrotica virgifera
atattgactgctgataatgtccaagtctaaatgttagcgccggtgagtcacggatcaaattgcccgcaagtatataagcgtggtgtcattcaacttatccataaaacttgtgtactcattattagtttgtagatatgagtccacacggacaggttagtggtgcagttcaataggatgtacccccgatagtgtcacaacgttggacaggacgtgtttccagtatacagcgcatgcactaagtgtatttgtaatctgaaagcttcgatgaagaatcatgaccgtatcactcaatatccgtattgaatgtgtttagcacgacaa

SEQ ID NO: 13624 - DNA, 380 bp, Diabrotica virgifera
  misc_feature (247)..(276): n is a, c, g, or t
accttacttccggcactgatagtcagtcggaatttcggtccatttgtggtgtcaattttagtgttcatcttccaactcacgtgactgtatctcagtctatgtcggactcgatgttgtccaaatcggtatcgactgctgtgatttgtgctgccagttatatggcatccaacatgacagccatattgaatgacacatgactgtaggcagaagagatgacagttgcaatacattcttcagtgcattcgtnnnnnnnnnnnnnnnnnnnnnnnnnnnnnntgtagcattggttgtagcattggtacctgcagtacttaacggcatatatcgtcgaatgttccatccattgtacctcatcactggcctcatcaatggcaccaata

SEQ ID NO: 13625 - DNA, 397 bp, Diabrotica virgifera
  misc_feature (94)..(113): n is a, c, g, or t
agcttttagagatcacctttcgagttctattttgaagtaaagaaaatatagagtttatttacaaaaataggagtcttacgaacgtgacttaagnnnnnnnnnnnnnnnnnnnngatgtaaattgtcctataatagctgtatttttattcttaaacatatctaaacaaaacagaacaacccactcacacaaaaatgttgacataactgtgtcgcaaaacgtcctacatatttatgtatgtatattgtatatgccgcttgcctatcttgtttatggcattagttattaattaacatgtactttcaagtctttttataataatcttctttgtacaatactttgttttttccttaaactctaataagttctgtggccaaaattaaggccaacagttttcct

SEQ ID NO: 13626 - DNA, 404 bp, Diabrotica virgifera
  misc_feature (288)..(306): n is a, c, g, or t
  misc_feature (328)..(349): n is a, c, g, or t
aaagagctcagagaacagttgatgcttttagaagccagggaggaaaagctggaaaagaaagagaagaagcgaaccaagagtgctgtgcataataatgaattggaggatatagagtctgagaagagtactttacaaaatagaataaatataattcaaaagaaaattctagtaggtggggaaaatttggtagaaaaggcgcagcaacaaatggaactcttagaacatgttgataaagagttgcagcatttggatacatcacattccatattgaaagagattcttctacannnnnnnnnnnnnnnnnnnattgttaagaaagaatatgctnnnnnnnnnnnnnnnnnnnnnnctctcgattctaaactagaagaagttgataaattgatctctaaagcggtttaaat

SEQ ID NO: 13627 - DNA, 228 bp, Diabrotica virgifera
cacgggcggggctcccaactggtttatgggtgccttcgccttcagatctctgctaaattcctcctacgggttccctcacttgccttccacggtccaccttttttccagtgtaaacccggtagtttcccgacttttctcacgtttaaccccttgtccttttcgcccctttgcgccttggggcttatcccccttccgggtctcccgcttttgtcctttccaagcctttgc

SEQ ID NO: 13628 - DNA, 304 bp, Diabrotica virgifera
aatgtctctttcagcgactatcgtcttgccgactcactggtaggcgacttctcaagacactactaccacgcgaaatgacacctctccggcaatgtagccgagttacaaaagatgacggcagaacacggagcacatgtagagtggctttttgacaataaacttcagaattaagccatcgtatcaatgttatagttctacacataagtacataaactagttttgcggttaccagcataggacacagtaccagatcataagactatctattcgtcaatcagaatgtcaccagtatgtctcatcttaa

SEQ ID NO: 13629 - DNA, 381 bp, Diabrotica virgifera
aggacgcgtgggttcggcttctggaagctctacaactctaccctaagtctaggcaataaagaacttcaaaacgctacgttagatttggttgttgagaactttggaagatgcggatatggagccttagatcaattccaacaatataaaggtcttactgatgacgttttcgttaatggaaataaactaacagactggacgattattcccttagaatttaaaactagctggaacaaaaatctaggcaactggaaagctgtaggaaacactacaaatactccagcactttataaattttcactaaacataccagaagaaccacaagatacctttgtgtctttaaggacttgggtcaaggggatcacaatagttaatggttttgtg

SEQ ID NO: 13630 - DNA, 366 bp, Diabrotica virgifera
  misc_feature (144)..(165): n is a, c, g, or t
gattcagctacacattttgggttttttttgaaagaatcggttactgttataattttgactatatactggcaaaataattgctatcactgactccgaatatttgacattaggatcaagtgtattatttgatatgttagattggcnnnnnnnnnnnnnnnnnnnnnnggcttctctaaaaatgagtcaataagtcaaacaccactttattaaaatttcgtcgatgtgtaactacctaaacttgattttgagtacaagaagtatagtaggaagttcaataacatcaacatctgactaaagtatttacggaaataaacttcggtgggaaagaatacttcatggagaaaggtgaaaagcagatgtccagga

SEQ ID NO: 13631 - DNA, 57 bp, Diabrotica virgifera
  misc_feature (14)..(51): n is a, c, g, or t
acacacgctgctcnnnnnnnnnnnnnnnnnnnnnnnnnnnnnnnnnnnnnngaagaa

SEQ ID NO: 13632 - DNA, 404 bp, Diabrotica virgifera
acaccgacctagtttaaacatgcatatgacaacacatactggagtaaaaccatgttttgcatgtgaaatatgtaacaaacaatatttaacaaacgcttctttaactagacatatgagagtgaagcgacatttaactgttaatagggatgtgaacacggaagaaaaacattttgaatgccaaatatgcttcaaaaaattaacaacaagatttaatttaaaaatacatatgagattgcatactggtgaaaaaccatttggatgtcaaatttgcaccaaacagttttcaacgaaacaaattttaaaatcgcatatgagagtgcatactggtgaaagaccagttaaatgtgaaatttgcgccaaacagttttcaacaaacccacagctaactagacatatgaaagtgc

SEQ ID NO: 13633 - DNA, 289 bp, Diabrotica virgifera
  misc_feature (9)..(9): n is a, c, g, or t
tacttggtncagcagttgcagtgctgtgctttaggatattttatttcttaccatctctctaggtgtcaaatactagccactcatcatgtgtgatcaagatgttggcgcattactcgtggacaatggatgtggtatgtgcaaagctggctttgccggggatgatgcacctcgtgctgtattcgcttcacttgttggccgcacaggacatcaaggtgtgatgggaggcatgggacacatagattcctgggtaggtgaggaagctcaatgtctgtcaggtatcctgacctta

SEQ ID NO: 13634 - DNA, 408 bp, Diabrotica virgifera
  misc_feature (46)..(64): n is a, c, g, or t
aaacacaagtcattagtgatattttatggttttcactttttcactnnnnnnnnnnnnnnnnnnntgaaccacgacgacaaaatgatgatagaagataacaatccaacgctcggccaacctttgagtgattttcttttgcaattagaagattacacccccactattccagacgcggtaactgcatactatttacgatcctcaggactagagcctaaagatccacgattggtgcggctgatctcgatagcagctcaaaaatttatatctgatattgctaatgatgctcttcaacactgtaaaatgaggtctactaattcttcaagccacagtggctccaagagcaaacaaggcacaaaagacagaagatactgtctaactatggaagatctgacaccagctttggcagaa

SEQ ID NO: 13635 - DNA, 400 bp, Diabrotica virgifera
  misc_feature (14)..(45): n is a, c, g, or t
  misc_feature (220)..(245): n is a, c, g, or t
  misc_feature (255)..(275): n is a, c, g, or t
  misc_feature (378)..(395): n is a, c, g, or t
actatattttgttnnnnnnnnnnnnnnnnnnnnnnnnnnnnnnnnactaatttgattaaattcataaggtaataagcaattgtcaaaaagtttatggtgtaataaacgttcagttggtgtattttcccaaatgaatgatacgtctagatggctaaatggtagagtgctctgatttacaatctaacagccctataatacgcaggctcgaaccccaatgcannnnnnnnnnnnnnnnnnnnnnnnnngattgtaagnnnnnnnnnnnnnnnnnnnnnccagaaaatacgtatttagttaaaatttttggcaacaattattgttcagaaatcatttctttgtggcatttttcaatgtgtttgtgtgtgtgttttattcttnnnnnnnnnnnnnnnnnngtatt

SEQ ID NO: 13636 - DNA, 55 bp, Diabrotica virgifera
  misc_feature (5)..(37): n is a, c, g, or t
aaaannnnnnnnnnnnnnnnnnnnnnnnnnnnnnnnngtaaggaaaaggtgttga

SEQ ID NO: 13637 - DNA, 376 bp, Diabrotica virgifera
acccacgcgtccgggatataatctgcaaagcagcatctgcgtggagtcgcaaacaagatctcaagatagagtccactgacgtatatccaccagtggctcacgaattaagattaaatgttgtgtgaactgccgtcagcgacacagatgcatatactcaaagctgtcaagatccacactgcctctccccaatggtttagggacatgaatgatctgggatcgtcgagagtgtaggggaaggtgctccagttgtaataccaactgatcatgtagttccattgtgtgtacctcaatgtggcgacagtgaattcagcattgcactcaaatacaaacttgtgccagaacattcttataacccatagacatggcaggatgccat

SEQ ID NO: 13638 - DNA, 202 bp, Diabrotica virgifera
  misc_feature (66)..(66): n is a, c, g, or t
aggacgcatgcgaaaatattatggtactttatactataagtatggaaaattttcattgaatggtangtacttagtaatgtgagagaatactatcatttgtatgaaggcccggttatttaatggaccatgtgcaatcatggaatagtaatgaataagtacatgcatataatattcgaatttataagagctaacctattaaaat

SEQ ID NO: 13639 - DNA, 291 bp, Diabrotica virgifera
  misc_feature (127)..(157): n is a, c, g, or t
gttaaaattgttaggtaatttcaaggacgatgtagaaatgttattgatcgcatgcaacagacataaaaggaaggtatatcaaaattttctattgtataaattttccagttagcttgtatattgtacnnnnnnnnnnnnnnnnnnnnnnnnnnnnnnnttgtagaaaatatatacaaaatgataatgcacacttatttactttttaattcaaatttagtattaaaccattttacaattattataacaaatttatttttgcaaaaagaaagattacttatttaatctgtaact

SEQ ID NO: 13640 - DNA, 300 bp, Diabrotica virgifera
agccaggatcaacgtctacgtccagggcctctcctgccctcaatcttgccttgtagaatcaactgcagcagttggtatttttcgttacgcataatgtggccgaagtaagacggagatgtacttataccaagtaaagtcgcttgaaaatcaacagtgaagtcatgatttcctttgactgcaacccgccctttataacataatttacttttagaatctactatcattatcactagtcaccacagattgatcagcaacaggatgagaggacgaacttcctttttgcgctctgttgtggagtgt

SEQ ID NO: 13641 - DNA, 406 bp, Diabrotica virgifera
  misc_feature (125)..(144): n is a, c, g, or t
  misc_feature (239)..(257): n is a, c, g, or t
  misc_feature (317)..(344): n is a, c, g, or t
gccaattatctgaaacaggttatttaatacttaagggtataagaggattaattttatttgtagtttttagtggaagattattttcttgattagtattttctactcctatttttatttgtcttccnnnnnnnnnnnnnnnnnnnnctttgatttttattatagttggagtttgattaggttatgagttagctaaatttaaaatttcttataatttattaaggttaaataatatttctagnnnnnnnnnnnnnnnnnnnatatgaaatataccttttttatctactttaggaattaattattatccaatttattttggnnnnnnnnnnnnnnnnnnnnnnnnnnnnggatgatttgaatattatggaagttcaagtgtaataaaacaatttaataatagaataatttt

SEQ ID NO: 13642 - DNA, 352 bp, Diabrotica virgifera
  misc_feature (23)..(40): n is a, c, g, or t
aggttagcaaaaaagactatccnnnnnnnnnnnnnnnnnnctcaaaatctaactaaacataaaaatgtctgcttcgtttattcatagaataatcctgtctgtaagattcctatcattgtttcattctgcatattcagctgctcaacatcgataatatcttcgtttgaatgacttagattttacacatttaccttgagatatctttattcatgctttgattagcctctttgtcatcatgtatggtgttctgagcatcgtcggtaagtttaatgagattaattccacatctgaattggaaaacatgtcctgtgaaacttttagggaaattccttccttctttaccttcattcat

SEQ ID NO: 13643 - DNA, 434 bp, Diabrotica virgifera
aaggggaaatgtgatcataaaatatgtagtatgtcagaacggcatgttagagataatggaaaatattccctttattgtgaataacctagagaagcatagttttattaaatttattaggatataaaatcacgatgaagaaaagataaccaaaattacgtaggaggtcaaacaatgtgtttactgtgggattcctttttgtcttaaacgtaatacattgatgtcctgccgttagcgcagaatcatcatccttatttttatcataaagttaaagggtgtcgacgttgtcaagttttctgtaccattgtattaggtgtaagttatagcatttagtggtgacaagaaataatatttcatttaggggtgactatatttattgcattttgtgatatatatagtaaggtctcgttttatgcggtggatacgttctacagaaa

SEQ ID NO: 13644 - DNA, 411 bp, Diabrotica virgifera
  misc_feature (305)..(326): n is a, c, g, or t
aagaaatttttagaagtaaactgtgtcagtgctttagtttttgtttcctggtgcccatacaatggaagtctgaaaaaattatcaatcaggttaaagtgctatagatttatcaatatacttcgtgtttcgttttaaggcgtattttaaaaactggggcataaagacacttgtggcaccaacatggtggactactacagagtccttgaggtgccaaaaaccgctactaactcggaaatcaaaaaagcatacagaaaattggcattaaaatggcatcccgacaaaaacccagacaacatggacgaagnnnnnnnnnnnnnnnnnnnnnnatcagaagcatacgaagttttatcagacgagaaaaagagacgtgtttatgatgaatatggcaaagacggtttactgaatggcaac

SEQ ID NO: 13645 - DNA, 398 bp, Diabrotica virgifera
  misc_feature (7)..(92): n is a, c, g, or t
  misc_feature (97)..(232): n is a, c, g, or t
  misc_feature (240)..(279): n is a, c, g, or t
  misc_feature (321)..(391): n is a, c, g, or t
  misc_feature (396)..(396): n is a, c, g, or t
acccaannnnnnnnnnnnnnnnnnnnnnnnnnnnnnnnnnnnnnnnnnnnnnnnnnnnnnnnnnnnnnnnnnnnnnnnnnnnnnnnnnnnnngtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagagcnnnnnnnnnnnnnnnnnnnnnnnnnnnnnnnnnnnnnnnntatgaaatgttatcgtttttaatatacaatttttaagaatannnnnnnnnnnnnnnnnnnnnnnnnnnnnnnnnnnnnnnnnnnnnnnnnnnnnnnnnnnnnnnnnnnnnnngatgnag

SEQ ID NO: 13646 - DNA, 122 bp, Diabrotica virgifera
  misc_feature (8)..(105): n is a, c, g, or t
acccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctaaaaaatcaata

SEQ ID NO: 13647 - DNA, 404 bp, Diabrotica virgifera
cccacacgtccgacctcagaggcttatattttaaacccatgattttttggaactaggggcccattgcgtcttgttctacacatcaaggactaccaaaacacaaagtttcagagcatttgacagagagccatttcccataaggtttctgtggggtccattgtccattggtaaagtatttaccaaaggttgtaaagaagtttaatcatgaagaaggtcttcaaagtcaggaagtagataatcgagaaagtgataatgacttagttataaaagaacacgtttttattgtagacaaccctgtagtaaaagacttaaatagactaaggtgtgtaaattattcagatgtatcaagtaatttagcagccactggcagccagtttagtgtacctaatccacagcagtttagt

SEQ ID NO: 13648 - DNA, 426 bp, Diabrotica virgifera
  misc_feature (2)..(31): n is a, c, g, or t
  misc_feature (53)..(80): n is a, c, g, or t
  misc_feature (290)..(304): n is a, c, g, or t
  misc_feature (378)..(378): n is a, c, g, or t
  misc_feature (392)..(392): n is a, c, g, or t
annnnnnnnnnnnnnnnnnnnnnnnnnnnnncgacaaatggaattttataggnnnnnnnnnnnnnnnnnnnnnnnnnnnntgtcatttgtcaaaataaaagattctttaactgcgtttgcaataccatttttttagacccgtcctgtatttgtcctttattaaagtatcctgtaataaaggatcctttatttgccggtggcaataactctctattatcagctttgtaattgccttttattagtttaccaccactattttgagaattgaaatgacagcgtgaactgtaggnnnnnnnnnnnnnnncgtattaaaacagatactcacagagtaagaatatacggggtacgttcagtatgatgatttagattttagataanaagagatatattanatagaagataataaaagagtgggccaacgagttt

SEQ ID NO: 13649 - DNA, 182 bp, Diabrotica virgifera
  misc_feature (130)..(147): n is a, c, g, or t
ccttgaatgcaacttcatacctcttcaaaattgtcaccaaaattcaattcattggccttctttttaaaacttcttaactggaaaaaccctggctttacccaatttaatccccttgcaaaaaatccccctnnnnnnnnnnnnnnnnnnaccaaaaaggcccgcaccaatcgcctttccaaaaa

SEQ ID NO: 13650 - DNA, 309 bp, Diabrotica virgifera
  misc_feature (39)..(62): n is a, c, g, or t
  misc_feature (285)..(285): n is a, c, g, or t
aattttaccaaaccccattttaatcaatttttcaaaacnnnnnnnnnnnnnnnnnnnnnnnngtacttatctctaatagtttaggagattatcatcagatattcatttaaacgattaaattattagtaacaaattatctgactggttttcagcctggtaccctcgaaaaatcgaatttacgcaccaaaaaagatgaaggtactgagggaacataagagtgcatattcaaccatccccttgttcctaaactatatacttattatatttaattagatcatattttantatttaagtaatactgagataaaa

SEQ ID NO: 13651 - DNA, 390 bp, Diabrotica virgifera
  misc_feature (55)..(72): n is a, c, g, or t
aaggatcaattatttgctgaagctacccaggaacccggtttagctttccttgtgnnnnnnnnnnnnnnnnnnttaggaatgggataccctgaaatttccgttaacggaattactccagtatttaattcactggttgaacaaggcgctgtgcaagaaccagtcttctccttttacttgaacagagaccctgatggagaagttggtggtgaattgttgcttggtggatcagacccaaactattacaaaggtgactttacttatgtagatgtttcagctaaaggctattggcaagttgttatggacagtcttaacgttggatcttccttaaaactatgttcagatggatgtcaaattatcgtagacactggtaccagtttgatcgcgggacca

SEQ ID NO: 13652 - DNA, 179 bp, Diabrotica virgifera
  misc_feature (14)..(52): n is a, c, g, or t
  misc_feature (71)..(176): n is a, c, g, or t
ataatattgtgagnnnnnnnnnnnnnnnnnnnnnnnnnnnnnnnnnnnnnnngaccttgtgttacaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatg

SEQ ID NO: 13653 - DNA, 124 bp, Diabrotica virgifera
attaggggaggcctatgttcaactttggatgcagaagtctgcatgatgatgatgtcaaatgtaacgatcaaataatacacaacatcaaattctatgtggctgttaggcctggatcccacgtacc

SEQ ID NO: 13654 - DNA, 375 bp, Diabrotica virgifera
aacccaaacgtccgccaacgcgtccggtgaactttcgtaattgtgtttattatttaacactgataaaccccagcagaattattaaacatcagaatggaacaccagcagctgatcaaggaaatgccttatagtggaacagattcccatacaggagagactgacattggcaaggaacagaacaacctttcagttgaggttatggttgcagaaggagaaagaacatggtacaaggagctccaaatatcacaaatcgaacattagagggatctgctttaatgacagcgtcgtagtattggaagctgcagctagaaatgacattgatgaaattcgaatgttgctaatgaaaggcgtcagtccggattcgtgcaacgaaga

SEQ ID NO: 13655 - DNA, 368 bp, Diabrotica virgifera
  misc_feature (12)..(12): n is a, c, g, or t
  misc_feature (42)..(42): n is a, c, g, or t
  misc_feature (112)..(112): n is a, c, g, or t
  misc_feature (133)..(179): n is a, c, g, or t
  misc_feature (232)..(252): n is a, c, g, or t
  misc_feature (254)..(280): n is a, c, g, or t
  misc_feature (318)..(355): n is a, c, g, or t
agtttagttganaataattaattactaatcatttaggaaganatcctaagaacgggggtaatccacctaaggatttcttcctaaatgattagtaattaataatttagttganaataatttttatgctgtaagnnnnnnnnnnnnnnnnnnnnnnnnnnnnnnnnnnnnnnnnnnnnnnngaattactttttctactataactattataataaatgaaatttatagaaaatcnnnnnnnnnnnnnnnnnnnnnannnnnnnnnnnnnnnnnnnnnnnnnnnataagattaattttatgtacagaaattttcagaatacnnnnnnnnnnnnnnnnnnnnnnnnnnnnnnnnnnnnnntagacaaaagagg

SEQ ID NO: 13656 - DNA, 446 bp, Diabrotica virgifera
  misc_feature (334)..(358): n is a, c, g, or t
agcagtagatagatcaagtatatagaaatataaatggtttgtctaacaccgctgttttagatttgaagtagtggaaaccaaagttgtgtcacatgattagaatttccgtaaaagtatttataacgattgttccttaagactgttctaacgaaagtagtagcgcaaaatatctaaacgcttctaataaactcaagaatgctattcattgccgccatttttctcgtacatttgacgtgcaatatgtatacgtcatacgtcattggtatgtaccaaagacgaatgacgtatattgtacgtcatacgtcatacagtcactcactctgtcataaaaagnnnnnnnnnnnnnnnnnnnnnnnnnccatatgttctcgcatcgacatgaatcttatttttcgctttttaattattctggactctttaatgtgttcgctgaaataattttatcc

SEQ ID NO: 13657 - DNA, 400 bp, Diabrotica virgifera
  misc_feature (92)..(112): n is a, c, g, or t
  misc_feature (144)..(144): n is a, c, g, or t
aaaagagtaagaattacgtcaattacccgcttcattactttcttccaaattcccaatttcggtgctaattaggaaaataaatttgggtcctnnnnnnnnnnnnnnnnnnnnntataaaccttaaaggctttaaggggccctgcnggtctgtcagctacgccactgtatacaagttttcggttgatatgcacacgccatgagcaagggtccttcatggttgaagaaacatgttaacataactttgcccgcaaaaggttgaaattcgtatgaccgcacgctgagtatatttggacggattgttaagaacaaaccccattttgaatcacaaaccttaaaaaagtggaatacaaattataaggactcaccaatgtaacgtgtacaaacacaaaaacattttaaa

SEQ ID NO: 13658 - DNA, 179 bp, Diabrotica virgifera
agattcaaaaacttgggaggtcacctcataggttcaaatgtataactaaatctctatggggcgtcatcgagcttcaatttatttaccttcttttaatatgttgaacgtcgtttaatccctttgttacccaaaattctttgccttgaccctattttaccaccctctttcagatccatttt

SEQ ID NO: 13659 - DNA, 375 bp, Diabrotica virgifera
  misc_feature (89)..(102): n is a, c, g, or t
  misc_feature (104)..(120): n is a, c, g, or t
  misc_feature (136)..(162): n is a, c, g, or t
  misc_feature (188)..(214): n is a, c, g, or t
agttttaattaagattaataatttatatttaagtattagttttgaataattttaattattgatagttaatttatgatgtgagagattcnnnnnnnnnnnnnngnnnnnnnnnnnnnnnnngtaccatgagtatcannnnnnnnnnnnnnnnnnnnnnnnnnntaatatatacgaattaaatttagctnnnnnnnnnnnnnnnnnnnnnnnnnnntgttaatttagttaatttatatgtgttgaaatgttgatcgcggctacatatatctcacctgttaagaaataacttgtctttatgtattaactatatagtcacgcctgcctactgataaattagtaaggccgcggttttttaagcatgagcttgtagcttaa

SEQ ID NO: 13660 - DNA, 389 bp, Diabrotica virgifera
  misc_feature (56)..(179): n is a, c, g, or t
aggacgtgtgcgctttgttgccatttatagaccgtatatctaatatgaaactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagttgtccagagaggaaccagtgttaaaagtactattatctagctatttatactatttattgttgtaacatatcctgtgtgtatatacaatcgacatttttaacttatcgcctatcatgaaattgatttttaaaacttggagttttttcactgatataatatattcaaaatggtttaagctgaaattagatgtgtgcctgaccattt

SEQ ID NO: 13661 - DNA, 369 bp, Diabrotica virgifera
aggttttggtttggttgggattgttagatgttgttctggatgttcgggagctgatggatgtgggattggttgtgcaatttttctagaccagagttggtcggttgtgtactggttgtggtgtgattgtggaaatgttttgatttgttttgttggagatgttgaggttaagttgagcaatggtggttgtgtaagagtttgctagggtctttttagtgttgggggtgtcaagcgatagaatcattaatgagtagttcagagttggagtcgggtgtaagggtgactggctgtacatgaaattggatttatagtggtgtgaagttatgattgtttgtacatagatgagattttgtgtgatgttacttactgaaa

SEQ ID NO: 13662 - DNA, 235 bp, Diabrotica virgifera
  misc_feature (6)..(22): n is a, c, g, or t
aggagnnnnnnnnnnnnnnnnnttgaggaatgctgtcggacacagagtatccatacgagcgagtctatgagacctgtagatttggactatctatagtgccagccatgatcagtcacattacgtacatgaagacaaacgacgaatcgcatcttaccaacacaattgctgcaaaatgtcggatcacagtgcctaatgatacatcggctacaatccagtcaaatgggccgtgcataca

SEQ ID NO: 13663 - DNA, 375 bp, Diabrotica virgifera
  misc_feature (30)..(168): n is a, c, g, or t
  misc_feature (268)..(286): n is a, c, g, or t
  misc_feature (306)..(334): n is a, c, g, or t
agcggacgcgtgggttaaattgaattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaccctacatctaattttaatttaccaataaactgattaagaacagtattaggtctattaattattccatctagattttgattaatcccctctcgnnnnnnnnnnnnnnnnnnnaagattattataacattacnnnnnnnnnnnnnnnnnnnnnnnnnnnnntataaatcccaaggaagaacattaatttttatctcactatt

SEQ ID NO: 13664 - DNA, 401 bp, Diabrotica virgifera
agcgtttagtacaactggaacggtggaaggagcttatttcctgaaaacgggaaatttgatctctctaagcgaacaaaatttggtagattgtgcaagcgacttatgtaatggatgcagtggaggctggatgtataaagcgcttgaatatatcagaaaagctggaggaatcatgtctgaagaggattatccatatactatgaaagatgatgtttgccgagaagatgtcaaaatgtcgctcggtcccatctcgggatacacacatctgaatgcaacggaagaagctttaatttcagctctcgctaccgttggcccaatcgctgtttccgctgatgcaactaaatggtcattatatggaggaggagtttttgatgacgaagaatgtggaaaaaatataaaccatg

SEQ ID NO: 13665 - DNA, 319 bp, Diabrotica virgifera
ttggcttcaagggcaaggcttaaaaataaacctgaatcaattaataacctattaaaaaaattcccatcttggacaataacgttatagctaaattaattagtacaacaaattacacagttgagcaggtaagagatggatctcatcataacatgcaaaatataaaaccccaagatcctgtactacttggcttatgtagccaagaaaatttagaagcagaagtggaaaaagcaaaagtagaaaaagagaagcaagaaaggttaaaaagtataaagaatagctattaaggatcctcaaatttttgtgctttgttaacattaag

SEQ ID NO: 13666 - DNA, 403 bp, Diabrotica virgifera
  misc_feature (262)..(279): n is a, c, g, or t
agcggacgcgtggggttgacaggtgtcttacaaagcttgtttaatttataaatactcatcacccaatgaagaactcatattttggcccgatctagcgtcatttcattatgccaggagtacgacagattggttaactgctcaaaatataattttgttcttaagtgcgacaaccctccacatgtgcctcaggcgaggcctatagaagagttttcagtcgaattgtgtataataatagttgggaagtccaaaatgaagatccgcnnnnnnnnnnnnnnnnnnaaaaattacgtgagatcgatttagaaacagtccaaaggcttattgcacatacaaaaccaaatttacgtgccatcgaagatcacggacctctttctattctttaaaaatatattataaaccttag

SEQ ID NO: 13667 - DNA, 407 bp, Diabrotica virgifera
  misc_feature (210)..(225): n is a, c, g, or t
  misc_feature (336)..(373): n is a, c, g, or t
  misc_feature (376)..(401): n is a, c, g, or t
aaagagtttgatttgagttattgtcattatgttaaaatacacggactgaatccttaaactaagggatttaaattaaatttgatgaaatattcttagggatattacaccgaacacaactttagtgcagtaaaattctcgtgttagtgattccatagtaaatcacgaagaaaaaccagggaaaaaaacgttatgataatatccctacatggnnnnnnnnnnnnnnnngattgtgtttactctcaaaattaacaccaaactgtatgagtttatatgtatgttattttaaagtataaattatgtatctacgataagtcaataacatttcgaggatacatnnnnnnnnnnnnnnnnnnnnnnnnnnnnnnnnnnnnnntgnnnnnnnnnnnnnnnnnnnnnnnnnnggggtc

SEQ ID NO: 13668 - DNA, 54 bp, Diabrotica virgifera
atttatatttataaaactgttttatattgaatgtgtaggagaaacatttggtgt

SEQ ID NO: 13669 - DNA, 387 bp, Diabrotica virgifera
  misc_feature (282)..(316): n is a, c, g, or t
aaaattcagagttggcgcaatgatatgaattcattgtaatttctagacgaatctattcatctaggttttattggcatttcggtgatattatattttccatgggatgtgtgcggtgtcctttcttaaatttgtttaaaataaaccattattttagctgttaaacgaaacaataaacatattcctcacttacactccgcttgtttattttcgttaattctattagtcagcgcagtttatgtaaaatcaaagtgttaccttttgtgatctcaccaaatttggcgnnnnnnnnnnnnnnnnnnnnnnnnnnnnnnnnnnnatttcaaaattacattctgtccatattgtgagtttttttaaggtaaggattaaatctcgataaaagataaa

SEQ ID NO: 13670 - DNA, 404 bp, Diabrotica virgifera
cccacgcgtccgagagctgtacaactgcttgctcaagagttatctattccacttactctgaagaatgtgaatattccagccaaggaacaattcgctccagagtttttaaagataaatccacaacacacggtaccagttttagatgacaatggttttatattaatcgacagtcattctattatgacttacttcgtatcaaaatatggaaaaaatgattctttgtatccgaaagatttacaaaagagagccatcgttgatcagagacttcactttgattctaatatcctctttgcaagaggtgctcgtattgtgaaaagagttttctatgaacaaaaacgagacgttgtaccagaagacctggcagcattggtggaagcgtatgaaatagtggaaaaatttttaaa

SEQ ID NO: 13671 - DNA, 398 bp, Diabrotica virgifera
  misc_feature (6)..(26): n is a, c, g, or t
accaannnnnnnnnnnnnnnnnnnnngacacgtgggatgatgctcaatttatattagagatcatgaaagagtatgagtgttaccatcatagaatgaaattaaatgaattccgtgatgttgagattcgagtcttgggtattgccagcaataaaataactgttacaaaatgtctagatagtctaaatcagtatatgcctatgatggatgaatttccaataattgatagtcatgattggaatcacacatgtaacgagtatagcaattctcacatacagaaatgaagtcactctaatctaacagacagattagtcagatatccatgttcctccataggaaaagaagttaaaatgttacttcaggattgccagacattacggctgggctcacaaccaaatttt

SEQ ID NO: 13672 - DNA, 402 bp, Diabrotica virgifera
acatgctgcaaattttacatttacgtatcaaaacagaccaagcatattagaagttatcgctcaacattccctcaatgaaaccttgcacccagctctacaaagacttgctttggtgctttccacaaatattccgcacaaatttggatggttgaataagtatttcgaagaaacttttgttgtgttgaatggtttattacagtatcactatttagctcactatgattcatcatttgctgaacacttttatggactgaaacgggtatcttccaatggtgaccccataaccaaaaggcatagagaattgtctttaatatttttagttggtattccatattttaaaaggaaaatagatgaaaaagtagctataataaggatagaaaatgctgaagggtctatacgaaa

SEQ ID NO: 13673 - DNA, 395 bp, Diabrotica virgifera
agacccacgcgtccgactccctgatcatttcaatgaaattttaaaagaaatagtaactttacaaaaatatgtagcagcttcgagtatttttattaggaattatgatatgcaaaaatgtcagaatattttacaggaattaacagtaagaacgaaacaagtagaagacgaattgctacccaaaaagaaattttcctttaaaaataaagttaaacaaaaggcacagaacagcgaaataaaaagtaaaagtatagacgatgtcgattttaaaccaaaaattgagccagttaaaaacgttaccggttttttcaataagtgtaacgaacacctcgctttagataattctgaactgcttaaaaaggatgtttctatagaaaaattagattcttgtacagtgt

SEQ ID NO: 13674 - DNA, 348 bp, Diabrotica virgifera
aacacgcgttcggccgaactcgtgtggaggactcgtgggtcagacgcggtgggatacgacctgattttttggctagattatttctcgacagtgcattatttagcactttcggcagatacatgtgatcatgggctataggtcaatattgcaaaggaaagaattgaactgtctgctaatgggcgatatcggaaaatgatcactcaagaagtcactttaacaacaactggtatttcagttgagtgatgcacatccatcataaagatacgattttcttcacagttaattacttgtgaatcgagtgtgtaaatttaaatatatcctttgaagtctcagaagtattatgaaatt

SEQ ID NO: 13675 - DNA, 283 bp, Diabrotica virgifera
actgtcacttggtgtataatgcgtcttgaaattcggttcattcatccaaatgttagatttagtcgtagcggatgtaagcgggtggccgccctaaaggatggaagctttttttcgcttgctagttacgtcacatactcgttcaactgagtccaccatagattcatttcactaggcctctcgctttacaatcttcgtaacggttgaaaaccctaggtgttacataccattagtcgctttgtagcattttaccttttcgccaattggctctatagtattaaggcac

SEQ ID NO: 13676 - DNA, 383 bp, Diabrotica virgifera
aatacaatcctgttaaccttgcagttccttttacctctcttattttgaacataagcaatagcctattgtgcaatcaaaaatatatcgcaattttggcctattgaaataaacagacttatagttcatggaactggaactggctttgacataagactaacatggctaatagggcattcacatatcccacgtaacgaagaagctgacaccctagctaatataggaagagatttgaacataccattggtcatgctcctcgatgtccacgacatatacaaccattacgtctaaactatatgatgaattcagatggaaattaaacaccctaatcagaatcaaggacatcaataccgaaatgtacaagctaactttcctaaaaatatatg

SEQ ID NO: 13677 - DNA, 323 bp, Diabrotica virgifera
actcgcgggccgacccacgcctctaaagtgcgtccgtctaccggaatcacgtcacggcagtcagaagaagagcaagtagacgagcccagaatgactgatgcgaagatcatgtgagtgcagggactggtcaatattgatagttcagatttttgagtttagcagaattgagcggtacgacttaagatgctttaaactttatgtgtaataagctcgtattttcacccttgagatctgcctttcatgtcgtttagatcaatccgtgattttgaggcggtcactctatgtgggtactgtctcacttacgctagcgttagacttcagtc

SEQ ID NO: 13678 - DNA, 364 bp, Diabrotica virgifera
aagtctgcatcgccttaattgatactgctatagctcaatgggacactgtatcctctaaaccctatattcaggagagcaatatctgatgatggtatttatcagttaacatatgtacatgtggacattgtgcctgatattatcagatgcctgaatgtatcagcaatgataaagccattgttgttttcgaagacgacgtattacgacgtccatttgataagtgctaatatcatatggtacagtttttgggaatattaaggcatcacacttagccttagatagtggcatgatgattaacaagcatgtcatttttgcagataattccaagagctttgatgctgatgcagttgcatctcaagttacatgc

SEQ ID NO: 13679 - DNA, 275 bp, Diabrotica virgifera
  misc_feature (179)..(199): n is a, c, g, or t
gcgtccgcggccgcgtgggatttatgttaacgtaatagaatattttttagtgacagtaaggacaaatttgatgtaatgctagttaattagtgttgtgagagaatatttgatttttataggggggccgttcagtttgtgtacctcgtgtatcagggagcatgagttgtcaattcactacnnnnnnnnnnnnnnnnnnnnngcgctggcggacgaggaatttttatcgtgacagagatatttgaggcgatttttttgtgatgcgctgtgattcgttt

SEQ ID NO: 13680 - DNA, 373 bp, Diabrotica virgifera
  misc_feature (314)..(331): n is a, c, g, or t
agcggctttacgtatatcaagaaaggtgatgaagatgatcttaaaaatgcagtttatgtgaaaggtccagtatctgtagctattatggttacttccaactttagtcgatacaaatcaggaatatttgacgatgacgcttgtattaccgattatgtgaaccatggggtactagttgtaggctacggaacgcagaatggaaaagattattggatcgtaaaaaattcttggggagatcagtttggaaataatggatatatatggatgagaagaaatacagacaatcagtgtaatattgctagttttgcaacttatcnnnnnnnnnnnnnnnnnngttggataatttttgctactctatgtagcattaggtttttat

SEQ ID NO: 13681 - DNA, 363 bp, Diabrotica virgifera
cacacattattctttgcaaacgatcgaggctatctgcaaagtattgcaggagtttttatcattgtggtctccagaattccctcggttctatttgtgttggatggtgttgatgatgtgccgtttttggcatgtttttgtacattacgtttttcacttctcagtgcaagaactgctacgtgctttttaaattgccagatcaaatatcttcatttaacgatggaatgataatatacaaacaaattatagtaagttcctttgtaagacgtatatttgaagaatccctataaagggttacatcgcagaactttttcggaatactaattccatcatcagtgttaaattccagtaatgtacatgcctgag

SEQ ID NO: 13682 - DNA, 381 bp, Diabrotica virgifera
tacagaatttcacatcaataaatattttcatgctggaatagttaagtacgttgcgtcctattgctttaagatcaacctgtatatactatttatttatttcgtttactattttatacttgtgaatgtactttatgataattgccagatgaaacaatctttacaacgtattgtttatcttcgctttagcgtcacgacatgaaagacaaaaagttttatataaacttgttaatggcagaaattccatttacaccatctctggcacgacgttgtacaataagttttgtaaagatttggatactttgaacgatttgtaaaaaataatatgaaatcattacgcaagtgtttttcaatttgacactacaaaattgctgttataatgtc

SEQ ID NO: 13683 - DNA, 421 bp, Diabrotica virgifera
  misc_feature (56)..(73): n is a, c, g, or t
  misc_feature (254)..(272): n is a, c, g, or t
  misc_feature (403)..(404): n is a, c, g, or t
agcttaattgaaatagttaaattcagttattgtttgattgcttgtttttcataacnnnnnnnnnnnnnnnnnncttgtaaatggtagggagtggaaatttgaaattttgcagttatgtataactttgcgcaccctgtcaaaacgacggtgttgccgtttaggagaatcaacgatgacgtcatatctctaaattgggacgcattattattatatgtcaagggtgaaaatttgaaatgctgattgacgtttctgannnnnnnnnnnnnnnnnnntagtgtttgaattattattgaatttgttccaaattgcagacatcgctttgttgttttttattatcttgtgaacggtggagagtagaagtttgatattttgcagttatgtataactttgcacaccctatcannattacagtgttgcattt

SEQ ID NO: 13684 - DNA, 412 bp, Diabrotica virgifera
  misc_feature (43)..(78): n is a, c, g, or t
  misc_feature (111)..(128): n is a, c, g, or t
  misc_feature (346)..(346): n is a, c, g, or t
aacacgtatattttttagagacctgtaagttgagtgtacatannnnnnnnnnnnnnnnnnnnnnnnnnnnnnnnnnnnaagtatataactttttttggggacagctgcagnnnnnnnnnnnnnnnnnncttgtgtgttttgtcaaacactatatttctagtttttttcagatttttctgtgacgctggtcaccttcaaaaattaaaaaactgttttttaagggggttttgggggtttgaacgtgtttctctcatttttacatattctaaaggactcagttacttcaagttacatataacctataaagacgaaatttatttgatatattctgaagtctataaaatanggaaaatcgccaaaaacccccaaaaaaacagtttttcggatttttggagggggcgagccttgcgga

SEQ ID NO: 13685 - DNA, 374 bp, Diabrotica virgifera
aagcgtcacgttcctctatgacttactctaagatgttgtttgaatttcaatttatatctaattactacgtcatgcaagttgaacgtcaacctgtagacatgcctattttatgaccacaatttcgaaattaaaattcaattgaacctgattctaactttatttgcatgtttcgaccctacatgtaattttactcgcccactgaccggggtcagatcactactatggctactccatatgccctcgacattttgacttatcacctcgcggaaaaagtacattatgatcaaagatcattatcatcattaacgtaaagaatgtaaagttttaagtggtaattataagtcccattgaagaacattaatttttatctcact

SEQ ID NO: 13686 - DNA, 412 bp, Diabrotica virgifera
  misc_feature (115)..(133): n is a, c, g, or t
agtttcatttaacccttatcagaaccctattatgttaagaaatagtcttcatacatctgtgattgtatagtacgtgcccatagttttttaaaaatcgtgacagtgtttgcagtcnnnnnnnnnnnnnnnnnnnaaaattctttagtttaggataaccaacgcactttttacctggactgttctctctgcacttcccactacattagaagcaggagcataatattcaatgcaagcataccgaacgacgtagtcttctaaaaatactgaactaaacatgacagcacataattggtttgggtagtaaagacgatagtgttatttaccaaaattgaaatcatacacactaaacgctcaagtcacttaatttgacacaatctctaaagatcctaatggcattataagtctagtagtt

SEQ ID NO: 13687 - DNA, 411 bp, Diabrotica virgifera
agaaaaggtattgacttggtgaggggactctatagaataggagtggcttagaattagtcactttgtccatttcaggacttattttggacatatattttttcaccccctacagggagtgaaattcacccccatggcaaaggcacacatcggcacattatcaccttttttctttgacgtgttggctatccgtgtgccagatttcatgtcaatccaagcggttctttaaaatttacagcaaaaaccgtgaaataatgtactaataggtttatttgctttttttttgcgctgtaagagcataaacatttccatcaaaattcaagtttcattcaaaaatgttcgtttttttaaagtcctcattttatcttatgacaaagttccataaaaaatatagctacttttcttttctttgtt

SEQ ID NO: 13688 - DNA, 363 bp, Diabrotica virgifera
  misc_feature (9)..(29): n is a, c, g, or t
  misc_feature (49)..(66): n is a, c, g, or t
  misc_feature (220)..(238): n is a, c, g, or t
  misc_feature (248)..(265): n is a, c, g, or t
aacggacannnnnnnnnnnnnnnnnnnnncgatataaaagcataattcnnnnnnnnnnnnnnnnnnaacaacaatctgtattttttgttaaataaatctacaaaatacagacaaatcaaaataaagtgtggaatattgtaggaaattatttatagcgtaaacaataagataactaagtaacggtcatagagaggagtgatataccaaaaaattttagtcnnnnnnnnnnnnnnnnnnngcagacacgnnnnnnnnnnnnnnnnnnctacaaagatcgttttacacctaaaagtctggggatattttttaagtctgctcgtatggagaagattttaaacacacatgtctacctttgatttgaat

SEQ ID NO: 13689 - DNA, 151 bp, Diabrotica virgifera
  misc_feature (11)..(88): n is a, c, g, or t
aacggacactnnnnnnnnnnnnnnnnnnnnnnnnnnnnnnnnnnnnnnnnnnnnnnnnnnnnnnnnnnnnnnnnnnnnnnnnnnnnnngttaaaagggtggacgttctaaatgattgatcgcttccgtaggctgttatgcaatgttaaatt

SEQ ID NO: 13690 - DNA, 419 bp, Diabrotica virgifera
cccaagcgtccggctacctggcaagaagccaccaaggaattggcccgaaaaaggaagaattatatttaagaatacgtacttaaaatatgctccagaacttccacctgtattgaaagatttaaatatagaagtaaattctggcgagaagattggaattgttggacgaaccggtgcaggaaagtcaaccctcattgcgtcacttttcagattagcaccgatagagggtactatatcaatagatgatgttgatactgccgaaataggtttgaatgatctaagattaaatatctcaatcataccccaagaaccaattttgttctccgcttcactcaggtataatttagatccttttgagaaacatggtgatgaggttttatggaaagcgttagaagacgttgaactcaaaggtgctattagtg

SEQ ID NO: 13691 - DNA, 422 bp, Diabrotica virgifera
  misc_feature (401)..(401): n is a, c, g, or t
gtcacaaacattcacacaattcttctgaaataaaacaacaattcctgtctaccatctatagatatccttatttcaaaataatttttactgatgcctccaaaagcagcaatggtgcagctattttcgaagatagtacctctgtcacccgcctagccaaggagtgtagcatatactggagaactgcaagtaatcaccaacgcactaaaccaaatgtatcaacaatatatctgatataaatgttcttattatatcagattctctgattgtcttaaatggggtcaaacataatatgtatcttactcatgggaattgaacacaaataaaagacaggtattatacaatgcacaaacacgtggcaaaaacaaaatattcttatgggtaccaacccataggtataccanaaacatgggataatggagaag

SEQ ID NO: 13692 - DNA, 412 bp, Diabrotica virgifera
  misc_feature (58)..(74): n is a, c, g, or t
aggttgagatgtgttatcaaaggaccaagagtttcgaaaaattatcattcctatatcnnnnnnnnnnnnnnnnngacaaattgagaaaaatgatgaaaattgcggaaattagaaaagctaaatcatctcaatatcatgctgcacttttgcttggtgatcttgaagagcgtgttaaaattttgaaggcttccaatcaactttctttagcctatttgacagctgctactcacggaatggtagatgaagctgaacagctgaaggaacaaattggagaaaagaaaggttttccagatgtagatccaaatgcaaaatttttgaagccacctcctccaattcaacaagcagaatccaactggcctttgttgacagttagtaggggctttttcgaaaatacggccgcagttgctacagc

SEQ ID NO: 13693 - DNA, 418 bp, Diabrotica virgifera
aacggggtacagaacgaaatctttattgtgtatgcccattaaagacaccaatggtgatgtgataggagtagcacaagttataaataaagtcggtgaacaacccttcacaaaaaccgacgaagaagtattttccaagtatctgcagttttgtggtatcggcctcagaaacgcacacctttacgaaaagtcacaattagagataaaacggaaccaagtgcttttggatttggctagaatgatatttcaagagcaatctacgttagagcacgtcgtgtataggattttacttcacgcacaaagtcttattcaatgtcagagagtacagatccttctaacgcaccaagattcatcagctagcttttcgagagtttttgatttcgaagaaaatgacattaacattatagaggcaggagagagc

SEQ ID NO: 13694 - DNA, 144 bp, Diabrotica virgifera
taaattaagtctacccttcgacgttaactttttacgtagcatggactgggatcaatctgtgttgcaagcaaccatatcaaactcaataccaggtcggtggtacggtcgtgccgattgggatatctcagctaaacagatcaatga

SEQ ID NO: 13695 - DNA, 333 bp, Diabrotica virgifera
acccaagcgtcaggcgaatggcgtgcgacgagaggttcgttttactgggcgatctgatatgccggagcggtggactgaaccccttccaagcgggccttcgtttccccgtcacgaagatgcccgcggtagaaccggatatgctgcaattgcagtatctgacgcagatggctttcaaacaggcgcagaccagacttctcaccgaaccatggaacgcgatatccctgcaacaacagcaaaaacttgctgcgcaaagactgattatgcgacatcaacaggtaacaccatatcgccaatacctacaacaaccacacgcgagcaaatctttaatgcaca

SEQ ID NO: 13696 - DNA, 338 bp, Diabrotica virgifera
acccactcctccggaaatcaattgtatctactaactaacaatagtcttaaatggcaataatttgacattattggaattaaacattttaatggataatgcttaatgatacatattgagtacgttctaaattttagataaatatttagattataaattatcattttctaccaaatctaaatacataattcgatcaatgattagttgtattatacatactttaaataatagttcagggattgaagtcagttcaatttaatatagatcgaactcttataattagaaaattatatgtacctcaccaatatacaaggttccatttagaatgctgtatcatttat

SEQ ID NO: 13697 - DNA, 387 bp, Diabrotica virgifera
  misc_feature (128)..(147): n is a, c, g, or t
agatggaagtggtttttgcttcatgtaataggtatatttatcaaaatttctaaaaaatcccaatgcattgaataaattatgataaatatacctattacatggaagtggtttttgcttcatgttagagnnnnnnnnnnnnnnnnnnnnagtatccagtcatttatattctatatattacagctttgcgtgaggtctgtgctacgttgtctatcccataatggttttcctgtgatatcttggactattttcttttcacacgtttccatcagtctttttgtccttgtagtgtcagatcttgtttccgcagtgtaagtcataattggcctaactactgtcctatagatattggcctttgtttctgtccgtagatgtgtgtcgcgccagata

SEQ ID NO: 13698 - DNA, 375 bp, Diabrotica virgifera
  misc_feature (320)..(347): n is a, c, g, or t
atttattagcagaagccaagaataattttctttcatgacaattggatatcattgtgagagaatatttcatttttagcaacgacaaatttactttttgtacctcgcgtatcacggattactaagtactaattctgtactttactaatttcgcatttaaaatagctaaaccattaacagttgtactgtaacctacatatgttaaaccatttttttgtaatgacatgttactcgtttttaactacatctaattttttaggcaataaatcaaatttagttattaccaatatattcatcactaaatatttttagattgtcaacannnnnnnnnnnnnnnnnnnnnnnnnnnngataaaactttattaacatttaattttt

SEQ ID NO: 13699 - DNA, 328 bp, Diabrotica virgifera
  misc_feature (6)..(24): n is a, c, g, or t
  misc_feature (275)..(292): n is a, c, g, or t
gatagnnnnnnnnnnnnnnnnnnnaaataaggagataattatctacataacaactaatcccatcattcttaatatttcattcgaaaataatacccattcgcgatatattacatctcattaagttacaaaaccttctattttctttgtttctaaagatatcagagaaattaaggaaacaaaatgttcacaaaacataagactacaatatgattccgatgtatactgagatttttacttcgtcctccctacagggtgtctcaaatttaacataagannnnnnnnnnnnnnnnnncacccggtataggcacaaaaagaagtttgagtaaac

SEQ ID NO: 13700 - DNA, 365 bp, Diabrotica virgifera
  misc_feature (33)..(53): n is a, c, g, or t
aaggtctttgtccatgagtggatgcaaacaggnnnnnnnnnnnnnnnnnnnnncacgtaaagaaaagacactgtagttaccacagctggtcccaagcccgaatgaaatgtaggggtgattggcaaagttaggaaactaccaatcgtaagaacaaataggtaaggtagtgtcgccaaataaggccagtgtcttaattaggccaattgcaaatattttcttaaatatagatattatattattagagatcaccgtaaatgtctttctcagtcaaaatcgtctaagccattcagtcggtagtatcacatagcagtgtcaagtagactagacacgtgtttgttacggtgcggaagttcgtttataaattt

SEQ ID NO: 13701 - DNA, 328 bp, Diabrotica virgifera
  misc_feature (38)..(53): n is a, c, g, or t
  misc_feature (105)..(130): n is a, c, g, or t
aggtttttgaaaatgtcacaatattttaattatttctnnnnnnnnnnnnnnnntgcgtacaaaactgattcaggaaaaaaaccgccgtttattaagtaacaaacnnnnnnnnnnnnnnnnnnnnnnnnnncaagaataggtactgcatagtataaacatggcgacaatgtggctcaacatgtagttttaatttcaattagaatatagaaaattttggtattaagtactaagtagtgacttgttgcacaacctactatgaagttgtttcgaatcgaacaaaatattattttgttctattttatagtttaaatacatcaccattactggt

SEQ ID NO: 13702 - DNA, 366 bp, Diabrotica virgifera
aaactaacgtcatacaagaattcagttgtacgtgcagatgcttacattcttttttgtggcatgggtaacctggagactttcaaaagattgttgaacagtcttcatactatggtacatactggagtcatcaacagagtagactggggtgttgtaagaatctgggatcattatggtatacaatgtgattcggtcatagtctctcggctaaagattctctggttatggcaacttcattagattatggataagatattcctcactcagggaaatttaaaacaatggagtacattgagggatcttcagttcgcatatggtttaacaattcgcgtatccactctatgcagaccatcgttcaacattttcagc

SEQ ID NO: 13703 - DNA, 389 bp, Diabrotica virgifera
aagctggctgttgtttctgcggcgtgtgctatgagtcatttttaatatcgtatacatattgtagttcaaattacacacataggtacacattatctctcaaatattatattacatacatttttattgttgaaaggtttgtctgataattaactattttgattggaaataagccacaattaaattgaaaaatacaaaatattgaaaatcaaaatgtttatctgatgaaaatcggtccgggttagccggacttccgggttatcgggggccgacttatcggggttccactgtatatacaaaatatcgctagaaataactataaaacaattgctcacaatgtttgatgtgcagtgttagggtttagagtagataactgataactttcttttttg

SEQ ID NO: 13704 - DNA, 386 bp, Diabrotica virgifera
  misc_feature (356)..(375): n is a, c, g, or t
aagcattgttcgtgatactgcataaatgaaaaaagctatattttttgtattcacaatgattagctattaacatgtaaaaagttttatgttcatttctaataaaggttctgagagggagaatcttgggggggtgcttagttttggtcttctaaagtgtactagtaccttagacagatcggtgcagttcgaccttacatattatatcatatctcgactattaaaatttttttcaaatattgaatatttttgtgaaaaacctaaatatttttacaatccacaatatcaagaggtaatttaagatttgtcactttttgcattcttcaaaaccagctgccttaatattgtacataacagannnnnnnnnnnnnnnnnnnngttctctacaa

SEQ ID NO: 13705 - DNA, 422 bp, Diabrotica virgifera
agttatctgtacaatgagatgcgagattttcacactaagccatcgttcaaccaaatctcgaattaaaaaaattcctgtttttatcgtagtcttagaaaaaccaccggtagagaggttttgtgctacaattaatattaacgcattcgttttggcgtattaattaaacgcttttctttagttcaatcgtttgggtcaaatctttggacgttaatttgactactttttgctcaatgcaaatgactaaaaatttgcagacatatgcattcgcggaaacaatacacgataaaaaaattgtttatgtttattaattgtctaaataaaaaaacgattttaacggaaaaatgataaaatatcgtgtttttacactgaagaaacttgaaacttttacagattgtagctagttttatgtacaatacataatt

SEQ ID NO: 13706 - DNA, 289 bp, Diabrotica virgifera
agccgacgcgtccgcacacgctgtcagcggacgcgtgagcaaagagctgtccatcagtcaactggtgataatgagtacacctatgatctacactacatctctgtaagaagacgggcacggcatatcgtaaactataccgtcacactaaagagcatcattagagatcatgatcttcgtctggatgtgatctctcgtaatctctctacagcagatcaaaacctggagatatacaaggtgtgtaaattcacagtataaatagagataaattgattcgcacatcagatatcac

SEQ ID NO: 13707 - DNA, 142 bp, Diabrotica virgifera
  misc_feature (74)..(101): n is a, c, g, or t
ccacgcgtccgcacgtgagagcaggttgggttccatccttaaattaataacaaaattttattacgatagggacnnnnnnnnnnnnnnnnnnnnnnnnnnnngataaatattaacacaaattaaattctagtaccttgtgtac

SEQ ID NO: 13708 - DNA, 412 bp, Diabrotica virgifera
  misc_feature (99)..(120): n is a, c, g, or t
taaacacacgtctgcaatgttaagcaacagaaatagtcttggacttagtgttctacccctctagaaaatatgataaaagctgattattaatgtgtatgnnnnnnnnnnnnnnnnnnnnnnttagtgcggtatccctccaaagtgcagaaatatttctatgtataccctaaaaaaatcccaaatgcaaaaaactgacgcaactttagtcatgtcagcatcatgtatttgtaacttttggtaacaatagtaaaatttgatttttataatagtttaattttgttcctttttttatttgttcacttaagttgttgaaatcacaaacatttttccacaaaaatatcttgttccataacctaaatcgaagatgtaatatatccaatgctttatagagtggttattgtagaataaaatg

SEQ ID NO: 13709 - DNA, 409 bp, Diabrotica virgifera
  misc_feature (76)..(95): n is a, c, g, or t
  misc_feature (106)..(137): n is a, c, g, or t
  misc_feature (140)..(168): n is a, c, g, or t
  misc_feature (176)..(216): n is a, c, g, or t
  misc_feature (224)..(237): n is a, c, g, or t
  misc_feature (239)..(269): n is a, c, g, or t
  misc_feature (307)..(325): n is a, c, g, or t
  misc_feature (353)..(404): n is a, c, g, or t
agcccacgcgtccgagtttgtgaaggttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtatt

SEQ ID NO: 13710 - DNA, 391 bp, Diabrotica virgifera
  misc_feature (282)..(299): n is a, c, g, or t
acaatggactccctaacctccaacagaaaaccaacctaaaatacgaaccttaaaattttgtttgcaaaaagggaattaagttagttaaacataagttgtgaaattgtatttatatgaatatatagctttatgttttagttagatgcatgtctgaatcattggtgataaggcactttaaaaaaacggtgtatctttgtgattgattatatattaccagaataaaagtgggttaaaatgtatcagcttgatgccttgatctaaataaaataattctcaaaaatnnnnnnnnnnnnnnnnnntcacagacagttttcgacatgttgactagtctgtgttttggcatgaatgttctttaccacttaattgtctctaatgaatctttcgtactctt

SEQ ID NO: 13711 - DNA, 310 bp, Diabrotica virgifera
aggatcaaaacacctttgcatacattcactccatttggtaaagcagttatttccagtcgacagttgggacctgcaatatcactgttttaaacgcatcgatggcttcatctggtgactggaatcgctgcacatgcattgacatcgtaaactttatgatcgtgatgaagtcgttgggacctggtctgggctatacagtgaatggtttaacatttcgatgttttaaagttccaaaaactctattgtatttttggcagtgtgcagacttgcattgtcctgatgtatgatgattcgccgttgactgatgttttgt

SEQ ID NO: 13712 - DNA, 431 bp, Diabrotica virgifera
taaacacacgtctgctaacgcgtccgtttcagataattaccgaacaaaaatcagtattatgaaagttaccggtactttggtgatacttagcgtttattttgtgttaagtatagtcgactctgcaacagcgagacaagtgcctagaagacagttgctttcagagaataaaagtgacattgaggaggactgtaagaatggactacaaaattattacaattacccttacgactgccagaaatattacacttgtagagaaggaaaattataccttagtacatgccaagacgatttatactggaatagtgaacttcgcagctgtgatattcaagcaaatgtgaattgctcaaagataattccccttccacatccagtgtgcacggattctagaacaacgttctatatttacccttacaactggcaaaaaatttaag

SEQ ID NO: 13713 - DNA, 403 bp, Diabrotica virgifera
  misc_feature (32)..(50): n is a, c, g, or t
agcccacagcgtccggatgctagaaacttttnnnnnnnnnnnnnnnnnnnaaacactttaggaaggttctaatgagttttccacgaaaagtatttgattttttggttgtttcatgttaaaatattcgatttcgaatttgacgtataagaggaacttttcattggctgcaacttttcttttactgggtcgataaacttcatttttttattagctacatttttgctaacaatattcttttaaattaaatacttactccttgaactaattgcgaaagattgcctaaaaacgtgttttgtttgttgaacaataaccattatttttactcataagtaactcgaaaagtcttgagttgaccacttcggtggtgacactgaaaaattacatggtattgctatattttacg

SEQ ID NO: 13714 - DNA, 182 bp, Diabrotica virgifera
  misc_feature (3)..(80): n is a, c, g, or t
  misc_feature (85)..(119): n is a, c, g, or t
  misc_feature (139)..(170): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnaaagnnnnnnnnnnnnnnnnnnnnnnnnnnnnnnnnnnnggaacctgtgttacaagggnnnnnnnnnnnnnnnnnnnnnnnnnnnnnnnnccgaattaaaag

SEQ ID NO: 13715 - DNA, 87 bp, Diabrotica virgifera
  misc_feature (11)..(71): n is a, c, g, or t
aaaataaatcnnnnnnnnnnnnnnnnnnnnnnnnnnnnnnnnnnnnnnnnnnnnnnnnnnnnnnnnnnnnngggtgagcagcacaat

SEQ ID NO: 13716 - DNA, 328 bp, Diabrotica virgifera
aggagccattggttcattgtcaggattgatgactgaagccgaaagcatttaattttcccaataacatgttgtgatctactctgtcagatgacttggataagtcagtattggtagtatcgatctgactttgactcgccatcgcgtttaagactttttgttcagagagtattaaagttgttaccgttgatgtattctgagagtgtccatgttgattgtgtattagacactctttacgttatgcattgaatggctggtgcaatgatctctcaaaatcttatggaatagaggattgtttacaagtgcttctataagttgttaggtcttgttt

SEQ ID NO: 13717 - DNA, 399 bp, Diabrotica virgifera
  misc_feature (269)..(286): n is a, c, g, or t
agcccacgcgtccgctctttgtagatatctcttggaaacattaatatgctgattggaattctttaattattttatgaaaatattatggttgatttatggcacctgactgatttcagatctccaaatacacattaggaaatcatgaggagagaccatttttatttttccatatgaacttttctatagaaatattagcttgctaatatccactaactagtagaagattgtaatgtcacatttatttaaagaaatggcaggatagcaaggannnnnnnnnnnnnnnnnntgataaattgcatacctttgaagaagacaacatattactcctatacatttcatcaaacaatagaacagaagaaaccacgataccagatgaggaaacacatggaattcagttca

SEQ ID NO: 13718 - DNA, 397 bp, Diabrotica virgifera
  misc_feature (10)..(10): n is a, c, g, or t
  misc_feature (13)..(13): n is a, c, g, or t
aacaaaacanaanatatctcgacagcgttactcaaggaatgtcaaaattccagtggattggcaaatagttttgagttaaatgtcaacccctttggtgcagttttgggaaaaacgcgttcaaagttttgacaacttttattttcaatttctttttgctctgtcaaatcgtcaagtgatgcatactggaatatgtttttgaatcgcgtagtaatttacaaaagagaaggggaacagctgttgaacgtttgtcactacgcctacgctcaagcgcgctgatgtgaagctgctgcgaagcgaatcgaagctagggatattcaacacgctctatttccggtaatttttctccaataaatctgaaattttcagagagtattcttgaagttatgtacttttaatt

SEQ ID NO: 13719 - DNA, 375 bp, Diabrotica virgifera
  misc_feature (272)..(292): n is a, c, g, or t
  misc_feature (331)..(373): n is a, c, g, or t
atggtcccaaacaagtgtgtgtttcgagagctccaagaggcaaaaagaagtctgttactgtagttacaggattgagtagttttgatattgatttgaaagttgcagccaaattctttggtacaaaatttgcatgtggttcatcagtcacaggtgacgatgaaattgttattcaaggagatgttaaagatgacttgtttgatgttattccagaaaagtggcctgaaattgatgaggatctcattgaagatctgggtgaccaaaagagataaacnnnnnnnnnnnnnnnnnnnnnaccttttaagtcataataacaaattaaactatttgttcnnnnnnnnnnnnnnnnnnnnnnnnnnnnnnnnnnnnnnnnnnngc

SEQ ID NO: 13720 - DNA, 402 bp, Diabrotica virgifera
  misc_feature (94)..(124): n is a, c, g, or t
  misc_feature (275)..(292): n is a, c, g, or t
  misc_feature (365)..(365): n is a, c, g, or t
  misc_feature (389)..(389): n is a, c, g, or t
acccacgcgtccgttgaactacgtttagtctgtcaatgattgacagactaaacgtagataagtccgaaaacgttttgaacgtggtccgtttggnnnnnnnnnnnnnnnnnnnnnnnnnnnnnnnatgtaccaactacactggggagttttacttcatgttaatttttatttaactagatggtatacagccaaccttcgggtattatcccgttttatttttgggaaatttaatgtttgtgactacatatttttaaaccattgcactgaagaaatannnnnnnnnnnnnnnnnntaaacttaaaatacattgtatttaatacacaaacacaatttaatcaaattttcaaagaacagagataaaaaanattaaaaaaagtacctaactacanataaaaactgaaa

SEQ ID NO: 13721 - DNA, 140 bp, Diabrotica virgifera
  misc_feature (27)..(45): n is a, c, g, or t
  misc_feature (116)..(136): n is a, c, g, or t
aacagagatgttgtttagccgacatgnnnnnnnnnnnnnnnnnnncattatatctacaaatgcatgtcatatttatgtgctccatctttatttatttctttgttatgtgcaaaccnnnnnnnnnnnnnnnnnnnnnggtc

SEQ ID NO: 13722 - DNA, 195 bp, Diabrotica virgifera
  misc_feature (67)..(93): n is a, c, g, or t
  misc_feature (100)..(121): n is a, c, g, or t
taaaaataataaaatactttttactaaaagtaaagagaaattttatttagactgatacttaattacnnnnnnnnnnnnnnnnnnnnnnnnnnnaagacannnnnnnnnnnnnnnnnnnnnngggtgcagggattattaattgacaattagatattcaatcgtttcgtctttacaagatctagacgattagcattt

SEQ ID NO: 13723 - DNA, 78 bp, Diabrotica virgifera
aagtgagataacaagattgctcgtcgctaatgttagctcaagtatcggacttgcatggtcaggcatgactagttttag

SEQ ID NO: 13724 - DNA, 78 bp, Diabrotica virgifera
  misc_feature (9)..(29): n is a, c, g, or t
  misc_feature (38)..(58): n is a, c, g, or t
actactccnnnnnnnnnnnnnnnnnnnnntgtttgtannnnnnnnnnnnnnnnnnnnnaaaaagagagaaaaaataag

SEQ ID NO: 13725 - DNA, 344 bp, Diabrotica virgifera
  misc_feature (276)..(290): n is a, c, g, or t
attttgcattagttactggagactgaatttacgggattcgcataatagtgagtaacacgcaggacaagtacagatataggtagaattgatccagacaatgatcagaagcagtgctttgttgttaattgttccctcaaattcaagtcttatcgtattatcccttctcgcagtgttcacatgatcagttgtgggagcaatggcccgagacagtgacgattagataaaaactcgatctgcggtagtacacgcatcatcaaagatgttcaatggtagccnnnnnnnnnnnnnnnatacggaagaacaagttaacgctacaggtgtgtaagtattcaattctgaattac

SEQ ID NO: 13726 - DNA, 266 bp, Diabrotica virgifera
actgttcatccttgccgctgcccttattgtggttacatgtgccgatctaagtgccgtcgtgtaatggaccatttttaaggcagcccataacagatcatagaacgtgagttgcgaggacttcattatcgctgttttccaagacaacctcttaattttcaatgtacacaatgctaaatactagtgtgggtacggcacctactacatggcagttaacagattcgcgatgtggtccagcgtcgaattccaagccatcttgggccgtcaga

SEQ ID NO: 13727 - DNA, 329 bp, Diabrotica virgifera
  misc_feature (219)..(236): n is a, c, g, or t
agggcactagcaagttcgtatttcggcagttcatcaatgccgatggacgtcagttaggtattaataggttcgagttgatttgagcttgaggattaggttgtatagcagtttcttagatatcttatatgcttgttgtgcagcaatctgttgttcgtttttaattgtatctcattgtttaagaaatggaattattgttagttattaaccctgtatttagannnnnnnnnnnnnnnnnnatcagtattgatcatttttagggatgtgcatagactacttattttattagaatttaacttttaaagtcaaattaggatttaaaattttcagat

SEQ ID NO: 13728 - DNA, 111 bp, Diabrotica virgifera
gttattttttatgaggcagccagtgtggttttcggtggagctagggaattagtattggggcgagagtagtggatttggtgggagggggggtttagtggagggaacatgtgt

SEQ ID NO: 13729 - DNA, 356 bp, Diabrotica virgifera
  misc_feature (269)..(289): n is a, c, g, or t
gacacaaacatatgtttgagtcgaaagctccaaaaggtataattaatgctgttacagtagttacgtgatagaatattttagatatagatttgaaagttgcagccaaagtccctggtataacatgtacaagtggttcatcagtcacaggtgacgatgaacttgttattcagagagatgttaatgatgacttgattgatgttattccagattagtggcctgaaattgatgaagatctcattcaagatctgggtgaccaaaatagataagcnnnnnnnnnnnnnnnnnnnnnaccctttaagtcataataacagattatactatttgttcgcataaaataatttttaggggatgcgctt

SEQ ID NO: 13730 - DNA, 284 bp, Diabrotica virgifera
  misc_feature (4)..(31): n is a, c, g, or t
  misc_feature (47)..(76): n is a, c, g, or t
  misc_feature (104)..(129): n is a, c, g, or t
  misc_feature (175)..(198): n is a, c, g, or t
gagnnnnnnnnnnnnnnnnnnnnnnnnnnnnatagtattatgagatnnnnnnnnnnnnnnnnnnnnnnnnnnnnnnggggatccctgaccatcatgtatcaagnnnnnnnnnnnnnnnnnnnnnnnnnnacgattttcaattttcatatttcaaaatatgttaatagttaattgnnnnnnnnnnnnnnnnnnnnnnnnatgaattgttaatcgttatacaattttacataattcaaatttagtaatgacgatattattagtattaatatattgtatatttagta

SEQ ID NO: 13731 - DNA, 143 bp, Diabrotica virgifera
  misc_feature (92)..(121): n is a, c, g, or t
agtcgtcatgaaatgtaatttgttttaatcaatatctatatttttgcgagatatatttatttgatttatcaggaataaattcatggttaagnnnnnnnnnnnnnnnnnnnnnnnnnnnnnngacggatgagcttagcaattaa

SEQ ID NO: 13732 - DNA, 173 bp, Diabrotica virgifera
  misc_feature (39)..(57): n is a, c, g, or t
ttacaacaccctgaggtgagtcgtattaaaccgagatannnnnnnnnnnnnnnnnnncattatatctacaaatgcatgtcatatttaagtgcaccatctttatttatttctttggtatgtgcatgcctagataaatatatattttaacggtcaggagaaaataaaataaagtt

SEQ ID NO: 13733 - DNA, 295 bp, Diabrotica virgifera
aacaatcatccttcagaattgtcaataatccatgaatgtatttttgcagttgctaactttcagttgcatcaaggttcacagacagtctatgtttgcgttatagttgagtttagttattattggtgtagtaaagttgtgagagatcaacattggtggtagataaagtgtggttttgagaattattaggtctgggtaaagtctctacaagtctgggtaggtctagcgttgcaatgtgtatcagtacattgcgagtaccgtgcgctgaatggcgattttcttggagagtaatgtaggg

SEQ ID NO: 13734 - DNA, 376 bp, Diabrotica virgifera
  misc_feature (144)..(163): n is a, c, g, or t
  misc_feature (258)..(276): n is a, c, g, or t
ttacttatctagctttatatatagtatctgaaactggttatttattacttaagggtatatgaggattaatttgagttgtagttttttagtggaagattattttcttgattagtattttctacgcctaattttatatgtcttccnnnnnnnnnnnnnnnnnnnnctttgatttttattatagttggagtttgattatgttatgagttagctaaatttaatatttcttatgatttattatggttacataatatttctagnnnnnnnnnnnnnnnnnnnatatgaaatataccatttttatctactttaggaattaattattatccagtttaatttggtatattttaaaggaattttttgatataggatgatttgaata

SEQ ID NO: 13735 - DNA, 299 bp, Diabrotica virgifera
  misc_feature (59)..(83): n is a, c, g, or t
aggtagcgtgggcgggactttgttggcacgaaataagtttttaaatacatagttagatnnnnnnnnnnnnnnnnnnnnnnnnnctgtacctattgctatttgtataaaatattcacttttattatgtaagcacctgtatatgtgtagttttgatttttgtatttgccaataacctattgagatatgaagaaaatacacatacatacattttcagtttgatgtgtattgtttattgtattttatatttctttttttattgtagaaaacgacaatgaaaagttaataaaatctaatttatg

SEQ ID NO: 13736 - DNA, 394 bp, Diabrotica virgifera
tagttttgttctgcctatgtagaagttaataattttgtagatttagctttttgtacatagatattaagacatcggcttcgaaacactacttatttatttttaattcactgtcactgtcttttttcgttaaaccatacctttctgcaaccttatacccttaacttgtttagttcttctgactgttattcggttgttcatctacttctgtaaaaatacaaaactttttctaataatccacctaaatagtataaggatgtttgtaagtaaaaatcgaaatttatttttatatgtacagaactttatttacttgtccaattttctaattttggaaaacacgaggcgactattttgtgataaatcttaagattaattagactaatgttaggtatattgt

SEQ ID NO: 13737 - DNA, 435 bp, Diabrotica virgifera
tgaacacgcgtctgccaacgcgtccggactattttaactcagaagttaattataaatattgcggaggcatgggctgcgcaccagactcgattagtactcagatatttatggcaaaacttcagccagacttaactcgaatagcaactcaggccaactcttggttagacgatttcaaggactggagcgaaaccgagagctgttgcaagtactttaaggacaccaactacttctgccctcattcatacagctctgaagattgcgatccttgttacttcactttaataaataaaactactggcttaagccagtacaattattaccgaaagtatctgcctcactttttgaatgacaatccgaatccaagttgcgccaaagccggacatccagcatatgctaacggcattacttatttgtccgatgaaaatggatatacag

SEQ ID NO: 13738 - DNA, 231 bp, Diabrotica virgifera
atggttactccattaggtaaacatgtaacatacgcttgaatctcttcctatctgtcttctacattcacatcaaagtccatttttttggtctcccttttatgtgaccaccctggttttaccctatttgatcgttttgcctcactccttttgttctaaatttgttttgctagctttttggttatcaccgttgccccttcatatccctttcacatcctatttggaaactggtat

SEQ ID NO: 13739 - DNA, 377 bp, Diabrotica virgifera
gtctacataatttaagtttaccgcgtaggtatagtttggtgcttgattaccccggaaatgatcgtcagtataatgtggtgaaacttaaagaaaatgctacacaattaagttaagaaaaatcaccattgtaacgaaaagactgctttatattataacagaataagactacaacatttatggaaggtgctgaattgaggagaaactcaaagagaaaatccaaacttaaattttcatcgttcacctcatattttagaacgagtaagacaggaaatgacttaatatcatcccctactaatttcgagagaatggacttattcccagataacatttctccagtggttgatatccaagaatgtccattcgatgttacgggatac

SEQ ID NO: 13740 - DNA, 335 bp, Diabrotica virgifera
ctctacagtgacttgggctaattcacgccgcttgatgctggacagcttcatcttaccacaagcagatcatgtgatgtcatctaagtttgcgcagtacggctcgatcttcaacgatgtatatcttgtggattatctgaccggcgacttcgtggtggaacaatactatggacaattggacttaactggaaaagtctccaatttacaaaagacgatgggagaacacggaccccttggcgatcggctctagcatgcgatactccaaggaacctcttcataacttcattagatttgtaaatatctttagtgcagtttttgatttgaccgacgtgatactg

SEQ ID NO: 13741 - DNA, 118 bp, Diabrotica virgifera
ctgtatatacttaactaattatttattaggaataaaacctgtatatctttagaaataaatgtgttttattattgttatatgtaattgtgatttagtattgttataaatataactgctt

SEQ ID NO: 13742 - DNA, 60 bp, Diabrotica virgifera
aaaaagcgtcagtaaacatcaagaagaacatcgaactgtagcagcagctaacatggcagt

SEQ ID NO: 13743 - DNA, 387 bp, Diabrotica virgifera
agcaatattttgcactgctcctacctttggttcaggaaaaaatatcgtatgctatttctcgagctggacagtttatagacacggaggagacggagctggatctttcgacgtacgtaacatagacccatcgttatgtacccatatcaattttgctttcattggtcttaacacggatgcctccattcacattttagatccgtgggaatccaatgatgccggaggtcctgagggttttaaaaatctggtagctctaaaagaatcaaatccaaatcttaaaataattgtaagtatgggtggctggaacgaaggatccgaggtatactcagaagtagctgcaaatgcaatgttgagaaaaattttggccaacaacgttgcatattttcaaaa

SEQ ID NO: 13744 - DNA, 394 bp, Diabrotica virgifera
aggtattcgttgatgaagttgcacaagcatgtgaacctgaagtttgcatagccttaggtatggttaaacatggacagcagatagtattggccggagaccccaagcagcttggaccatcattaacttctgattctgcgatccgatatggcttaggtatatctctccttgagagaattatgcaaaccgaattgtatcaccaacataaccagcggtgtatcaccatgttgatacagaattttagaaaccatccaaagattctaacgttgcctaacgagctgttctacggagaccagttgcaggcccagtcacaaaggtcattattagaccccttagcaacaacttgcgtcttccaaaagctacaagaaatgtacagtgttgcgggaaagaagaactc

SEQ ID NO: 13745 - DNA, 72 bp, Diabrotica virgifera
acaaatataagtttgggtaaacttttgcacaactgtataaatactaacgaacaaaacaaaaaaacagaaaga

SEQ ID NO: 13746 - DNA, 394 bp, Diabrotica virgifera
  misc_feature (60)..(82): n is a, c, g, or t
actacagtacaacaaagggtcgctgtgttggtttccaaaggtccataggctagcacatgnnnnnnnnnnnnnnnnnnnnnnnaccatcctggaattattgtgattgttggcactcaacacttagattaaatcagacaagatgacaccgcatcagaatgcggtgtgctcgattattgagctagagcaaacatctaaaaattatcgacctatcggcacaagagttgaaggtttcaataagttttgttcacattatcataattattgtaacaatagaccctacgactaaaccacattgaccctttgccacatgccctaagtgtgaagaaattctagcaaatgcttcatgctgtcatggtatttctttatagaagaaatatagtggaaatatttaaag

SEQ ID NO: 13747 - DNA, 385 bp, Diabrotica virgifera
  misc_feature (19)..(40): n is a, c, g, or t
  misc_feature (86)..(105): n is a, c, g, or t
  misc_feature (111)..(147): n is a, c, g, or t
  misc_feature (192)..(221): n is a, c, g, or t
  misc_feature (286)..(307): n is a, c, g, or t
agttacgtagtattgtgannnnnnnnnnnnnnnnnnnnnngaagaagatttaatttttgctacttgtgtatcacggattactatgnnnnnnnnnnnnnnnnnnnngttacnnnnnnnnnnnnnnnnnnnnnnnnnnnnnnnnnnnnncatataactattttaaataattttcttgtaatgatatgtgatacnnnnnnnnnnnnnnnnnnnnnnnnnnnnnntacattatatttatttagtaacactatatttagacttaaatagttttacattattaataggaacnnnnnnnnnnnnnnnnnnnnnncataacattttagtaaaatttattttctatgtaaaaattaagagtacaaattttcataatttaaaataagttactaat

SEQ ID NO: 13748 - DNA, 376 bp, Diabrotica virgifera
aaaacatgaagactgctttggttttgactcttttgttttgtgtcggtcttaccgtcaacgccaaaacagctaatatgccagagaaacctacccatcatcccgccacccctgagcccgagcctgacccagaggagtttcagtgcgatgcttgcataacgtttgcaactgttatcgatgagttggtcgaagagagattaccattggacgaagttgagagagatgccagcttaatatgccgcatattaccaggtaccttaggagaattttgcgaacaacacttacttccaaaagttgacaaaatctacgaagaatgccacaagcatgaacctcaagatgtatgtgatcgtttggacttctgttagagagacattaataa

SEQ ID NO: 13749 - DNA, 394 bp, Diabrotica virgifera
atattaatagcattatgggtagacttcctaagtgatgcagatacatacaattttagtacgtatttccagtagaactactgcaataacatcaaacaatgggtctattgttatacgaaggggttgtggaattaataccaatatgaccattcaaaattttcataaaattttggataaaatggtacccattagttgttatcagttaagtttaaaacttggcactcatggagagctataccataatatataataggtatatctcatattacatctcatattgttcactacagtagtaatcagtgagcctgcatacacagaaccataataatatattatggttcgtgtatgcgggctcactcattgcaatagtgagcaatatgacatataacatattata

SEQ ID NO: 13750 - DNA, 438 bp, Diabrotica virgifera
aaatatctatatcactatacatatcttcgtcatatatttctacttccattatatcatcggctgtttttactttgcttatatatcttagtacttcttcagtgtttcctaagtctaattctatgttcacttcgtctatggtcatctctttgaactccgtttcaattcctactatcctcttcatcagaaactagcactaggcctcttcaaggtacacattgtgtacaattttacaggattgtggactcagtgtcctagttttcacgtcacttgtaataattatgtttaaaaaatatggtaaatgtaatcaccaacacgttcaactgacgtcccctttccttgatttactacctgagtgagcttcgccgttgcagatatttctgcacacttgtacgttgtttccttcatgttaggtaacactaccttttaataataataata

SEQ ID NO: 13751 - DNA, 266 bp, Diabrotica virgifera
  misc_feature (2)..(21): n is a, c, g, or t
  misc_feature (116)..(141): n is a, c, g, or t
cnnnnnnnnnnnnnnnnnnnncaaagtatagaaaaattttacttagtgatagtttattactaatgtgagagaatattttagttttatcatacgaaaaacttagatttttgtaccannnnnnnnnnnnnnnnnnnnnnnnnnctaattatcatatttattcactttcgaactttaaaacgagctacaaaatcttaacaagtttttaattgtaaacaataagagtattttaacatacactttttattgataattgacacatgttatat

SEQ ID NO: 13752 - DNA, 330 bp, Diabrotica virgifera
  misc_feature (155)..(188): n is a, c, g, or t
acttaaaataacaataaatacacaattttgcgtaaagtttactttaaaaatatattgtacatttatgtataagtcaaaaatccacgtaatttttacataatattcatttaactggtctcagtctgtttgctagaaataaatcagttttttgtacnnnnnnnnnnnnnnnnnnnnnnnnnnnnnnnnnngacaatggtttttgactgagttattctacatatcgcacctccgctcaaagagtgtcataactcaaaaaaatttaaaatcggttttattgcaccaacagtttaataaaactataaactcatatctcacaaaagtgtcacgttt

SEQ ID NO: 13753 - DNA, 381 bp, Diabrotica virgifera
  misc_feature (46)..(185): n is a, c, g, or t
aggacgcatcgggtcacgcctacagttttaacaagctccatagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgatgctaaagttgaccctagacaagataacgcaagtgacaataccagttgtaggagcccatatgtcatatgttaagcaagtgttcgatcagctgcgcaataaggaacacttgaagccagacctcatgatacttggcaacgtacgcgtggaaataaattaggcgcaaaatcattcacagcatcaatgtctgga

SEQ ID NO: 13754 - DNA, 51 bp, Diabrotica virgifera
aatttaaaatcataagatcttttttagtccaagtgaagcaaaattttagtc

SEQ ID NO: 13755 - DNA, 348 bp, Diabrotica virgifera
  misc_feature (100)..(119): n is a, c, g, or t
  misc_feature (121)..(146): n is a, c, g, or t
cgaagaatatgtataatgtttctaattgtgtaaaaggcaaaacaaaaaactgcgatatctgctttaacaaggaaaaaaggatcaaaattttaagttatgnnnnnnnnnnnnnnnnnnnngnnnnnnnnnnnnnnnnnnnnnnnnnntacatagggcatttctcgaaatgcaacggttctcgtgatagataacgacacgttcacgtcgaacgtcagagaataactgaaaagtgtcattgttgcggaataaacatacatattcattttactgccaaattttccacttttcctggtaaaagtatagaatttttggagtgaatttaacaagaaactggaattatgagttttt

SEQ ID NO: 13756 - DNA, 418 bp, Diabrotica virgifera
acggaaacacagttacctgtatcgttccgacatttgattttgcccgagaaaaacttccctcctactgaattgctggacttgcaaccgctgcctattactgctttgagaaacgaacaatttgagtctttatacgccgataagtttccacagtttaatcctatacaaacacaggttttcaactcagtatacaatggagacgacaacatattcataggcgctcccacgggatcaggaaagaccacaatagcaaaatttgccatcctcagactcttcgattgaaatcctgaaggtcgatgtgtttatctagttcctaaggacgccctcgctgaactgattttcgccgattggcataataagtttggacaggccttggcaaagaaagtggtattgctgactggagaaactggtactgatctaa

SEQ ID NO: 13757 - DNA, 378 bp, Diabrotica virgifera
agtgtgatatgagtatgatgtgtcaagtttaagataagttctgcataattgcgttcgactacaaaattatcatcggtgttaatatgttattttttttacacaaatatgtgtattgttccagtttacgataagtgcagcgttgattgttcaaatatccaattatcgaacctacctcgcacatctcctagttgtgagtagtctttcgtggcaacaagatggttttaactaagtacctcgaaacgaaatgtcaacagcacatagttggagatgatcattttaacgaatccgattattggaatagtagtgccatattatttcctgaagatgattatacagaaaatgctactaccactatttagggttccacgattcggatat

SEQ ID NO: 13758 - DNA, 409 bp, Diabrotica virgifera
actttattttgttttaaacttgtaataatggctggggaagtaatagttgatgctttgccatatatagatcaaggttatgatgagccaggagttagagaagcggcttttgctatggtggaagaagagtgtagaagatttaggccaaccaaaaactacctggaacatcttcctccacttaacatatcatcttttgaaactcctattatgcacaatgagttcgaaaggttgcagaatcgattacctatggaaaccttgtctatgaaacgttatgaacttccaccacctccaagtggaaaactaaatgaagtgggtgcctggaatgaatgtgtagacaactcacaagctcagctagaacatcaagctgttagaattttaaacctgcatcttatgttagactactgttgtcctg

SEQ ID NO: 13759 - DNA, 408 bp, Diabrotica virgifera
agcccacgcgtccgatgaagactgtccattcttttagctattttagcgttgcgtcggtttaaccgtcagcgcccccccaaagaacgacgtcctgtgtgatatctgcgtagcattgacaatagtgatccatgaccacttacaacaagacttgccattggacgaacttgaagaaatagtaacggaggggtgcagtgcattaccagatccacttgcagatttatgcaagaataaactgaatcgagcagtctagagcatataccaccgatttgaggacggctcgcctgtagaaatatgcacagttttagacttatgtgagacagattaatatgaaagtcagaataaactctaaagttttaaaaacatttttgaacctttttaggcaaaaaacttcatattgggggaatcaag

SEQ ID NO: 13760 - DNA, 71 bp, Diabrotica virgifera
ctagaaagattaaaaaaaacataaaaatacatgaaaaaatcatcaatggtgtcaagtgtcattcaaatttt

SEQ ID NO: 13761 - DNA, 365 bp, Diabrotica virgifera
aggctgggtgataggtgtagttattaaagaataaattatctaggttttattaacaatagaagtgaaatgttagcaaatataacatccaagtttcgtaattgtacttgctcagttagaaaatattctgtagtttcactatcttcaaccgaaaatagaataaatgtagaacctcgcgaacttgcctttcctccaaaatatcaagaacctcgacaagtttggttggagagtttagatacgatagacgacaaaaaattgggtattcttgagctgcatcctgatgtttttgctactaatccaagaatagatattatacatcaaaatgttagatggcaaagtttatatagatatgtaagctatgctcatac

SEQ ID NO: 13762 - DNA, 424 bp, Diabrotica virgifera
  misc_feature (383)..(383): n is a, c, g, or t
aggcatagcctcatttgtttattatattttttaccattcttttctaagttcatcccttcatatgacacattatcttcaatttaatggatccgccgaataacgtaagcaccacattattcatttttaagaaatcgaacaagaactgttgaaattataataatggtaaatgtctaacacagcgtttcttaaccggtgggtcacgacccactagtgggtcgcggtgtggctcttacagtagctgaataacatacatatatatcatcatgggtgagggatggatcgcgaatataaaaaaacgtcagaaggtgggtcgccagacataaaaggttgggaaccactggtctaacagtttaagggttagcaatacagtacacagtaagtanaagttacaaactgtactactaacccttaaaatgtataaatt

SEQ ID NO: 13763 - DNA, 422 bp, Diabrotica virgifera
  misc_feature (57)..(77): n is a, c, g, or t
  misc_feature (363)..(363): n is a, c, g, or t
agtagtgattaaaaaatgtctgagtacgataaagttcgaatcggaaaactggtattnnnnnnnnnnnnnnnnnnnnngaagaaacgcaaacacaaacctaaacaacaagaggaagaaacgccaaaagtggatgttgatagtgcaaaacatggaaactggtggtccatacagaaaaaagatgagatggttggtcctatagctatcgaattcggtgcccatacatacgtaagagctctagacaacgggctttttactctaggagccccccacagggacggacaaggaccctctccggaagaaatcttaacagccataccaataaacgaaagaaaaatagctttcaagtcggggttacataagttnttacgagtagagaaaaatggaagtgttactgggagatccgatgccataggagccatgga

SEQ ID NO: 13764 - DNA, 323 bp, Diabrotica virgifera
aggcttcattcatggcgctatttcaaagtctgcctaacgggttcaaaatccgttctagtggatatggaacatctgacggtcacgaacatgccctagatcatgctcaataaggaggcattcgtcatcgcgatactgccagcgtttatcagcgcgaagctcttacagggaacgttttacagaaatgggttcgcaatataatacatggggaagatatttttagtagcatggtgtttcaaacaagagatgacttggatcgagaataagctcgtaaagaaagcttagaagatcttcagctggattacgttgatctatatctaagtcat

SEQ ID NO: 13765 - DNA, 418 bp, Diabrotica virgifera
  misc_feature (334)..(334): n is a, c, g, or t
agattatctgtagttacattgttaacacagatcgatactgaaaaagagcaaactttgtttttcgttggatctatgattttcgcaacaatgttaaactgtttcacaggtttggcgttagctagcttatacgaattaataaccaaatttccgtgttcatattatgcttcacttcagtcaggtaacaatatatgtggaatcttgtcagctgttttacaaataatccttcttagttttcggctaaggccaaatgaaaacggtgcaattcagttctccgttggctgctttatcctgatttttactacaatttactattttgttgtgttcaagaattcanaatattttatatacaggatagatacaaaccatgaagatcaaagaaatttatctactgcagaatggatgcaaattatacctaaaa

SEQ ID NO: 13766 - DNA, 317 bp, Diabrotica virgifera
  misc_feature (6)..(43): n is a, c, g, or t
  misc_feature (54)..(73): n is a, c, g, or t
  misc_feature (87)..(112): n is a, c, g, or t
  misc_feature (120)..(157): n is a, c, g, or t
  misc_feature (160)..(184): n is a, c, g, or t
  misc_feature (212)..(231): n is a, c, g, or t
  misc_feature (236)..(262): n is a, c, g, or t
gttctnnnnnnnnnnnnnnnnnnnnnnnnnnnnnnnnnnnnnncgctgcccttnnnnnnnnnnnnnnnnnnnntctaggtgccttcnnnnnnnnnnnnnnnnnnnnnnnnnnccataacnnnnnnnnnnnnnnnnnnnnnnnnnnnnnnnnnnnnnntgnnnnnnnnnnnnnnnnnnnnnnnnncgaggaacacaatgctaaatacgaaagnnnnnnnnnnnnnnnnnnnntggcnnnnnnnnnnnnnnnnnnnnnnnnnnncgctgaattccaagctatgttggcccgtcagatggctaacaagcccaaacaatcc

SEQ ID NO: 13767 - DNA, 324 bp, Diabrotica virgifera
gactacgcgtccggttctttcagaataaaactcataatgaatctgttcatccttgctgcggccactagtgttgcgataagtgccttcctatgttccatcaatttattggctacttataacgtgtcgtacaacgtggctgaggatattattcatgtcgctgttatttacgctgttctcagagatatcgacgtacacattgcgtagtacgatgcttgatttgaatccttatacttggctgatatcatattcgccgtttaggtcagtcatggtttctaagctatgtttgaccgttagttagcaaaaatacctttacaatcctttatt

SEQ ID NO: 13768 - DNA, 274 bp, Diabrotica virgifera
  misc_feature (10)..(82): n is a, c, g, or t
  misc_feature (85)..(218): n is a, c, g, or t
  misc_feature (231)..(252): n is a, c, g, or t
  misc_feature (254)..(273): n is a, c, g, or t
ggaataaccnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttaataaacnnnnnnnnnnnnnnnnnnnnnnannnnnnnnnnnnnnnnnnnna

SEQ ID NO: 13769 - DNA, 145 bp, Diabrotica virgifera
caattggacgattacaatgggaagttgtaactgagtcctcaattgatattctacttcatgatacctattattttgttgcacttattcatgatgaatgaactacaagagctgtattggctattacatcgggatatatacgattaat

SEQ ID NO: 13770 - DNA, 338 bp, Diabrotica virgifera
  misc_feature (10)..(203): n is a, c, g, or t
  misc_feature (208)..(272): n is a, c, g, or t
  misc_feature (284)..(316): n is a, c, g, or t
gttaattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaannnnnnnnnnnnnnnnnnnnnnnnnnnnnnnnnnnnnnnnnnnnnnnnnnnnnnnnnnnnnnnnntttaggatgacnnnnnnnnnnnnnnnnnnnnnnnnnnnnnnnnngattaaatttctatttaaatag

SEQ ID NO: 13771 - DNA, 433 bp, Diabrotica virgifera
  misc_feature (43)..(56): n is a, c, g, or t
  misc_feature (58)..(75): n is a, c, g, or t
cccacgcgtccggtattaatgttgacggaggctcttgtgaacnnnnnnnnnnnnnncnnnnnnnnnnnnnnnnnnagtaaatattttgtattatatctcattttattggtatattaaacatcacttcactttgatgttgatttgttaatgggcataaaagtttgatttagtatggttgtaatagcaatatcatcttgtgggtttttattaatattctacatgtaccaacaatattactgcttaggtattttgatatcttttcaatatttacataagtgtcagtttaaggatcatgcacttcacggccaacctaataacattgaagcttatttttgttgcagttaatgttgggctcaaaaatcaagaatgacttaaaaattaaatcagttagttatagactgcttaagaaataataagtatcataaaatgccat

SEQ ID NO: 13772 - DNA, 427 bp, Diabrotica virgifera
  misc_feature (182)..(217): n is a, c, g, or t
  misc_feature (278)..(300): n is a, c, g, or t
  misc_feature (368)..(369): n is a, c, g, or t
ttaaaacctgaagaaagatttatgaactggtgatttacaaaatcttttttctctctttgacacacgtacattcaaatttgattttagatttatttatatcaatttacgccagtattaatcataattcagagttggcgtagtgatgtggaatgattgtggtttccagacgagtttattcgtgnnnnnnnnnnnnnnnnnnnnnnnnnnnnnnnnnnnngaattgtagagaaacactcattgatatttttcttaccacaagttataaacagtaagtttgnnnnnnnnnnnnnnnnnnnnnnngaattttcttgccaagtttttggtttttaaacctttccgaatgtattgcatttgacgattattatcannaacacagagtcttagttgatatggatacggttttagtatatttggaatatttggcata

SEQ ID NO: 13773 - DNA, 430 bp, Diabrotica virgifera
  misc_feature (10)..(30): n is a, c, g, or t
agatagtttnnnnnnnnnnnnnnnnnnnnntaggggagaaagttgaagttactggtgatattaaatttgatatatttgtattaggcagtgttgcagtttctaaagatggatatcgaattggtaaaggaggaggatttgttgatttggagttcgctatttataaggaaatgaaagcaatcactgaggataccattattattacaatcgttcatgattcgcaggtatttgacactcttccccaagaattatttaaaacgcacgatattcctgttgatgtcataataacgccaacccgcgtcataacgggtggaaaataaattgtcaagccaagtggaataatttggaatgaaatgaccggcgcacagattagaagcagaaaaatatgcagactttaaaaacaaaatgtgaaagcgaaggaagggatacaaca

SEQ ID NO: 13774 - DNA, 135 bp, Diabrotica virgifera
  misc_feature (3)..(30): n is a, c, g, or t
  misc_feature (40)..(73): n is a, c, g, or t
  misc_feature (75)..(134): n is a, c, g, or t
gtnnnnnnnnnnnnnnnnnnnnnnnnnnnnggggttactnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnc

SEQ ID NO: 13775 - DNA, 414 bp, Diabrotica virgifera
cccacacgtccgtccagatccttgagacccatccacatcatatttatttcgttggtgcaatgatatatttgttcacatggttatctaatttttacatattgatatgagattgcaaactgaatcttcgtcatctgtctaaagctaaaacaataattgtagaagatataattcctaaatattgaatattagcgaaagtaataatgagtttgttgatggctctgacatgactgtactcgatctgtcatattgtcttagatttgtgataaaaagaaattctatagtttgacaatcactttgtgagttatctttatttgtagtttttatatatagcactacaataatttgagtttttcaagcagaataaatctatgacctatatttagattctttgtggtgcgaacttttttggtaact

SEQ ID NO: 13776 - DNA, 387 bp, Diabrotica virgifera
  misc_feature (35)..(52): n is a, c, g, or t
  misc_feature (100)..(122): n is a, c, g, or t
  misc_feature (299)..(299): n is a, c, g, or t
  misc_feature (305)..(305): n is a, c, g, or t
attgagggacatacatcttacatccattaacatgnnnnnnnnnnnnnnnnnncagtaagaacacagattctcattaaagtataatatatatagttaaacnnnnnnnnnnnnnnnnnnnnnnngtttaaaacagtatgcacgaccagcatgcacaagatgatgaaaaatatacattcatttagttatattctttaggaagaaggtagtaggtagataagagttaggtacatttatttgtccgattatgaaacacgatatgcactttttagaattaacattcacagttttctgagtaaaanatgtcntatgtcaccattgtcaacactatggcgtgtaagcatccatcattcgcctttggtaggcttttggggaaacattgggttcatc

SEQ ID NO: 13777 - DNA, 290 bp, Diabrotica virgifera
  misc_feature (29)..(49): n is a, c, g, or t
  misc_feature (140)..(160): n is a, c, g, or t
  misc_feature (240)..(240): n is a, c, g, or t
acgtccgaatttaatttattagtatatgnnnnnnnnnnnnnnnnnnnnngttttatatatagaaatgtgagtaataatgtgagatataatggggattttattaattattgtaccatgtgttgcacggagtataacatggnnnnnnnnnnnnnnnnnnnnncgatattattttcgcttttaaattagcttttttattgtaatttatatagtttaattaatattttatgtatgttatgtganacgaaatgatatacgtctaaatttatatcaaattttttaagtttaattat

SEQ ID NO: 13778 - DNA, 413 bp, Diabrotica virgifera
agacagtgcattgtgcaaaacgataaaactattttgaaacagtaaaacagagcagtgtcagcataaaggcattgttcgattttaactgtattgtgctactgaaagtgcacgtcaacttgtttttaagtgcactcgattacctacaaactaaagtttaaatcaatttttacgagttcgatttataatatggtgaggataaaacaaagatataacttgatatgatccaggtcgaatccaatagcatgggctctccgatatcggacttcacggatgacaacttcgaagaagaactagcagaagcttgcgaggagaacttggacagtctgatgttttgttcgacttcatatccagaagtcggagatactgctcccgaaaagttttctgagatttcgagatacgggatcgtcgatgtc

SEQ ID NO: 13779 - DNA, 51 bp, Diabrotica virgifera
ctctaaagtaagtcgtattatacataaaaaaacaattacaaaagaaagaaa

SEQ ID NO: 13780 - DNA, 71 bp, Diabrotica virgifera
aacaaacatccaaatgtggattattccttcatccagtacactacatatccacttgccaacatctgcagata

SEQ ID NO: 13781 - DNA, 431 bp, Diabrotica virgifera
  misc_feature (203)..(220): n is a, c, g, or t
  misc_feature (284)..(284): n is a, c, g, or t
  misc_feature (333)..(333): n is a, c, g, or t
  misc_feature (336)..(336): n is a, c, g, or t
  misc_feature (348)..(348): n is a, c, g, or t
  misc_feature (357)..(380): n is a, c, g, or t
atattgagtagattaaattcatctgaatataatcacacccacttataacacagctaaaacaggtctaaacatacttaataacaacaacacgtgcaagtcattaaaaattctgagaaagcgaaaccttagtcaaataaagaaatatatctctcaaatctataccatcccatttatgaatttcgcaccaaataggtacctaatcnnnnnnnnnnnnnnnnnnaataatacattaataaaataggtattctaaaatcagtctcctttaactgattaataaaaggtcncatttttttggtccacgaataattaacaatccgcatatgaatttcgcancanataacattcganatactatannnnnnnnnnnnnnnnnnnnnnnngcagtaacaggtattttggaatcagtctccttttaaaagactctaaagaac

SEQ ID NO: 13782 - DNA, 243 bp, Diabrotica virgifera
tgaccacgacgtctgctaaccctaaattgtaaatgatttaatgcaaatgaaacaccaaatagaattcaaaaataaagataaataaaaaactaatgatttggatttattttaaacagcaacattgaagaccaatcaaaatctcgatcttctgaaatatgacataattgtcctacattcgttaatggactcagatatcaaatgtaggacaattatgtcatatttcaaaggataaatattttgatt

SEQ ID NO: 13783 - DNA, 165 bp, Diabrotica virgifera
aactgtctctgtaccttcctatcaatgcgttattcactttacttacacgtatgttactctgtcatacttctgcttcatgcaccacttaaggtgcggcgcattacacgtttcattcaatcattgagggcatccttcatcttgctgttcactcattgaatctaccct

SEQ ID NO: 13784 - DNA, 237 bp, Diabrotica virgifera
  misc_feature (2)..(2): n is a, c, g, or t
  misc_feature (5)..(6): n is a, c, g, or t
  misc_feature (8)..(8): n is a, c, g, or t
cnggnncngccggcagggctgtcagccgggcggccgcgcggccgggtcgtgccgtccgtccccctgcacgccacttcatagccctggggggggggctgcgaacttcagttcgaagaacggggttttcccccgtccttactggtaacgccctgtcgttactacaccctgagcgccttgcctcacatccccctttctccagctggcttactcgccaacatgacctcacctatcgccctt

SEQ ID NO: 13785 - DNA, 421 bp, Diabrotica virgifera
  misc_feature (6)..(27): n is a, c, g, or t
cacaannnnnnnnnnnnnnnnnnnnnnaatttacatgtatgcacgtttagtaatcagaattttaactattctcatctaaatttcatttgatttattcttgtcatctgctactctttctgacgattagaacggcagatggcacacgttggtttttcttcttgatgattgatatgtgtctctattttatagttttttggaaagaaaccacttttctccctccgggagtttcaacaaccctcaaatcgccggcgatacaacaacgaggaccatgtcatcagggctgcaaccacataaccaagactgcaacgaccaacatccgtaggcctggtggaatacaacacctacaaccccagagcccgttgcagaaccagcagcagtaccatacgacatcaagaagataccatcagttgccaaaagccat

SEQ ID NO: 13786 - DNA, 321 bp, Diabrotica virgifera
  misc_feature (25)..(61): n is a, c, g, or t
  misc_feature (96)..(121): n is a, c, g, or t
acactactaatatactttttagtannnnnnnnnnnnnnnnnnnnnnnnnnnnnnnnnnnnnctactgcgagagaatatttgacttttagaaatgannnnnnnnnnnnnnnnnnnnnnnnnnacagggattactaactcctaattacatatttactactttcgaatttagaagagctacacaattaaaatttttaatgtaacataaatcctttaaataacttttttgtaatgaactgttaatcgtttttacataaaaccaatttctgaagaaataaattgaatttattcactaacaatatatttacaattcaatacttttac

SEQ ID NO: 13787 - DNA, 429 bp, Diabrotica virgifera
accacgcatccgattaatttatacaacgaaggtgatgcaactaacttcaacaaagtcttggaaaattgtactctggataagtgttggagggagtgcaaggagtcttcgaattatttaagtagaagagaagcagtgaaagaattcaacaggttgaacaaatacaagaaacgtggtctaaacatcgtcccaaccaaatatggcatcgcttttggtgtcacttttctcaaccaagctggcgctctcgtactgatttactccgatggatctgtcttaatatcacatggtggtatcgagatgggccaaagactctacacgaaaatgatccaagttgccagtaaagctctaggaatcccggttgaaaagattcatacaatggaatcaagtactgacaaggttcctaatacctcaaccactgctgcaagtactgga

SEQ ID NO: 13788 - DNA, 374 bp, Diabrotica virgifera
  misc_feature (244)..(293): n is a, c, g, or t
acgacgtaattttgtgtattcctgtattatcaagtaagagctgatttctgagcgatcgagtgtcgtcttaacttctttgagaatcacttctctaacatctagtcatgtttgtgtaacaacagaacataggtataccgggattcttagataggaatttttacttgatctaatggcatatactggaaattgatgatacatgaatgacaaagcccagtagcgtgctagaattagctcgtagagcgtnnnnnnnnnnnnnnnnnnnnnnnnnnnnnnnnnnnnnnnnnnnnnnnnnngcctacatagcttgacttatcgaactatttaattggtccagacaattaatagttagatctagtgcagaacgagcttgcgca

SEQ ID NO: 13789 - DNA, 325 bp, Diabrotica virgifera
  misc_feature (31)..(31): n is a, c, g, or t
atgatcgacattggatggatgtcaatgtcangagtgctcctgcacatcctatattagattcattggcatatctaacgaatagtaggtttgcagtgtctaatatgctcttaacatcatgccattattgtacttatttctttttgtcatccacgttattacattgtgcaaatggtactgaaacgactgtcagttgttttacataattacagtttttttattcattgatcatgcaagatcttttacatttgcaatttgttttaaatgtgtatcaagttgtcaatggttaccatcacttagttaactgtaaaaataaattacaaattta

SEQ ID NO: 13790 - DNA, 404 bp, Diabrotica virgifera
gagaaatactgggaaaatacctgcatcacaactgcgcgacttactacaaaactggggaaaaagcctgtcaccaaaagaagtatataggatttttagagaagctaatgttacagctaatagcatggtgcgatatgaagatttcgtaaagatttcctgtgctccagttccagattagtattagatgacagcattgtcagcatacctatatatttagtctactgggcttaaacgagctgcaataatttttgcttacgagtattcgcacacattacatttttatgaaattaatgtacctacgtaagttgttaaataagagcatagtccttcaatttaatcatcttccattgtgtaaccttggcttttttgatattatacaatctaattaacacttatgaatttactac

SEQ ID NO: 13791 - DNA, 204 bp, Diabrotica virgifera
  misc_feature (116)..(116): n is a, c, g, or t
  misc_feature (176)..(176): n is a, c, g, or t
tctcgtccgcctgtgcgtcctttccgcttcctgttttctcgctctggttcgtgttcctgctgccgtctcttcgtggcgcgctttttctggccgggggctgtttgtctgccgggtcntcgtccccggtcttctctggcccctgcttctcgctccgcttcctggtttctcgcggtctncgtctggggtgttgtgtgtctccgtcct

SEQ ID NO: 13792 - DNA, 387 bp, Diabrotica virgifera
  misc_feature (219)..(238): n is a, c, g, or t
taaaatgagtcagtatatttccgtttgctcaggaaacaaaatacgcattttttttctattttattgattattacacgtcgacagaactatctgaaaccgccaaggtcagatcgaaaactttcgttacgcgacgttgtcagattaatcgaagtttaaaggttttccggtttttatttgttacctgtttcacagtaaaattgataacaattctataacgcnnnnnnnnnnnnnnnnnnnnctaagtaacagtgtatattggttaaattccttttgtcaattatttcagttaaatacaaataaggagtcttaattgtttattaatgactgtgtgacaggtacttcttttaggacaacagactcagtaaaacaggttaaaataaaataaat

SEQ ID NO: 13793 - DNA, 56 bp, Diabrotica virgifera
  misc_feature (13)..(51): n is a, c, g, or t
acgaaataagtcnnnnnnnnnnnnnnnnnnnnnnnnnnnnnnnnnnnnnnngggcg

SEQ ID NO: 13794 - DNA, 380 bp, Diabrotica virgifera
attcggtaaaattaactaacgaatttcgtgcaaaaatggaggaaacgatttgtgataaatataatacgagtctagttctttatagatataataataatgctttttatttcgagcaaaatgtaaaaataatccaaatggttacaaaatatttattgaagccttctagaaagcgtcacatgttagttaattggtgtttgtccgagattaacgaaaaaaactcaataagcaaagaaataaatttccaagaattaaaaatacttgtcatacaattctgtactcacctattggcagcaggagttctgaagcagttacctgataaagaagtcccgatgtataatatatttaagcctgacttaatatacttctggacgcacactgaa

SEQ ID NO: 13795 - DNA, 440 bp, Diabrotica virgifera
  misc_feature (13)..(436): n is a, c, g, or t
acgattaatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtt

SEQ ID NO: 13796 - DNA, 276 bp, Diabrotica virgifera
acaattttcgacctgatactatggcaatatttcctatggtaactgttggtccagatcccagacttgatgttgtgatgtctcttatgtagtacggattatatccaaacgtttgtttccacaatgacactagaaaggtactagcatcacaaggcatagccgcacttatgcacaaaacttccgtcaactgaagtaaccaggatcaaggatttccatactcaatcgttgtatttggagaattgatcagtactagagctgtaacttgcaaacagatgacta

SEQ ID NO: 13797 - DNA, 55 bp, Diabrotica virgifera
aggccggcccctctatagggtcgtttcttttcttctcatgcatcatccttcttca

SEQ ID NO: 13798 - DNA, 156 bp, Diabrotica virgifera
  misc_feature (16)..(16): n is a, c, g, or t
  misc_feature (94)..(94): n is a, c, g, or t
caatggaaagatatangtgtgatatgtcaagtagtggacagataagccaaccactggatgtggttttgagggatttttgcagtggggtttgtanggtgctatgccgcgctgggtttgggatttgaaataaaacgaagggagatgtgccacgctctt

SEQ ID NO: 13799 - DNA, 411 bp, Diabrotica virgifera
taagcagaatcttaagtagctgttgaaatactggccctaagtaacggtatctttctttttataaatattttctctatacaaaggcatatcttttcagaacttttaattcgattaaaatttgttctttctgaaccaaaaattaaatatgtatgtagtattttatttcttccgagcattcacggataagtaagtacattgatgactttattcagtaataattacaacacaattgtctaaaaatagattattgtcattatatttactttggtcttttacgattttagcgtacagtgtatttttcagagaaataaaatttcagtttattattaatgtaaatcgtaaaaaataattttaatcaatttaactcctacataacaacaaaaataatgtctgaatccttttattattcat

SEQ ID NO: 13800 - DNA, 338 bp, Diabrotica virgifera
aatcggtacgtattttgcaaatttctatgtcaacaatgctctagacggagctactctaactaattgctcccactttcaatatgtatccagattgagtcttagagtcatctggatcagtatcaaaacttgcatcgatataaccctttacgatgaaccttttgtcacctccataatcgagaaacatatccttattccactaaggataattttgacctatgtccagtgatctactcctagatcactattgtactccctttgccaaacatagggcagggtatacaataggtctggtacacagcatgtcatactttatagaacctatggctgaggcataggcc

SEQ ID NO: 13801 - DNA, 323 bp, Diabrotica virgifera
atctaaattcgttgtaatgtctccaaagaatctccttcgtcacaaggactgcaaatcagtctatctgaattcgatgatcttgctggtcaccctgaatttgataagcaagggacacgcttcaagcgtctaataaaagaccggaatgaccataaggaccttgaggaaggaatcagacgtctagttctttgttctggaaaggtgtactatgaattggatgaagaaagaaataagtcggattccaatgatgttgcgatatgtagagttgagcagctctgtccattcccctacgacctcattcagcgtgagctgaagagatatccaaa

SEQ ID NO: 13802 - DNA, 398 bp, Diabrotica virgifera
  misc_feature (195)..(214): n is a, c, g, or t
  misc_feature (308)..(330): n is a, c, g, or t
  misc_feature (388)..(388): n is a, c, g, or t
acccacgcgtccgcttttatatccaggacatcctttgggtttccatattcttgtcaggcaagctttttaagaaaaggcattcctgaggattcgatcccaactattacaacaaatcactaaatctgtatgatacagttttcaagagatggcgacggtttagtataaaatagtaaccattttgcttatgaattatcnnnnnnnnnnnnnnnnnnnnctatcgtagaacaggattataattatagctcgtataaacattcacagtgctgcattggcgttgatagaagatatcctagaatattataaaaacnnnnnnnnnnnnnnnnnnnnnnnatgtatatataacctcaaaccttaattgcccaaatattaattaacttgggaacctctnacagtattac

SEQ ID NO: 13803 - DNA, 169 bp, Diabrotica virgifera
aaacaatacctgtgctatcattgtaaattctactaactatacaattaatttaataatagtggtgacccgccatgaaaatgaaattaattgtatagttagtagaatttaggttaccgtttttcttttaatataaaagctagactctattgagcctaggaagtatttgaat

SEQ ID NO: 13804 - DNA, 355 bp, Diabrotica virgifera
  misc_feature (17)..(41): n is a, c, g, or t
aaacacacttctgctannnnnnnnnnnnnnnnnnnnnnnnntttacaatatgtgtcaaccaaagatttttggcggcttctcagcgaaaaccttcataaccataaaaattgccttggtcaaactatagaccttctatcacagagccaaatactaactcatatcgtccatggtccataccagaattcttatccttcgcgaacatcgtctctataagacagcatcactcgtttaaatcaggtatatcacctctgactcttaggcaacatcaagacgatcggattttatcactggtagaccctcataatctaccaatgacccatggagaacaacatgactataggatagcaccactggt

SEQ ID NO: 13805 - DNA, 370 bp, Diabrotica virgifera
ctcgcgggtcgacacacgcctctatactgactctgtctaaaatttttactcacttcgcgatgtgaacaaagtgaattacccacgtcgcggagtgagcattttattcggacattggccgaagcgaaatacccagaacgcgttgtgaataaacgaaagtactcaattgccgaaataaacacgttcaacggagattgagcaaaaccataatacccataacccgacgtgggtaatatattttacacacgtcgggttgtatgtatttgaaatttgcgcaaactccgaaaagcttccaaacacaaacataccctacgttaatttcataataacaagtaaaataaaatcaaattttccttgaaattcaatttatttt

SEQ ID NO: 13806 - DNA, 413 bp, Diabrotica virgifera
  misc_feature (78)..(98): n is a, c, g, or t
  misc_feature (131)..(149): n is a, c, g, or t
  misc_feature (213)..(230): n is a, c, g, or t
taaatatgttatgaaaatcacgaatgaattgaaccccaaaggcatttttaattataaatgtacataattcattataannnnnnnnnnnnnnnnnnnnnccgaaaatacctgtagacgcattatcttgtttnnnnnnnnnnnnnnnnnnngtttatatctctattttagaaatgtattttcttttttacatattttttaaagttttaaccatcnnnnnnnnnnnnnnnnnntccactatatagacttattttttctatcgattttaaagacttaacttatctcgagtgtttctttaatatacactgcgaggcataagttaggtatgtagaaaattatgcttgattttttcgtgaacagatcaacggatttcgctaagtttttttattattttagatttttctttggtatttaca

SEQ ID NO: 13807 - DNA, 152 bp, Diabrotica virgifera
aatgtttgttcgtagcgcaattgtctaacgttaagcactagatctgattcacggacagtgcagttgcggggtaacaagtgtcattcgggcaacggggctgaccgttgccgagctgtttggatgcaggggcacggccttcgggcctccctttg

SEQ ID NO: 13808 - DNA, 437 bp, Diabrotica virgifera
  misc_feature (287)..(305): n is a, c, g, or t
cgttgaaaaaaattgcattaataaaacaataaccagaaaaccaaaaatttaacaacaggtaagggacaaaaaatttgcatcggttgataagaaaataggactcaagtataagtaaataagtgtcatattgttgaaagttgtgtgttatggaaggtgattcgaaatcggaatataaaaacaattttgagtagaactcttctttttaagtttaaagaaaccaagcctggagcagggattcgatcctgagcaagcagtacagatcgataagtcactagatatacgatatnnnnnnnnnnnnnnnnnnntaacctgcattgatcggggtaagatttcgtttgtgagtccttgtatccaggactcccacataataagcactttgctgatagagagcccatatagcgcatcagagtgctatcggaggggaagtggatagtatg

SEQ ID NO: 13809 - DNA, 418 bp, Diabrotica virgifera
aagatctagttattgaaaagggaacagcagtttacattccttactttgctatgtttagggatcccaaatatttcccaaatcccctgaagtttaatccagaaagatttgctgataatactttcaattcagatggttacacctttttcccattcggagagggaccaagagcatgcataggtaaacgcctaggactcctagctattgctgcatgtgtctcaaatatcgtattaaaatttaatattgaaaaatgtgaagcaactcctgatgcaattgaatttgaacccaaatcgttggctctgcagtcaaaggatggactaaagataaaactaatagccagagaataacatattacaaatatacgtaattaattttaacacaaaatgtcaaagctaatatattgttatgggtctaccccaaa

SEQ ID NO: 13810 - DNA, 211 bp, Diabrotica virgifera
  misc_feature (8)..(27): n is a, c, g, or t
  misc_feature (52)..(87): n is a, c, g, or t
  misc_feature (109)..(136): n is a, c, g, or t
  misc_feature (150)..(207): n is a, c, g, or t
gaaaagtnnnnnnnnnnnnnnnnnnnngataggtaaataataatgggagagnnnnnnnnnnnnnnnnnnnnnnnnnnnnnnnnnnnnggaacctgggtatcaaggaatnnnnnnnnnnnnnnnnnnnnnnnnnnnncgaattaaagagcnnnnnnnnnnnnnnnnnnnnnnnnnnnnnnnnnnnnnnnnnnnnnnnnnnnnnnnnnnattc

SEQ ID NO: 13811 - DNA, 435 bp, Diabrotica virgifera
actgaaacaaaacgaaaacactacttgttttcgttaagcggactacattgtattcgaattttgtttttgttttcggtccttttccattgaccgtcacgaggaagtcaaattacagttttctcttcaataaccaaccaacacctttagagaagaagactttctctttttagatgtgtttggtcgataccgaattcctttggaaaagggtatatttccaactcattgcattttaaccaaaccacttgggtgttaaattatgtcctgtgccagtgttcttcattttttatggttcctttttttacgctgacgttatgaaattatgtttttaattttctttcaatttctatccagttggtgtcaaacaattcgacaatttctttgtacgaatcctttttttaatcaggctagtaaagcgatattaataaacacaacatg

SEQ ID NO: 13812 - DNA, 436 bp, Diabrotica virgifera
ctctaatccaatacagatgaagtgtttatgttttatttttatatgtgttatattggggatatcccaaaatcagtatggagttcatggtgaatgccgcccagtaacaggaagagttacaagaagcgcttttgttgaaatgggtctacattttgttgaacttctcaagttaagaataatatctaactgcgttgcaaatggcttttatattgaggatgagttaaaggaatcatttaaagatttgggagtatgtttaaacaaagaaaaattgtatgtatctccaagagaagattttcttaagaatcttaaagaatgcaacgttgaaccaattaaattagtaaaatcatgtttaacaagggaacaaagttattttcccgatttcctgtataatatggctaaagctcaaattgacttaatatacgataatcgtgacgttata

SEQ ID NO: 13813 - DNA, 442 bp, Diabrotica virgifera
taatttcaaacatggttggtggaaaaccatgcaaggtaaaggacggcaccaggttaatccagaaaacccaaatttggcccaaaaccggcaacaattggaagcccaacccttcgaaccggaattaaaggttgttgcaacattcggagagctactgaacagcgagttttacactcaaaatgaaaatttactaacacctttaataaactactttgaggatgtatggataggcagattggatcgacgacaacaaagaagaccgccaatgtttccaaggaatctttggaattgcttcgaatttatagaggaagatctaccgcgtactaataatgctgtcgaaggttggcacaacagcttcccctcgatattaaatgcagcacacccaaatctatggaagtttattacggggctaaagaaagaagagagtttaaatcgattaaaagtg

SEQ ID NO: 13814 - DNA, 361 bp, Diabrotica virgifera
  misc_feature (226)..(246): n is a, c, g, or t
aagtccaagacaaatgatatgacaagaaccatatgcagaatgggatttaaccactgtcttacaccatcatatatatttaaacttaatatagctgatagccctcaatgtatttgtggtcagtttggtaacctacaacacaaaattttgacctgttctcttatttctaataaagttaatatgtttttaaattcactgtattctttgactgatgtaaaccatcccattnnnnnnnnnnnnnnnnnnnnnttagaaaataatgagttggtatatcgactattgtataaacatattttagatattaaacttaagttgtaattgtaaaatatagtttaagtatttcttgtaaattgttatataaaaa

SEQ ID NO: 13815 - DNA, 438 bp, Diabrotica virgifera
  misc_feature (107)..(128): n is a, c, g, or t
  misc_feature (176)..(207): n is a, c, g, or t
  misc_feature (209)..(222): n is a, c, g, or t
  misc_feature (224)..(240): n is a, c, g, or t
  misc_feature (262)..(299): n is a, c, g, or t
  misc_feature (310)..(336): n is a, c, g, or t
  misc_feature (340)..(360): n is a, c, g, or t
  misc_feature (375)..(398): n is a, c, g, or t
aatttatattattaaatcaccctttaacttgtggtttaatattattaatacaaacaattttcacatcagttattacaggattaataaattataattactgattttcnnnnnnnnnnnnnnnnnnnnnngtatgaggaatattaattctttttatttatataaccagaattgcttcnnnnnnnnnnnnnnnnnnnnnnnnnnnnnnnncnnnnnnnnnnnnnngnnnnnnnnnnnnnnnnnctatattaagatttattttagnnnnnnnnnnnnnnnnnnnnnnnnnnnnnnnnnnnnnnatgaataaccnnnnnnnnnnnnnnnnnnnnnnnnnnncttnnnnnnnnnnnnnnnnnnnnncatataaattaatcnnnnnnnnnnnnnnnnnnnnnnnncttatcactttaattgcagtagtgaaaattacaaaatttt

SEQ ID NO: 13816 - DNA, 442 bp, Diabrotica virgifera
acccacgcgtccgtacggacataccgaaaataacatgaatgtgcgcggtggaagtcgcggtttaggtttacatcgatggcataccgaagagaacataccgaagatacctttctttcagtgttctttgctgtttctgtggtgactgacacgtgttccgggagagttagctttttttacattataagattatgggtcgcccatgtttctccaactgtcatcaatacgactaacttcacgcgtaactttgatacgagaattatgaaaaaaaatttgcattgaaagccagatcccgtaattttttaagcgttataaacatcatggttccgaggtgttgttttgtctaatgatgaaaataattatgagatttcatctgtagattgtggaaatctaattacagcgactagggcaaatataagaagttttcctgctgctctgaaaaaca

SEQ ID NO: 13817 - DNA, 124 bp, Diabrotica virgifera
atcagattccaactgttcatcgttgcctctgcctcaatgtaggtgaattctgcagggctgcgtgacttccattgttggatcaatgtttttgcatggtataccttgtcgtgcaagtttattcaag

SEQ ID NO: 13818 - DNA, 284 bp, Diabrotica virgifera
  misc_feature (3)..(17): n is a, c, g, or t
  misc_feature (19)..(31): n is a, c, g, or t
  misc_feature (39)..(77): n is a, c, g, or t
  misc_feature (92)..(127): n is a, c, g, or t
  misc_feature (145)..(163): n is a, c, g, or t
  misc_feature (165)..(208): n is a, c, g, or t
  misc_feature (237)..(275): n is a, c, g, or t
ggnnnnnnnnnnnnnnngnnnnnnnnnnnnnaatggtgnnnnnnnnnnnnnnnnnnnnnnnnnnnnnnnnnnnnnnnggtacctggtgtacnnnnnnnnnnnnnnnnnnnnnnnnnnnnnnnnnnnncccaaatttaaaagaccnnnnnnnnnnnnnnnnnnngnnnnnnnnnnnnnnnnnnnnnnnnnnnnnnnnnnnnnnnnnnnncccgttttaaaagtacacctaatttttgnnnnnnnnnnnnnnnnnnnnnnnnnnnnnnnnnnnnnnngattaaata

SEQ ID NO: 13819 - DNA, 384 bp, Diabrotica virgifera
cggacgcgtgggcgcaaatttagctgtgttgtagttgttggttgtgttatcagttattgtattgaacaatacaatttcttatattgctgatttcaactggaagcttgctcattgcagtggatggttacgatggctactatgaccgtcgcttcgaagattctcgtgacatgtacgaacgtcgttattccggaatgccgtctagccgcgacgtgggcatgcgcggcgctgcaagcgcgcgtgacttcatgccgcctccactgcccccacgcagagaacctctgcctccaatgccgtccatcgggttgagaggaggaccttccagcggtatgggaggcagtctaagagacagcggtttttcgagaagcgcaagtgattatggtatgt

SEQ ID NO: 13820 - DNA, 414 bp, Diabrotica virgifera
  misc_feature (6)..(405): n is a, c, g, or t
aaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatatat

SEQ ID NO: 13821 - DNA, 206 bp, Diabrotica virgifera
cttcttgaagcctgaaaatattagagacattaataaaagaaaaccagatcatccagagtatgattgtcgaactttgtatgtccccgagaagtatttaactaccttaacacgggttatgaaacagtggtgggagttaaagagtcgacacatggatacagttttgtttttcaaagttggaaaattttaggaactttaccacatggatg

SEQ ID NO: 13822 - DNA, 186 bp, Diabrotica virgifera
  misc_feature (7)..(51): n is a, c, g, or t
  misc_feature (53)..(65): n is a, c, g, or t
  misc_feature (67)..(80): n is a, c, g, or t
  misc_feature (83)..(168): n is a, c, g, or t
gatagcnnnnnnnnnnnnnnnnnnnnnnnnnnnnnnnnnnnnnnnnnnnnngnnnnnnnnnnnnncnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnngagattataataataatt

SEQ ID NO: 13823 - DNA, 442 bp, Diabrotica virgifera
  misc_feature (402)..(402): n is a, c, g, or t
ccacgcgtccggggatttccaatttactgcattgcatactatagtgatagttcaatagttgcactgcaaaatactcaaagaacaagtaaaatgtgaagtgcttttggtatgaaaaatagtaccttttgtatattttcctttattgatagtctgttttaaataaacatgttatcgttcttacaagatctggattttgttgctgtaggcgaaggcatccatacgttcgcagtgtcatttttgttctttagtttatattttaataaaggatcgctgggtgtttcagctaagacccagatactgttcctagtgtcaataatagccaagagctggtatgtcattcaactggggcattacgagccaatctactggtggcttcagttttcgcatatagcattcacctgnggcactcttcttttctatttatatcgaggactgctaaccg

SEQ ID NO: 13824 - DNA, 431 bp, Diabrotica virgifera
  misc_feature (77)..(92): n is a, c, g, or t
  misc_feature (98)..(118): n is a, c, g, or t
  misc_feature (136)..(160): n is a, c, g, or t
  misc_feature (212)..(243): n is a, c, g, or t
  misc_feature (416)..(416): n is a, c, g, or t
cccacgcgtccgcaagtgcttccctatcgaacttaaaacgttcgtaataaaagtgttattatacattataatatgannnnnnnnnnnnnnnnaaaacnnnnnnnnnnnnnnnnnnnnnttagttaactaaattacnnnnnnnnnnnnnnnnnnnnnnnnnattttcaaaagtgttgaaagcttcgagatgatgaaaagaactggttattacnnnnnnnnnnnnnnnnnnnnnnnnnnnnnnnngatgcgattaagacaataattcgtcaagactagatgcgataagactgtgctgtagttttcaaatagctaattctatactcttgctaataagatgggccattttcagaaggatggactattagctatggtgtttgtattttatattgatttaattataagatttggaacaacanattcaagcaattttt

SEQ ID NO: 13825 - DNA, 328 bp, Diabrotica virgifera
atcagcacacttccaatctagcgttttgtcagttatcagtactcgccaaactgatgatgcagtcattaaagctggacgacgacatgttaatgacgatcttgacgatttatttataactattgatgagaacgcaaaatctgcacttcctcgtacaccaacaagtttggccaggttcaatttagtcacaagttcatccgtcacggcattgatgtatgatcctaatgatgtcagcctttccaattctcaaaaattcactgttaccaactactgaacatctgacacatcagttgacgtgacatacactgacagtcaagatcgttccaatgat

SEQ ID NO: 13826 - DNA, 355 bp, Diabrotica virgifera
  misc_feature (34)..(67): n is a, c, g, or t
cccacgcgtccgcagtttgttatttgtgaatctnnnnnnnnnnnnnnnnnnnnnnnnnnnnnnnnnntggaagttcaacagatagacattagattagattttaattctatgaagatagatttagtaaaagcaattcatgcttgtgcacaaaggggcttatatcattcggtgaagtggttatccgaaataaatttctctttaaaacacatacaactatccaaagaagacactgtggacatatcagacgatctagatgaagaagtagatgcctatttagtagctaagtcaaattttgatctgaaagaatacgatagatgttctcagttttggttaagactgtatgaaaacccaaatc

SEQ ID NO: 13827 - DNA, 162 bp, Diabrotica virgifera
  misc_feature (71)..(114): n is a, c, g, or t
  misc_feature (140)..(160): n is a, c, g, or t
aaccgatctaagtgtggtgtgtttcttatataattccaatgaacacataagaaaaggtgtacttatatgtnnnnnnnnnnnnnnnnnnnnnnnnnnnnnnnnnnnnnnnnnnnngctttaccatcacgcgactcataagnnnnnnnnnnnnnnnnnnnnnat

SEQ ID NO: 13828 - DNA, 168 bp, Diabrotica virgifera
cccacgcgtccggaaagtcgatgctggcttgacagcttcgcaacaaaatcttttggatagcaactcgatctccgccagacagaaccagatcaaccaacaatatgacaggcttctacagttggccaacgaacgtcgcaccaaactcgaagagacagtcaaggccaaggt

SEQ ID NO: 13829 - DNA, 149 bp, Diabrotica virgifera
  misc_feature (74)..(97): n is a, c, g, or t
tttactgtctagtgagcagtgatcaaccacaaaagacaacatgtgtgacgacgatgttgcggctcttgtcgttnnnnnnnnnnnnnnnnnnnnnnnncctggattcgccggaaatgacgcaccccttgccgtcttcccctcaaccgtcg

SEQ ID NO: 13830 - DNA, 327 bp, Diabrotica virgifera
  misc_feature (24)..(46): n is a, c, g, or t
ccaagcgtccgatcgcgagcggtnnnnnnnnnnnnnnnnnnnnnnnttgctctatcttatagtttattatacatattaataacatctttagaatatacttattaataattaaacattagactacatacttttctagtaattggtaataatcctctatcacatatcatttattgaaattgcattagatccgcatctaaactaattctactccaatcgagcaacgataacgtattgtatatagaagttggtgttttttaaaataatagttgattaaaaagtgcagataagaatacatataatctaatggtaactatactatttaacatc

SEQ ID NO: 13831 - DNA, 113 bp, Diabrotica virgifera
gtcattggtgtgggttaaggcaaccgaattataaaattaacctttaaattagaaaattaattccaaatggcttcacaaaacctttgtatggcggtccgcaacttcagcaccat

SEQ ID NO: 13832 - DNA, 406 bp, Diabrotica virgifera
tttcaaacggtcataatgtactaaaaaagcaatttaaaaccgtacaaaatgctcactatattatctttagatcaatgcatcttacttatttataacttagttacgtataataattcttatacaaacaatatttgttgatcaagttgggggaaataattcgcaaaaaatttatcaacacgcggcaaaagtgacgattattgaagagtgaaatttttaattgaagtaaattgatctggtgtgtttggattcgcagacaattgactggcagacaattatttattgtatttattgattaatttatttattgtacatttctgcactgccaaatactacgtttcttgcaagaggttgtacgtcttggtgatgaaaatggaagaattagttaaattcatcggtacctcggata

SEQ ID NO: 13833 - DNA, 276 bp, Diabrotica virgifera
gagcattgatcgatacaagtggaatcgatcacaatcaaaatatagacaatgtgaattccaaagacaatagcgatattgcactcgacaaattacacaacgaaaaaagtacagatggcaaagcagagatacaaggaacgaatcgagcggcagaggacagaacagaagaccccaattaagcggaccgaaaagataatggtgcaaattcagacggtgaggatttagatgaggaataagaagaggccattgacgaagaggaagacacgggcgaagaagacg

SEQ ID NO: 13834 - DNA, 381 bp, Diabrotica virgifera
ttttatgagggagaaacctcgaatcacacatatgtaaggataaatcatacatgaaaaaacagagactttgacagatcctagatgcgcaagcatgccagggatgatcaccacatacagtggaaggatgcatcaatgatcaagaaagaaacagagagcaaaaaatcagtaacagaaacaagcctaatcttacctaacgaagaagaatccatcaacagggtttagcgggctctggttgccaaatgctaaagtcagcaatacgataatatgcaccaacattaatgaataaacaggtcagagacacaccgtctgcaattggctgcatgtgcacacaggggtcacaatttgataatacgagggtacatcgccctcaaaatttcaact

SEQ ID NO: 13835 - DNA, 408 bp, Diabrotica virgifera
  misc_feature (292)..(314): n is a, c, g, or t
caagaaacactgcatttaacctcatcttttaagttggattacaccaaagaaatgacaggtaatggttcctttctggcagatttaatcaattatacaactttagaggaaaacaatgacaattttggtgatgacagtgacagctatgaagacgtctataccttttacggacccttcagcaaggtggttaacatttttaaagatataattttaagtttattcatacttgttcttgactgtattctactgtatctattttgttcctttagtaaaattcgaaaaaaatacaacgtcnnnnnnnnnnnnnnnnnnnnnnnggatgcatttgcacagataaagtccatcattgattttttgtttatttatactttatctgtaaatcaatactacaagtttagctatgtaattttt

SEQ ID NO: 13836 - DNA, 231 bp, Diabrotica virgifera
gcaatgttgaaaggaaccctactcgccttggctctaggtggtatagccgccattgcaagaaaagccttgatgaccggtctgatctctcatcttctttctgttataattggactgaaagctattacccacaaccaatgtagctaccacgtacgagataatatccaagcctgtctaaatccactctaggccacactcaataggactcgacgaacaatccaattatggacattc

SEQ ID NO: 13837 - DNA, 194 bp, Diabrotica virgifera
ccgggcgttaatacatgaacatcaccagcttgacaaatgacattggcatgaactgtcagcaggtcagtcaggaaacactaccgcgttaagcaaaaaatgaccagaaaactgttccacaaaaaaaagggtctaaacgcattattagagaattccacccaggcattataaaaacttcctcacaatcaccaagattt

SEQ ID NO: 13838 - DNA, 298 bp, Diabrotica virgifera
  misc_feature (150)..(150): n is a, c, g, or t
  misc_feature (250)..(266): n is a, c, g, or t
agccaagcgtccgtataggaataattcaattcatattgaacattaacatttctttaaaataatgggttaagtgaacattttataagtagtggagatagtaacgacattatattctgtaatttatgtcgaatttaaggacatatcattganacaattataggataatccacactaagatgtcaacaatggatgactcagctgataaggaagctagtgaagtcttacacacattgttagcagtacagagaannnnnnnnnnnnnnnnngttgtagaaaaccatacatatcaaacttcgac

SEQ ID NO: 13839 - DNA, 401 bp, Diabrotica virgifera
  misc_feature (54)..(73): n is a, c, g, or t
  misc_feature (177)..(189): n is a, c, g, or t
  misc_feature (191)..(203): n is a, c, g, or t
  misc_feature (316)..(316): n is a, c, g, or t
  misc_feature (337)..(337): n is a, c, g, or t
acaaggtttattgacccaacaacaatatttacctcaacaatatctatctggggnnnnnnnnnnnnnnnnnnnnatgaacactaaccaaatcttgagccaaatctacagacaacaacttggacaatctccattgaaccgttatttggtaaacatgagacttgtaaacggagagcaagnnnnnnnnnnnnntnnnnnnnnnnnnnacgttcaacttctcgaaaaactcttcgccaaacaagaattgatcaaccaagaattgactgaaatcaccgaaagaagacaacaagtcactgaagatgttcactatcagcaacanatgattaacgaacagatcganaaactgattgaacaattagcttaccatcaaaacctcattacacgtgaagttgaacaatacattg

SEQ ID NO: 13840 - DNA, 380 bp, Diabrotica virgifera
acccacgagtccggcagttcgaagtccaatgcttggccatttaaactcatctctcgatggactttcaactattagagcatttaaagccgaagataccattagcacagaatttgatagacatcaagatttatatacatctgcaaactatgcttcagaatgctgccagagggcttttgggtactacttggatgtttgttgtactagatttataggtgctattattgcagcgttcatcattgttggaaaagaaactgctgttggggatgttggtttagcaataacacaagcgtttatgttgaatggcattgcccactacgccattacgctttgggcagatattgagaatatcatgacatcggtagaatggattttggaatacg

SEQ ID NO: 13841 - DNA, 256 bp, Diabrotica virgifera
  misc_feature (233)..(250): n is a, c, g, or t
aggtttttagttattttaaatgcataccctctattctagcattggtaaacatcacttttatttaatgatcactaattagtatggtgagaggatattttatttttacgcacgtcacgctttatttttcgtaccttgtgtatcacggattcttacttaatagttacacctttatgatctttcgacttcaatcaaggtactccattaacacttgtattgtactgtagctatttccnnnnnnnnnnnnnnnnnngattgt

SEQ ID NO: 13842 - DNA, 385 bp, Diabrotica virgifera
  misc_feature (76)..(76): n is a, c, g, or t
agtcacaagtccggtttgaaacttgagacacataatgtcttcagatagttttaataatcattcagattgaaattanatgtataaatcaaacggtttagatacagttacgcgaacttggattagttgcaaagaaatatcaattcggtactacaccctggactacacattttaccggtagtttagaagcacggtgaccaggacgttatcagttggtcataattttaaatgcagtgtgttccagatatatttgattgtgcctattcgttttgcaaatatttagttgccactttatagccgcagagaaagacagagttcattgataatagcggtcatatagtggtactgggaatgttttgattgtatattgtatgtacttatgataaat

SEQ ID NO: 13843 - DNA, 372 bp, Diabrotica virgifera
cccacgcgtccggaaaaacctgggaaaagcggcatggaaagttttattgaatatcttcagtttgttaaaaaatctctggagaatctagacagctttggggaaattcacattgtacttggaaacgaatcctgtgatatagactccagtgtttcagctacagctttagcatatcttttacatatcagtagacctaagcacatttccaaagaagcactggtagttgctgtacaaaatgttccagctgaaaactttttatttagaacagacaactgttttttgtatagagaaatccagctacctctggattatttagtatgtagggatcagatagactttgattatttagtgaaatcaaaaaaagtgactactact

SEQ ID NO: 13844 - DNA, 328 bp, Diabrotica virgifera
acccacaagtccgcagcaactagcaatggtcctgtcagcttacctcaggtctctccagcaggccaaaattctcaaactaatcaatttaatgatatgcttaaacaaaaccgaataccaccatcaccatctagctttgttcaacatacacaaagcatgtcacaatcaaatcaacaaaatgttgctcaaaatagtacttctcgaatacctaccacttcatcagattccgttgcaacacctctggctaccagtgctggtcctaagtctgtcagttcttcaaagggtgcatcaccagctcctgcaactccagtacaaccttctcatcagctat

SEQ ID NO: 13845 - DNA, 381 bp, Diabrotica virgifera
  misc_feature (11)..(46): n is a, c, g, or t
  misc_feature (60)..(121): n is a, c, g, or t
  misc_feature (158)..(179): n is a, c, g, or t
  misc_feature (198)..(219): n is a, c, g, or t
  misc_feature (231)..(251): n is a, c, g, or t
  misc_feature (340)..(357): n is a, c, g, or t
cttggttaatnnnnnnnnnnnnnnnnnnnnnnnnnnnnnnnnnnnncaatatttaatacnnnnnnnnnnnnnnnnnnnnnnnnnnnnnnnnnnnnnnnnnnnnnnnnnnnnnnnnnnnnnncacatccctaaatatatttaaaattactcatattagnnnnnnnnnnnnnnnnnnnnnntattaatcttttattaacnnnnnnnnnnnnnnnnnnnnnnaggattaatacnnnnnnnnnnnnnnnnnnnnncagtatatagttttatatattactatttttatcttctagaaattttttactagactatcaagtttaaattagttagatttactagtgcnnnnnnnnnnnnnnnnnngcaactgtatatttactatgaata

SEQ ID NO: 13846 - DNA, 357 bp, Diabrotica virgifera
  misc_feature (6)..(66): n is a, c, g, or t
  misc_feature (72)..(118): n is a, c, g, or t
  misc_feature (130)..(348): n is a, c, g, or t
ttaaannnnnnnnnnnnnnnnnnnnnnnnnnnnnnnnnnnnnnnnnnnnnnnnnnnnnnnnnnnnnatggtnnnnnnnnnnnnnnnnnnnnnnnnnnnnnnnnnnnnnnnnnnnnnnnttgtttcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgagctt

SEQ ID NO: 13847 - DNA, 435 bp, Diabrotica virgifera
  misc_feature (356)..(374): n is a, c, g, or t
acgtttctagaagtgaggttaaaatgtttaaaagttactatattaagaaacaaattactttaaatttaaattgtaaacaaattacagtatattaatatgtttccaagattggtaagaagagtgctagtacaaagaagttactatagtagtcaagtaaactcaaatgtacaaatgaatcctaatattaaacctttagaaaatattaaagcagatctaaatattacagactcctgtgtgaaacgtctcaaaaaaattactagtgacacaaacgaagtgttaagggtgtctgtcgaagggggaggatgttctggctttcaatacaaatttgacctagatacaaagattgaagcagaggnnnnnnnnnnnnnnnnnnnatggtgtgacagtggtgggtagatactaatttctttggattacatcaaaggatcgacaata

SEQ ID NO: 13848 - DNA, 409 bp, Diabrotica virgifera
  misc_feature (394)..(394): n is a, c, g, or t
aacggtgtggtgctagtttgcaacaagtgtgactgttttttgaatttttaaccagttctgtattgtaggaagtttaattgcgcaacttttatgtcagtacaacttttctcgaaaattaataatttaaagttatattcaaaaaacgaagagaaaaatcgaatttgtccttcattttttgacattttgattatttaaacaatgttcctgacatttttgatacggaggataactcaaatattgttgtttgagttatttttaagcaatttctgcaaaaaagggttgagtcactctcaacgtcaaaatgtactaataattttacagatgcgccctggtctatatcctgatagagggataagtagtaatagctggtgctgtaaatatattgaaacatacntatctgttagttttt

SEQ ID NO: 13849 - DNA, 159 bp, Diabrotica virgifera
aatggcgcgtggggtcgccgtccaaggtgtgtgtgtccttcgcgattttgctggtctggtaggagatgttctgcctcttggtcaggggttgcggtatggtgtccaggcaacctgagtctcttgtccagtgtgtgttgcaggcttatgctcttctcaggc

SEQ ID NO: 13850 - DNA, 264 bp, Diabrotica virgifera
  misc_feature (37)..(57): n is a, c, g, or t
atatattatacacgacatacccataatatgatctacnnnnnnnnnnnnnnnnnnnnncacaagtgcgaaatatcatatacagattagttgagagttgagttagtgaataaacttacgaaacagattgtcaacgaggcgagagagttattgacgaatatcagcacagcagccgtatgaatgcagttttagtctactctgaaccaaaatgggaataatattcagtgcgaaatgtacatctaccaataggctcgatggaaaaacagc

SEQ ID NO: 13851 - DNA, 301 bp, Diabrotica virgifera
  misc_feature (98)..(115): n is a, c, g, or t
  misc_feature (203)..(222): n is a, c, g, or t
  misc_feature (248)..(248): n is a, c, g, or t
agcttttagttcatccacagcagtctgacacaaacccgcgtcccgcaaacaataacaaaccctcttacgagatataagcacgcctttttaaccaaacnnnnnnnnnnnnnnnnnngttcgttgtcttacacttatttaaatttcatttaattgttttcgtaaaccacaacggaacatttcttaataacaatgttatattttgnnnnnnnnnnnnnnnnnnnncttttttaaaatgaaataatacgtcncattttaaaattcacaaaccatatgcataagggcttgttaaattttaagaaac

SEQ ID NO: 13852 - DNA, 148 bp, Diabrotica virgifera
  misc_feature (69)..(83): n is a, c, g, or t
aactatgcttccgtcgataactacttctttagtgtctgtaaggacttggttcctttggtgtcacctaannnnnnnnnnnnnnnatggtgttaatggtagaggagatggaggtaattattgtgtcttgtgtatcatggcttattacatt

SEQ ID NO: 13853 - DNA, 384 bp, Diabrotica virgifera
  misc_feature (64)..(97): n is a, c, g, or t
  misc_feature (153)..(171): n is a, c, g, or t
aaaaaatgtacagtggaacctcgataactcggattaatcgggaccgcagccgatccgggttatnnnnnnnnnnnnnnnnnnnnnnnnnnnnnnnnnnaacatgaaatatatgaatgcacagcacctacacatctaaattactaaaaacacgcnnnnnnnnnnnnnnnnnnncgtaagcaaacggaagcgaataataatataagactgtactacacacaatacagtcacaatcggaacgatgttatggtatttaaagaacagtgaaaactaagattattgtttaaaaaagatttttttaaatagtcttttagtcttttttaaacaatgctaagacagtttgaaatcttcttcttcttaacgtgccctatcaagttccctttgatg

SEQ ID NO: 13854 - DNA, 62 bp, Diabrotica virgifera
aatcgctcatttataatcgtcctacgcggtctggatcggtgactcgatcttggatgccctct

SEQ ID NO: 13855 - DNA, 215 bp, Diabrotica virgifera
acccatatgtactcaagttcgttcaccaataggtttctatggagcatcgtcagcgctagagcattggtgggagcgctgggcatcagagatctgccgagtcatggggtactggacgtactgttgctcgggttcgccatgtagcaggaggtggtacccatcgttctggacagggagctttcaggacaacgtgtcggcgtgggcgcatgtttgcacca

SEQ ID NO: 13856 - DNA, 341 bp, Diabrotica virgifera
caaacatctagtcaacaatactacgatcagttctcatcaaatgtggctgaagacagaactcacgaaggatatctttacaaacgaggtgctttgctcaaaggatggaaacaacgctggtttgtactggattcgatcaaacatcagctgagatactacgacgctatggaagattcccattgtaaaggttacatagatctggctgaagtaatatcagtaaatccagcaccaccagcgcctggtcctccgaaaaagacagatgataagtctttctttgatttacgtactagtcgccgaacgtacaatttttgtgctacagatgctacatccgcacaagaatggat

SEQ ID NO: 13857 - DNA, 349 bp, Diabrotica virgifera
aggtggtcaacgatattgcataacaatgtgtataagtatttcatcaatttatgaatctcatagcaaatgacttagagatagagttgcatcatgtgcactgcataattgttacaggctaatcgatacaaagtcctcactgagccaataagcaaggctgttcttaatcatctagagctgtcagcaattttcatcgtcactatttatgcagttcatttctattagggacctgactatcagatgtacatatgttagagattagttccaatgttaactgatctaattaatgaagtcactgtaacctaacatctcctataagtttttcaaccctcgttaaaattattcccatttt

SEQ ID NO: 13858 - DNA, 406 bp, Diabrotica virgifera
aggtggtcagctgtgaacaatttagctttggtaatttcaaagagatttttcagcgctgcctctcgatctataagaacatactttcttgacgtgacatgtgactgcaaaattatactgggttataactgacatcaaatgtaatagttgatgtcgaataattcgttttgagcttatttatacatcaatacagctgacattcttccttttgaacttaaaagtacctcaaacaagtaactgcttgttaattcttacaccttttaatattgtaaattttataaaagtcacgtcaagccacaacgttgacgttcctctcaaggtaagaatctgacaatgacttcatctctagcgcacgtcaaaggtggtggaagcttccaatctgaaaatattgtagatattagaaaaacat

SEQ ID NO: 13859 - DNA, 391 bp, Diabrotica virgifera
agctctgttagcgatgacctgccttccgattgcgagtccgacatttacgaagacatggaacatatgaacgaaaactagatttcgtcttcaactataaatgactcaacagaggaattagtcgatccataagatcggagaataacttttacgaagagtcattggtgtgaaattcctgaagtagtgaaatcgaccgttttaagtacttaaagctctcaacagatttaagctgcaagaagctaagttcgaaagcaatacgtcagaagcatcatacatacattcactcaatgtattagccgatcatttcgacaagaagttcatacactcgataatagtatatgaaattgagttcgaaattatatgtgggagcattaaatcagtgagagcttgctcc

SEQ ID NO: 13860 - DNA, 413 bp, Diabrotica virgifera
agtaaatttagatagacaccttataagtaaaaaaaactcatacacacgcattaagctttaagttactagactataattacttgtttttatagaaaacgctcttgtggcacttagaattacaaagaacgcataattttttgcgtttgcagcgtatttaattgcattcgccactacaattgcagtggcggaatccttgactgcctatattcgaatctttgcgaacgcattcaatgagacttatgtgagtatcatgcgcttcattgactgaaataagtgttatagctttttatctataacagacataataatgtcaataatgtttaagctatcggccttagctctatcaacttctggaatttgcactctaacactttgacctactttttcaacagggaatctatcattggaatgct

SEQ ID NO: 13861 - DNA, 415 bp, Diabrotica virgifera
  misc_feature (8)..(37): n is a, c, g, or t
acccacannnnnnnnnnnnnnnnnnnnnnnnnnnnnnggtgccgaggtagttctgactctttatatatgggtttgcttgaagtatacttgaccttctggtctctttttttgctaattatcatgagctttgtcttctttgcgtttatattgagtccattttgttgactgtaatacgtggttttacaagttttaccaagatcacaatactatggattcatcatctgcatatctggtgctatttagccggtacctgtttagtagattgccttttttggttgcgtgtaaaccttctgattctcacatattcgatgtgttcacggttggggaaaatttgactttcacacagactacagattttcttacggattttctttaggaacaattttagaacatgactcatgatggcttattgtac

SEQ ID NO: 13862 - DNA, 401 bp, Diabrotica virgifera
  misc_feature (341)..(359): n is a, c, g, or t
agtcattgtgtaaaacataattttgattgttttactgaaattaactacctaatttttttatgaatatgaatagtgtaactttagtttttgttctactgcaattgtttagttatatgtacataattacaagtgatattaatgttgaattaagtagagtgtggggtcctggtttaactcctgaaaaaattgtaatgcctgcaagatatttttttgttgaattggtggatgttaataacaggaggataatatcagacgatattgaattaaatgccattgtggatggaggcactaaaacaaataagccctgtcgtatatggaccaacctgctcaataggaaggannnnnnnnnnnnnnnnnnntacaaactgtatgaaacttgttcatatgtgaaaatttctgtc

SEQ ID NO: 13863 - DNA, 419 bp, Diabrotica virgifera
  misc_feature (41)..(70): n is a, c, g, or t
  misc_feature (302)..(302): n is a, c, g, or t
actctcggttcggttattgtgatagtatctgcgttagtgtnnnnnnnnnnnnnnnnnnnnnnnnnnnnnnacattgattcagctctcagtgttcttttagttttattaatcttgaattcggtatggccgctattaagagactcggcacttattttgcttcaaacagttccgactcacattcaagtcgacgctatccaaagcaggctgctgtcgaaagtggacggcgttctggcagtccacgaattccacgtctggcagttggccggcgatagaattatagcttcagctcatatcaggtgtangaatctttctgagtacatgaaaatcgcagaaaaggtgaaagaattcttccacaatgaagggattcattcgacaacgatacaaccggaattcatagactacaccgatataccgaccac

SEQ ID NO: 13864 - DNA, 56 bp, Diabrotica virgifera
aagacatctgcagacgtaatagatggcttcattatctaccataaaggtacttgctt

SEQ ID NO: 13865 - DNA, 156 bp, Diabrotica virgifera
  misc_feature (2)..(21): n is a, c, g, or t
gnnnnnnnnnnnnnnnnnnnntaagttgataaatttatttcaaataaatttatgtgatcaactcttctaaagcacacattgcatggggggccggtagcgagagtagctgagggcgcgctggtggaggagggaattggggagcggttcaagggggcg

SEQ ID NO: 13866 - DNA, 425 bp, Diabrotica virgifera
  misc_feature (70)..(112): n is a, c, g, or t
  misc_feature (198)..(198): n is a, c, g, or t
  misc_feature (275)..(288): n is a, c, g, or t
  misc_feature (290)..(305): n is a, c, g, or t
  misc_feature (318)..(338): n is a, c, g, or t
  misc_feature (368)..(385): n is a, c, g, or t
cccacgcgtccgattttcatttagtttacaatcataccatattttttagtcaacgtaacgacaaatttcnnnnnnnnnnnnnnnnnnnnnnnnnnnnnnnnnnnnnnnnnnncttataacagaaaaatttattctttgcaccttgtgtatcatggattcacacttaataagtacatatttactattttcgaatttaanagagctaagagattacaatttttattgtacaaccaatattttacctaatttttttgctatgaaatgttactcgctcnnnnnnnnnnnnnncnnnnnnnnnnnnnnnncaactttacttcnnnnnnnnnnnnnnnnnnnnngatatctttatattattaatagtaaatccnnnnnnnnnnnnnnnnnnccctaaaattttactaaaactcaatttttaaatacaaatt

SEQ ID NO: 13867 - DNA, 402 bp, Diabrotica virgifera
  misc_feature (278)..(296): n is a, c, g, or t
gcgctactcttctatcatctatattctgtattattctagccactcaaacttttctaacaattctatttttcatcttgtttaattttcttagctttagattatggctttggacttttatctttctttctcttgagcttaaccttaaatattcacttttgtacttcattcttaccctgtagaaaacctaatgttactagtctaggaataacataattttcttcatcgaaaaatttaaatatctagtcaattctatttattgttaaatcttccttagacannnnnnnnnnnnnnnnnnngttttcattgtcagcttcgataactacaacttacacatactgttcctcccaaatgttgtacattctttcttgaaaactttatacacatctttcaaaacgttaaatt

SEQ ID NO: 13868 - DNA, 405 bp, Diabrotica virgifera
  misc_feature (339)..(359): n is a, c, g, or t
ctgtatcatgttgtctaaaatacagtttgttaccttaagatcacggagctattttacccatgatactataaataacaagataatatattgcacatcctgaagtcgtgacgtaactggagaccggcaagttcgtaatagttcgtaatcattcgtaatgtccgattagtaacataacattaaacttcaatgtatacaaatcccatgatactataaataacaagataatatattgcacatcctgaagtcgtgacgtaactggagaccggcaagttcgtaatagttcgtaatcattcgtaatgtccgattagtttgaattgttcgcggttgtaagctaagtgnnnnnnnnnnnnnnnnnnnnncgaaattttgacaggaatctcgacaatatatttttttcgaatacat

SEQ ID NO: 13869 - DNA, 383 bp, Diabrotica virgifera
agtccataatggcaccgacagctgacaccactagcacggttacttggctctacgcagtcacagcgtcagtcttaaaacaccgtaatgagacgtgaagcatcacgtgctatgtaactccactctgtcatcaaaacgaaggcagcccagatcaactagaagtaagatattttcaaacgagctgaacagtatgtcaacgaataccgtttaaaataaagagacgaagttatgctagttagacagtccaaaaccagatgagatttccatgttcctgctgaagctaaacaggcgtctgttgttcgtattcagggtatcactaaagtgacagctaaagtacgcaaagtactccaactattccggatacatcaaatcagcaatggagtttt

SEQ ID NO: 13870 - DNA, 386 bp, Diabrotica virgifera
ctgaattatcaggtgatctgcaggtcagtcatcattttgtatcaattgtggtgataatagtttaaacacatcattgaagatccttgcatgtatctcagttcatgtaggtcaagccggggtctaaatcggtaatgcctgctgggagttgtcctgcccgcaacatgggatcgaacctggaagtcagattcatcatacataactgttggaggacgcgatgatagtttcatcacattcttcaatgaaactggtgcccgcattcatgtacctaaatcagtacttgtacatttggaactaagagtacttgatgaagtacgtacaggaaaatatcgtcaattgttccagtcagactacctcatcactggcaatcaacatgacggcaattacta

SEQ ID NO: 13871 - DNA, 422 bp, Diabrotica virgifera
  misc_feature (67)..(67): n is a, c, g, or t
atttagaaaagaaagaaaataataacaaacaagaatctgttaccacaagatcaatatcagcttttanaaaagatagaaaagtaaaattcgtccaagaggtcgataattctttgaacgaatctcaagaatctcacaaccaaacattgcattctactaaagtagtaaaaaatgttaattctgaatcaataacgaagcctgaacctaatttgcatcacctcaagatagaagatctgaatgtaatcgaaaagatcaatcctattataagtacagctaaagatgttaaaaattcggttaatgacactaaaaaacttatagaaaacaatgaactaaacacgagcttcaagtgtccaaaaaacgctgtacaattttatacgagttggaaaaacttcagaactaccgaagagaaatatacatacctcaag

SEQ ID NO: 13872 - DNA, 346 bp, Diabrotica virgifera
acgatcaaatgtcgagatcttcgatcgctagtaatgcttactgtcactgcatgctaaccaattactgctatgcaggtcacagtaagagtacctgggcaatgtgaaactagtctactctcagggttcccggactgccattcgttgagatctgtaaattccaagaactgtctaagtcacactcatgagtcaaaatgctccagtcataactctgcaaattgatgaagccaccttcaggtattaccttggcatattccaaactccatagtagtactaaccaacgtgtcaatcaggctgatgttcgagctgatcatttcagtcaatataatggtaatgcaaatgaccaaat

SEQ ID NO: 13873 - DNA, 285 bp, Diabrotica virgifera
  misc_feature (3)..(64): n is a, c, g, or t
  misc_feature (66)..(79): n is a, c, g, or t
  misc_feature (84)..(109): n is a, c, g, or t
  misc_feature (111)..(187): n is a, c, g, or t
  misc_feature (189)..(208): n is a, c, g, or t
  misc_feature (210)..(227): n is a, c, g, or t
  misc_feature (229)..(263): n is a, c, g, or t
  misc_feature (265)..(277): n is a, c, g, or t
aannnnnnnnnnnnnnnnnnnnnnnnnnnnnnnnnnnnnnnnnnnnnnnnnnnnnnnnnnnnnngnnnnnnnnnnnnnngtttnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnannnnnnnnnnnnnnnnnngnnnnnnnnnnnnnnnnnnnnnnnnnnnnnnnnnnngnnnnnnnnnnnnngtcctttt

SEQ ID NO: 13874 - DNA, 277 bp, Diabrotica virgifera
  misc_feature (6)..(23): n is a, c, g, or t
aaacannnnnnnnnnnnnnnnnngaactaacactttcgatagcgagtggatctaaaactattaattttatcaaaaaagtgtatagagcgttttttgctttgggtgaatgtttttaccaacttttgctgtcaaggtgtaatggggggtttccgcccccgaggtggggtggcaaccacccccatggtgggggcgcctttcggcgtcgtatggattttgatccttggactgtccactgcttgttctcggattttcgagcaaatcgattcattctggtaaa

SEQ ID NO: 13875 - DNA, 413 bp, Diabrotica virgifera
acccaagcgtccggtgataagttgtagttgtatctaactcacgtttgccgcaaacagtgttcatactaaaccccagaatctacacaaaatttagattgttttcactgaaaaatgtctcaagacgaggacctagaacagaatttgattggagtgatagatgcgggtaccagaacagtgcagttttgtgtgtttcggactgaacatacgaaagaaatagccaaacacactgtagacattacaacagctgtgccccaagaaggatggtccgagcaagatcccagggagatcctgagagctgtagaaacttgtatggaaaatgttgccaaaagccttggctctgaagcatctgaaaacatcgtaactataggtatttaccaacagagggaaacgacgatagtatgggaataaaacac

SEQ ID NO: 13876 - DNA, 400 bp, Diabrotica virgifera
ggattacatccagtacagctccagcgccggtttcaggaggctatcaaatagaaaaccagaactcacaagactctcaggctagttcccaaccatttacaacgctacctccaattttgaatatcaacgagatattccaaaatctagtagcttctggattagtaaagtcatcaccaccaagtaagccagtagaagagccacctaaagtggtagaatcgcctaagaaggaaatgagaattgagcctgaagtacctgccgctactagtactccaaacgtagcgccctcaaaacttaagaaaaccgtattgagcctgaaaccagtcacttttaacaggccagaaacgctgagagtacgccaaaacagcctatatgcaatgttatattctggtatgcaatgcagtac

SEQ ID NO: 13877 - DNA, 364 bp, Diabrotica virgifera
  misc_feature (253)..(273): n is a, c, g, or t
actacgcgtccgcccacgcgaccgcatgtttttagaagcatgtcacgtcaggtatctcttcgacagcgtgtacatagatcattcgctcaagaagaatctgggatagattatgaagaagattcagaacatggcagttcagatgggtaaaaacatgggtacccagaatggtccaactaataatccgttgaagggacaagcgctgaaagctccgcaatgacatgaattgtcggtggaacagggttttctagattcnnnnnnnnnnnnnnnnnnnnnctttctggtaccaacaagaagcctttaacacaccctcacaataaatttgttctacaacaatattcgacacagtctctgggcataaattttc

SEQ ID NO: 13878 - DNA, 438 bp, Diabrotica virgifera
  misc_feature (333)..(333): n is a, c, g, or t
  misc_feature (392)..(411): n is a, c, g, or t
cccacgcgtccgtagaaattgatggtatcagtattgaacaagtaatggaagtaaaataccttggaattacattgtcaagttacggagacctggacaaagaagtgagaaatcaagtacaaaaagcaaatagactggcaggactcaatcacactatatggcgaaaccgacatattaacactgagatgaagtcaagaatttataaaaccagtgtaagacaaataatagcatatgcatcagaaacaagacccgatacagccacaacacaaagactactgaaaacggcagagatgagactactgagaagaattacaggaaatacgttgagagatcganaggggagtgaagacattagaagacaatgtaacgtacagtgtaaaaacgaatggacactnnnnnnnnnnnnnnnnnnnnggagcaacccacataccagaatggtgg

SEQ ID NO: 13879 - DNA, 210 bp, Diabrotica virgifera
agaaaaaagaagtttgtcaaagtgtcttgaatgcatcgtgtagcggtcaaattgttggctttttcaagttgttttgaagatattaaaaatgagtttcctgaaccaaggtcctccagtgcgccaattaacagatgaataatataacctctgcaagcgtccgtaattttgtccaaaataacataaaagtaattatcacgtgttactccccgt

SEQ ID NO: 13880 - DNA, 336 bp, Diabrotica virgifera
  misc_feature (331)..(331): n is a, c, g, or t
acgtgacaatgcagggcttattaatccaccgtccaataatccttcttctaattcagtttttagtttagttcaatcagaccctatgcctagttttgctggactagggacagctccactatcaaggatatctccaggaaaaccttggccatctatgcctgtcaattatgcaaacttttcttcagttactactacagataatcaaattgttaatattagacctgaaattccagggcgtattaatccatcgttcattacaccttcttctaattcagttcctagttgagcacaatcagaccctaggcctagttttgctggaataaggacaactccnacacc

SEQ ID NO: 13881 - DNA, 233 bp, Diabrotica virgifera
  misc_feature (30)..(125): n is a, c, g, or t
  misc_feature (131)..(149): n is a, c, g, or t
aatccaaggacgcgtgggcggaagcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaannnnnnnnnnnnnnnnnnngtattttttaaacttatttcataaatatagtcaaaaatgtaataaccagaatagaaaattcaacataaagatcaaccaaaatgc

SEQ ID NO: 13882 - DNA, 393 bp, Diabrotica virgifera
  misc_feature (3)..(390): n is a, c, g, or t
gannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngga

SEQ ID NO: 13883 - DNA, 367 bp, Diabrotica virgifera
  misc_feature (22)..(41): n is a, c, g, or t
  misc_feature (99)..(136): n is a, c, g, or t
  misc_feature (164)..(189): n is a, c, g, or t
  misc_feature (212)..(233): n is a, c, g, or t
gaatttttgtagtaaaaatacnnnnnnnnnnnnnnnnnnnncttgtgtttttaagatatgaaaatattgtggaaactgccgatccaatttttcgaatannnnnnnnnnnnnnnnnnnnnnnnnnnnnnnnnnnnnnaactagctttattctttactttattacnnnnnnnnnnnnnnnnnnnnnnnnnncagttcactaacatagtacattnnnnnnnnnnnnnnnnnnnnnngagatacatattggtcttcctcgaaggtagcgatatgtttttcagttgtatctgaatttagtcatttcataaaataatagaggtgggaagtaaatatctgacataactgttaaaaggtacatacattacaaaag

SEQ ID NO: 13884 - DNA, 396 bp, Diabrotica virgifera
  misc_feature (161)..(179): n is a, c, g, or t
aattatacactctcagtttaggtttctttcttgtaaaacaaatctaaactgagagtgtataaatatacgccttgtatgtttatctgtatgagttgtttgccaaaactagttttttacaagaaagaaaccttttgaaatttcaagggttgcagtttagaaannnnnnnnnnnnnnnnnnncgaactgcgaatgaggtaatttgtggccctaaatttttacctatttaattgttagacataatttaaatatgtgggtcccaaaagctcgttctttatttaaatttgctccagtgtgggacagggatgattggaaaatcagaaatcatttaattcacctctattcatcccgccaattttttgcgtacacttgacgtatgacgttattgatatatcccaa

SEQ ID NO: 13885 - DNA, 378 bp, Diabrotica virgifera
caaaaaaccagtttaatggcgattgctataatagccctatctatacctataacccatctgcacactaatggaacgcagattcagatagagcgcgttaaacagtcttgctacctgggaactattataaataatgagcagtagagcaaaaaagttgaaaatggtggaggtatttagcatcaacggttctcctttaaaatcaatatgacggctaacccttcagcggaattcctattgacctcccctaaaggttagaattataaaatttggggcagctcggaaacaagattcaattcaatatttatgctcccccacccctttttaatatattcccgctaactcggaaaatatcaaccgcacgaaaaaaattgtcacaaaaga

SEQ ID NO: 13886 - DNA, 400 bp, Diabrotica virgifera
cattgacataatcctagccgttattcttttagaaaatatttcaaaacgtgattaaaagtaattaaaagtgatcatcaattaattacacttgttcttaaatggagcccatgacgttaggaagcgccccttcaagtcctgcatctcctgctgctaaccgcaattttttacctggttttttaataggaggtgataatcaaattccatcaggtaacccaagtatttcacctggaaggaataaaacccctgggacaggcggcaaaacaccagcaaacgaaccaaatggcttccgtcaaaagttgttcaatcaccagcttaatgaaagtgcaggatacacaccagcacctgaaaaagggggacctcccaagttaagactccttggtaatttaaaacacaaagaaaa

SEQ ID NO: 13887 - DNA, 209 bp, Diabrotica virgifera
  misc_feature (84)..(207): n is a, c, g, or t
aaaaggttcaaattttaattacccttaaatgaaacttaaaagcttttcaaaagtgtcacctaatttaatttaatgggccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntc

SEQ ID NO: 13888 - DNA, 440 bp, Diabrotica virgifera
caaagtgacagcttaatacaatttaaattatgaagtgtaagtgtgcatgtttaaatccaaattctgatgaaaatgaaggtaaaccaaccaaaaatccacacctatccaagatgcaaaacgactacttataccacattgcgttagacactgaaactatgaatctggttgatgcatttcaagatactaagtttgtttgtatgggaggatctccgacaagaatgtacgcctttgctaagctcatagctcacgaaatcggccatgaactaccttttggcacaaaattaatggatatcagtgaaaaagctgataggtttgctatgttcaaagttggaccagttatatcagtaagtcatgggatgggttgcccgtcgataggaattcttctgaatgagctgattaaattgatgtactacgctaaatgtaaaaacccggtattcttc

SEQ ID NO: 13889 - DNA, 433 bp, Diabrotica virgifera
  misc_feature (60)..(77): n is a, c, g, or t
agccagccgatttcgatttagccataaacagcaaaaggagtttatttgtatgattgaacnnnnnnnnnnnnnnnnnncagtttatattttatgttaaccatggaatttaaagctgaagttaaggaagagtttgtttttgttgaatgtaaccaaatagatatagagagccagcctgagccatccacatcaatatcaatagaacaggaacacaaaaatgaaccagaagaatggaactcaggattattgtataaagccatatactgtgactcagcaatggaagtaaaacctgaaattaagaaagaatttgatcaaaacgaccaaggatatgtagaacctctgctcttaacatccatagaacttagagagttgaagaaagaaatagatgaagataaaccagggttttctcataacggaatggaaatcatgaacagtg

SEQ ID NO: 13890 - DNA, 76 bp, Diabrotica virgifera
gtcgaccgacccttcggccaagccatcgggcgttttgattgccggaaaacagaagccaccatgagagaacattggt

SEQ ID NO: 13891 - DNA, 89 bp, Diabrotica virgifera
  misc_feature (9)..(34): n is a, c, g, or t
  misc_feature (36)..(57): n is a, c, g, or t
aaaaagacnnnnnnnnnnnnnnnnnnnnnnnnnncnnnnnnnnnnnnnnnnnnnnnnatacaacacacatttattttgggtaccctgtg

SEQ ID NO: 13892 - DNA, 373 bp, Diabrotica virgifera
  misc_feature (7)..(32): n is a, c, g, or t
gcgagcnnnnnnnnnnnnnnnnnnnnnnnnnnagatttacatttattgtacaaacgttaagatcatttacattgtgatttttccgactttagacaacatttatgccactttgcaatgtgaaattacatttactatggatggtgatactgctctcttcatactagcgtaagactttatgtacattacttttaaccgaatcgtgctgttgaatcagattattacatgtatattagatttgggacttagacctgactccctcgccagtcttttatcaacttcgattggagcattcaactaatctataagtgtcagaatttacatcagccaatattgcaagaacatataatcacgcacgacattggatccacattca

SEQ ID NO: 13893 - DNA, 260 bp, Diabrotica virgifera
gatcttccctcagccatgtgtcataagtccatgtttgatacaatgatatacttcataattagactatgttgtagatttgtcgcccatgtgaatccaattatgctccaggggcattatactgtcagcattcaatatacatataattgatatcgggacctcttgttctcagcgtctaatcgtatcaaaccttatgtatctgaaggctctcattcgggaatctctacgtacattcattggataccagtgattaatctggtgta

SEQ ID NO: 13894 - DNA, 312 bp, Diabrotica virgifera
cttcggctaagtccaacgttgcgcataagtttgttgacattcaacaaatctttatcacttacagatcgcagacattaatcaatcactccttcttggatcaagggatgtgtcacttttctaatcagcctaaaactgactatggaaaggattaatcccagaggactaattctgcaaggaccctgcacatccgtaaacagtcccaaaactgctaggtacacccaactagtgacaggtggccctattgacacaacccagtggatctaagctggatgtaatcgatacacaatccccatgccaagccgttagacactg

SEQ ID NO: 13895 - DNA, 347 bp, Diabrotica virgifera
ccaacgcgtccgctttggcatcacaaagaatttgacgaggtaactaggaggttaaaatgtaaacgtttggtgcactctttgaaagtgaaaatgtagtgactggaagttgaacacggatggtgatggtaaccacgaacattcgataagtgagactggggatttgctacctctgatggatttcagccagagacctatggagtgtagcagaggcaacaggagcgattccaaaagctgtcagacttccctggctatcagctgatctattactagaaggtagtacaagttacgagaagagtaactagacatattatgtcagaggcactcaagaccgcagaagagttgagctc

SEQ ID NO: 13896 - DNA, 416 bp, Diabrotica virgifera
agcagacataagtgagaacgcgacgcttatacataaaatcagcgcggatttgttgtccagcactggtactatgtcgcaatttatcactctgaagaaatctttggtggacgatgatctgaagagtgaaatccacatggatagtgaatcgacttggttggatatgttacaagagtaatgacagtttctgaagcgaggtcttatgacgaaactacaattccacctccaatgaagtgtcttcggacagactacgattcagaaccttcttctcagcatcctaacgatgaggcaaacacaatggccgatagagacttatgggtcacatttaagcttccacacactcatctgtaaaaaccagataggcgaagcgatatttcaggattcgaatcgctttagcataatccacacaacaaattttg

SEQ ID NO: 13897 - DNA, 301 bp, Diabrotica virgifera
gacatttcataaatgcaatggcacgctcgtcttgtcacgtttagacggggaagtggtgtacgcgatttcactgtcacatttccaagtatattcgactttaataagttggcttttcattcaagagatttaagatgatgtatatttaagattgaagtcttcacatgaagtttaagtagtcagattcatagtgtggtattattaacgactacaatctgacaagtcttgttaagttggtttagttctgcactgaaaatgggtacgaagcatgaaagtacaagtcagtttttcgcgagtatggtgc

SEQ ID NO: 13898 - DNA, 405 bp, Diabrotica virgifera
  misc_feature (22)..(47): n is a, c, g, or t
  misc_feature (137)..(137): n is a, c, g, or t
  misc_feature (198)..(227): n is a, c, g, or t
tacattcattctttttgtctcnnnnnnnnnnnnnnnnnnnnnnnnnncaccctgtaaataattagaatttatattaatgagtggagagttgaataacttttcagatgagctgtcacacgacccatattcttatttanaaaaattatcgattgcgtcattacgcccagatggaagacgtcactagtatgatatatatgnnnnnnnnnnnnnnnnnnnnnnnnnnnnnngacctgattcgtaatttatctccagagtcacccgttctcgagaaaacgaatttattcaactcaaacgtcctcactgtacctataacttcagaggcttatattttaaaaccatgattttttggagctatgcgcccattgagtcttttgttctacacatcaaggactaccagaacccaaa

SEQ ID NO: 13899 - DNA, 425 bp, Diabrotica virgifera
  misc_feature (123)..(142): n is a, c, g, or t
  misc_feature (316)..(342): n is a, c, g, or t
taaggttatgagttagctaatcaaactccaactataataaaaatcaaggttataatttttactagaataggaagacaaataaaaataggagtagaaaatactaatcacgaaaataagcttccnnnnnnnnnnnnnnnnnnnncgttgatttttattatagttggagtttgattaggttatgagttagctaaagttaaaattgcgtataatttattaaggttaaataatatttctagagtattatttctcagaataatatgaaatataccttttttatctactttaggaattaattattatccaatttattttggtnnnnnnnnnnnnnnnnnnnnnnnnnnnggatgatttgaatattatggaagttcaggtgtaataaaacaattaaataatagaatatttttacagttattttctcctaatca

SEQ ID NO: 13900 - DNA, 310 bp, Diabrotica virgifera
catatgcatcatcagttcgtgtgttaacatacatgttcacaatgcagtttctcgttctttgagccttattacattacagctcttcagaagttttacgtaatggtagatgaccacattgtacaggtaaatcatgatgaaatacaactttgcccacatggtatatatacctgacgtatcctgaacctaaaaatactgcgtgctgtcccaattgcgatcttcatataccatgtgaacgtacaaaatgcggtctaatatagtgcccatcagtatcaaattgacgactacggcctggataattgttgtcctacct

SEQ ID NO: 13901 - DNA, 77 bp, Diabrotica virgifera
catgaacatgctcttcttgctttcacccttggtgtaaaacaacttagtgttggtgttaacaggatggaatgtcgcaa

SEQ ID NO: 13902 - DNA, 196 bp, Diabrotica virgifera
cagacgcgtctgtgaggatgacaggacatgcgattacactgtggagacgatgacttagtgcgaaacagacggatgtgatacgacgtttctctgggacgtgagacatcgatctaagattatttcgttgtacggcacaaatgtctgatctgatcactgtcggagagcggaagatacaaggatgattacaatctgtagg

SEQ ID NO: 13903 - DNA, 368 bp, Diabrotica virgifera
agagtacgtcgtgccaggtgtgacatctcaagtaatgttccttttattcaaagtataattccgaataattgcattcacttaaattcaaaccagtcaatatgggtaccgaattgattcatattactagcatagccactggacacatagattcagggagatcaactactactggacatttaactctgaactgtggtggtatcgacaaacttactatcaaaaagttgcatcgagaagcccataaatatcgtaaaggttcatctcacatattcctgggtactcgacaaacttaaggccgacagagacccttctattaccacttaaaatgcattgtggacatgccaggcagctcagtaccaggtaaccatcat

SEQ ID NO: 13904 - DNA, 201 bp, Diabrotica virgifera
  misc_feature (119)..(189): n is a, c, g, or t
cagacgcgtcagcggacgcgtcgcggagagactaacatcggtgtcaaccagtggcggttattgattacaaggtcaataagatgaatattgaggagggctaagcatcatctgctgatcgnnnnnnnnnnnnnnnnnnnnnnnnnnnnnnnnnnnnnnnnnnnnnnnnnnnnnnnnnnnnnnnnnnnnnnnttcgccatgttt

SEQ ID NO: 13905 - DNA, 333 bp, Diabrotica virgifera
caatagcccagcaacgatgccaacattaggggagtcaagcttcagtaacggcaaggataacttttgtggagttcaaaatgccgctccgaaagcaacaacacagccacccaagatatgtcttcagagaaattggatagcacagggaatctaatagaataataccagagactgatacccacacatatttagttagaacagatactcaaaatgcatctggtgataattccaaatacgcgaagtatcctgtagaggatgatactctcaaaaaccatactcttctccaagaagaaatgaatcatggcagcgacaacgacggaaatggaagacaagata

SEQ ID NO: 13906 - DNA, 121 bp, Diabrotica virgifera
gagtaacaaaacaacatccaaacccggttccgtttgggagaaaaacttttccgggttaaggcaacaacaaaaccccggtaaggagaatttaattaaaggtactcacaatttcaagtttttc

SEQ ID NO: 13907 - DNA, 446 bp, Diabrotica virgifera
ggcaaacgaatccgcaaaggggaaaggcgcaaaatgtcgcctgtcaaaactttcaattaagtctagaagtacatacagaaggtaaaaaattacaaataagcatgtatccaagtactcaaaaactgaaaatgtgtggagctgtagcagttagccaaaaggttactggtctctcagagaaatatagacctgaacctttaagatcacataagaaaattgataacaaccaccttccagtatataaagatacccatctggtacaaagggcatcgatagctgaaagtcctagtaaagaagtggctccacctctacaaccaagacaaatgagggttaaccaatcgatgagagcacgaatttcgagtgatcataaatctggttcaaccaaagttcgagaagcgagatcgtcgtcaataagccagtcgaaggcatcttatttaactaaccgccac

SEQ ID NO: 13908 - DNA, 316 bp, Diabrotica virgifera
  misc_feature (289)..(305): n is a, c, g, or t
ggtcaattatgtatttcacggagttaggcaattttcttttttaatactgttgttgttttttggacatggcaagttccacagtgttttgtctctcctgtaaaattttcgatttgtgacttaagcaatttgcctattagaccgacgttatgtataaatattgcaccagagatgtcacgacgtaatctgagaggaagtagtgagagatgggattcaacagttgagtaatcatggctaactatagctagataagatttgaatgcgcagtaacgtaaaactttatgttggatcnnnnnnnnnnnnnnnnnatggctttgat

SEQ ID NO: 13909 - DNA, 421 bp, Diabrotica virgifera
  misc_feature (320)..(333): n is a, c, g, or t
  misc_feature (335)..(350): n is a, c, g, or t
cagaaaggtcagatcaaaaactttcgttacccaacgttgtcagattaatcaaagtttaaaggttttccggttttaatttgtaaccggtttcacagtaaaattgataacaattcaataacgccttttgcattttttattataaatcgaaatattagacgtgataagttacagtgtatattggtgaaattccttttgtcaattatttcagttaaatacaaataaggagtcttaactgtttattaatgactgtgtgacaggtacttcttttaagacaacagactcagtaaaacaggttaaaaataaactaaatgtattgacgnnnnnnnnnnnnnncnnnnnnnnnnnnnnnntataaaaagcttcccaaaaaacaatttccggtaaaactccctaacccggacgtttggaaaattaaaattaa

SEQ ID NO: 13910 - DNA, 404 bp, Diabrotica virgifera
caaaatcatggggttcatattcgtcactttctgcgccctcgtcgctgtagccaaagccggtatctacggcgaaacctacgcagctccccttagttacgctgcaccagtagctaaagttgcctactcagaagctcctgctgtgtcatactccagtgtgtcagccctagtagcctacgccgccccaggcatcgctaaagtagctgctcgcatttcatactccgctccagctttctcctactccgctctacccgttatcgtagctgctccagtagcttacgctgccccagcatatatagtagccgctccagtcgcttatgccgccccaatcgacacagccgtctatgccgaaccatctgcaccagctcactacgatttcggatatgccgtacgcgacgcccacaccg

SEQ ID NO: 13911 - DNA, 202 bp, Diabrotica virgifera
aaattgctgaatttcttttagcgcttttactatattagggaaccaaggagatttttaccatggtttgtaaatatgtggacgacaaccaggtaaggtctgtcacatttagtatgcaccaatcaatgattttggtagatgcacaacaatttattttaaataggtaatttaacaggtaaaaagttgattccgcaatcctttaccc

SEQ ID NO: 13912 - DNA, 464 bp, Diabrotica virgifera
  misc_feature (53)..(74): n is a, c, g, or t
  misc_feature (313)..(313): n is a, c, g, or t
  misc_feature (329)..(329): n is a, c, g, or t
  misc_feature (407)..(407): n is a, c, g, or t
caagctaaagatagatttctttcacaattaattagtgaaaatccatttgtagnnnnnnnnnnnnnnnnnnnnnncaataaaattagaaaattaaactgtactctggatgatttacgaaaagcaattagcaagtcggatatgatagaactatcagaatgcaaagaaagaataaagagaaagatgcctataaaaattaatgaaaatgtagacaattgtacaatatatgttgaaaatattaaagccgatgctaaccatgagtgggtttcacagatattttcagaatttggaaatgtggtttatgtttccataccanaatacagacataatanaacaaacaaaggttttgcttttgttgagttcgaagatgaagctggtgctaaaaatgctcttacatactttgagagtantgggtgtaaaatgccatcagaaacaaacccggagaaattaaagagtatcagacattc

SEQ ID NO: 13913 - DNA, 441 bp, Diabrotica virgifera
ggaaaagaagatcaaagtatatttaaaatagctaaaagggattcgccgacgaagacaatagtctcggatttgaagcctggtacaaggtatagattgtggttggaggtttacttgactaatggaaaaattaagactagtaacgtacaagattttatcaccaagcccagaactgcaccgtcgttgggcgcatcaacacaacaagataaactctccagagcggagcatcttgaacccaaaggagactactatggtcctctagtcattgtagcaatattagcagcgattgccatattgagtactttggtactattactgattttgattcgacgacataatcaaaacaaggctgccatcacaccaccatctcgaatcaatcagtctgcttatgataatccttcatataaggttgaaatacaacaggaaacaatgggtaaaggtttt

SEQ ID NO: 13914 - DNA, 361 bp, Diabrotica virgifera
aaaatgttgaaaatcaagaatagttaaattataaatacaaactaataagaagctggcctcctaatcattaaaatgagtaagggtgatctcaattcaataaccatatgtaacaaaataattaaagtgtttcttcagttcatcagtaatttgataattcctgattaagatgctcaagtatttcaatatttaagacagtattcagaaggaaaacaaatttttctcaaatttaaataccagtttaagtgggtttgtaagatgggacgcagagtatttcatgcataacgctaaatatggttacacctttgaaaacactttggcgttttttccagtataaccatacattataagaattggttcctgg

SEQ ID NO: 13915 - DNA, 329 bp, Diabrotica virgifera
  misc_feature (17)..(37): n is a, c, g, or t
  misc_feature (238)..(257): n is a, c, g, or t
taaatcgcgagcggctnnnnnnnnnnnnnnnnnnnnncaattgccttttttatttataggtacattacagaaataatgtgaatagatacgaattctacaacataatacaattattattctaaaataaacaagacaaacttttgaaaccaactatcgtgaaatacgaacatccatttttgaaaaaataacaattccttctgtacaatcataaataacgtagaatattttagtgattccnnnnnnnnnnnnnnnnnnnnaaatacttttacttgtaaaaaagaaaaaactaggataagtgaaaccaaattgtataaaagaagaaaccaaag

SEQ ID NO: 13916 - DNA, 77 bp, Diabrotica virgifera
aaaacacatgggaagcgtacaagcaataaaatacatttacatgaaataaaatcatgatcacatacatcaacaaaaat

SEQ ID NO: 13917 - DNA, 446 bp, Diabrotica virgifera
gaggactaaagatatttgtttgacatataaaagggatgatttagatttaacagggtttgttgatgctgattgggcctcaaataagttagatagaatatcttacacaggttttgcttttaaactttcgggtggtgcaatttcttggaagagtgttaaacaaaaatcagtggctctttctagcactgaagcagagtatgtagctttaggggaggctactaaggaagccatttatttgagaaatttgttgtcagaaattcaaggaacactggaatcagttgttttgtataatgacaatcaaggggctcagaagttatgtatgaatccagtattccatgaaaaaacaaaacatattgacatccgtcaccattttatcagagaggctgttcaaaataatgttgttgaattgaagtatttatgtactgatgaaatgttggctgacatcctta

SEQ ID NO: 13918 - DNA, 436 bp, Diabrotica virgifera
cacacgcgtccgggccaataagtttcatcggatattagacaaaaattgaaggatgctaatttggcacaagtgcccttggtattgtttgcaaaaggagcccattttaatcttgaagaccaagctgaattgggttatgacgttctgggtatagactggactgttgatccaagtactgtaagaacccgactgaagaataaaaatattacagtacaagggaatcttgatccgtgtgccttatatgctcctaaagaagaattggagaacatgataaaagagatgataagatcttttggaactgatagatatattgttaatttgggtcatggcatttacccagacgcacccgtcgaaagtgttcaaacttttattgaagcagttcattccattaacataataacaactaaatattaatggaatgaactgcttcaataaatat

SEQ ID NO: 13919 - DNA, 420 bp, Diabrotica virgifera
  misc_feature (48)..(68): n is a, c, g, or t
atctcaaattcaaaattaaaccaaatttgtaacttttattaagcctcnnnnnnnnnnnnnnnnnnnnnaatgcaataatggacatttcaaagagatctagacagtggaaatgttttgatttcggtccaccaacaaaaaaagttgatttttcacctaaagaacaaattaaagaaaattacgagcccaaaataagtagcagtagaaaaaatatcccagtgactggaaagaaatgctttaattttcatgaacaacttgcaccacaagccattagtgagcttgctgtacatcctaaaaagatacaagaagtcgaagattggtttaatagatttgttttggacaaaaagaagaatgtttttactcctccactgttactcccaagacctaacggttcgggaaagacttcaacgattaatggtaaaa

SEQ ID NO: 13920 - DNA, 444 bp, Diabrotica virgifera
aatttcttcattttcattgtgacttaaattcgaatgtgggatattttctccgcagtatttacgtagaagaactacacgccaaggacgaccatggcatcgtctactccaaccatcgtgggggaaataagtgcaactgatgaagtttctcaatacaaggtagaaaagatagttctcgatggtgatttgctttcttcaagccttcctcaattggaaatgtctgtcagtggtaatagtaatccagcaagcagctattcggctagaaaaacctcgtccgttttagcttctaaaaaagaagtcaccccacgaaaaaaatctgctgtaaagaaaccaacagtgtcatctagtattccgctgccggttattaagccagccaaggcaactccttcagccaaactatcaagtcagactgtcaaatctaacaccggtaaactttccaagccaaat

SEQ ID NO: 13921 - DNA, 439 bp, Diabrotica virgifera
  misc_feature (180)..(197): n is a, c, g, or t
  misc_feature (377)..(394): n is a, c, g, or t
aacaaatcgtgaaaaacatatctctatgcagaatttaattgcggtgaatttttatttgggtgtttttgttgtaaagttaaaatcttcggagttatagagcaataattgaaaaaaatacgatttgtcggcgccattttgtttataaaaaaagtagcacactatctgcggactttgcatgcnnnnnnnnnnnnnnnnnnggatcttataattcgattccagcaatggagttgctggtgaataacttttccatgaattttgctaattagcccagagtatagatattctaccttttttgccttattgttattctagctgcgcctctctgtcaacgctgtgtatacgtttttcgtctgatgggttcgacagataataaattnnnnnnnnnnnnnnnnnnctttcagtgctctttcgcattcttcgtctgaccattttggtattt

SEQ ID NO: 13922 - DNA, 447 bp, Diabrotica virgifera
  misc_feature (153)..(189): n is a, c, g, or t
tgtccatatcttgtgacgtgtctttgcgtggcacttgcggtaaattttgattgttgtaaatgtagattagtggggaaaccttacttttcggtggcaagtggtggcggaagtaacttagctaacatacgttaatatagcagtaacatttttagnnnnnnnnnnnnnnnnnnnnnnnnnnnnnnnnnnnnncctgtaagaaaatctgcaaataaaaatccacctattttgagccacgaatttgttattcaaaatcatgccgatattgtgtcatgtattgctatggtgtttgtagttggccttatggtacaagctacatctccaattgcttcaatattcataactctgcagcacaatgtaacagaagcaggagaggtgcccctttacagtcctggtgtgaaagattgggcttgtatatttttctacaccttgatttgcgttgttatccat

SEQ ID NO: 13923 - DNA, 385 bp, Diabrotica virgifera
cattatttcacttcaacaaactgctatttgacatacagcgtctgagatcagattttattcatatgatgatctgattaatattgtcagagctacactcagctcaatgattctttcacatcatttatgatacttggcgaacatggcagtatatgcagtgctgagatagatatgaacaggcgatttacaatccacccagctgtttaagattttagggggtactttggaagattcctttttggattgtggttatttgattggcattttacctgatgtccatcattcaaagagagtagataatgctagcttcctgctatccatctctcctatggtcacatttaagatcatagtatttggttctcacatgaatgtacattcaatggctatt

SEQ ID NO: 13924 - DNA, 407 bp, Diabrotica virgifera
  misc_feature (399)..(399): n is a, c, g, or t
caaacatcatttctattgaaaaaaaaatacttagttgtctgcctctatttgacgtaaaaaatggcacactattttaaagagaaggatattgacgaattcagagaatgcttttacttatttgcccgctctggaaccataaaaacactagatgaattaactgtcataatgagaagcttaggattatctccaactaagtctgaaatgactggatatttaaaacaaaagggaggaaaaatgtcgtttccagacttcttggaagtaatgtacattcactctaaggtggaaaacattccgaaagaagttgttgatgcattcaaggctgcagaccctggaaatactggaaaaatacctgcaaaacaactgcgctatttactacaaaactggggagaatgcttgtcnacaaaaga

SEQ ID NO: 13925 - DNA, 273 bp, Diabrotica virgifera
gaatatatgaaataaatagtcattaaaaatgtggtatatacctactcaaaatcatttaaaaaagtaaattgtattcaacccattattaatatacctagaatatttgaatgatttagtcccatatatacacatgaaagaatctccttctgctttaattaagtattagtaatgctattctactgcatatatttaattgcaattatattctatgatttttgtaactctacaggtatctaccacatttttaaagaatatatgaaataaatagtcatt

SEQ ID NO: 13926 - DNA, 312 bp, Diabrotica virgifera
  misc_feature (89)..(107): n is a, c, g, or t
  misc_feature (152)..(280): n is a, c, g, or t
cacacgcgtccggggaatattcgtgtttggagctgcaaaaagtactgaggatattttcgaaaaatatttgcagatattatggttgttgnnnnnnnnnnnnnnnnnnntgttaagctattacctctgtacctaataaagctatttatgtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcaaaaaatataacataaattcaattcaca

SEQ ID NO: 13927 - DNA, 442 bp, Diabrotica virgifera
caaatgtataataaaaacgtaataggtaagaaaaatcttagtttaatgaaaaagaatttcgactcagactcatctacaaatagtactcgtaccgaagatgatgccgaaaaaacttctgtgtctgattctgactgtgatgatacagttatattcaaaaaggctgttagtacggtaagtcctacaaagagatattccttaagaagtagagcttcagtggacaaatcaatatctccgaagaaaacacctgtcaggaaaaaaactgctaaaacgccagtgaagaaggagaagaagactgtttccaaaggaaagaaaattgctaacactggtcaagatttagaaacagcaacaaatgttgaggaagtcagaactgtattacatgagttaaaaccaggtactgccatgaaaggaatgacaacatcacagacgtcagttttggaagatt

SEQ ID NO: 13928 - DNA, 438 bp, Diabrotica virgifera
tacagaatcaggaagtagaaccagactggttggctggtgatagtaatctacaggatttacaagaacaggatatcagagacagaggttgtggagtatcttcaccgcatgcccaaaggagaatagtaggaggcgaggaagctggatttggtacattcccatggcaggcctatataagaataggatcttcaaggtgtggtggttctctagtcagcagacgtcacgtcgttacggccggtcattgtgttgctcgagcaaccccacgacaagttcacgtcacgttgggagactacgtcatcaattcagcagtggagccacttccagcctacacgtttggagtttcgaccatacaggtccaccccttcttcaaattcaccccgcaagcagacagattcgatgttgcagttcttcggctggaccgtgccgcacataatttactca

SEQ ID NO: 13929 - DNA, 267 bp, Diabrotica virgifera
  misc_feature (230)..(230): n is a, c, g, or t
  misc_feature (260)..(261): n is a, c, g, or t
ggagcagttcatacttttgatttcttacgatgtgaccaaaatattgtgttttccgttcttttattaaaagcataagctctatttccttgtttattctccgcaagacttctgagaatattctgagcattttacggtaacaccagaattcgaatgcttggattcttttttgtgctgcttctgtcattgttcaggctttaacacaatagagtacttaagtattctagttctcnaatgagataccctgggctggcagttggcanntagaac

SEQ ID NO: 13930 - DNA, 200 bp, Diabrotica virgifera
aagctgcattacactaatctgaacgtcgtcgtaattttgtttcatttgtgggtaaagttaaaactcatcaacaaatgctaatgtatccatcagtggcaaccggagtcaatagtaagcgcgggattgcgcgaaatgacaactgagaatcatcaaaacgttgggagaataatttcaaattctcataactggtgcggaaatgt

SEQ ID NO: 13931 - DNA, 440 bp, Diabrotica virgifera
  misc_feature (171)..(213): n is a, c, g, or t
  misc_feature (221)..(242): n is a, c, g, or t
cagacgcgtggggacctttcatccacttctgccaagaaggtgagacaggagctagaggagaaactagaaacaaatctacaatctagaaagaaagaaattgacgatttggtaatggaattcgtcagttcaaagcaggacaagaagaagggcggtaagaagaaggcagaatcnnnnnnnnnnnnnnnnnnnnnnnnnnnnnnnnnnnnnnnnnnnccttctgnnnnnnnnnnnnnnnnnnnnnncgccttctttgctgctggcttcttaccagtggaggcaaagaaaacatcagaagatgaatctgccaacgaacagagcgatggcgattctgaagaagaatattcacccaaaaaggcaaaaccagtcaagacacgcaaacttccccccaagaagaagaacggttccgaatctgactcagatgaagactggggcaaaaagaa

SEQ ID NO: 13932 - DNA, 410 bp, Diabrotica virgifera
ggaatacgagattgggagaatttttccaagtccattatagctttatgtgcgccggaggggagaaaggacaagattcttgcaatggagatggaggtagtcctttggtgtgtgcttttgatgacgacaaagacagatattaccacgcaggtatagacgcctggggcatcggatgcggtgaaaaacaaattcctgcggtgtatactgacttggccgtattcagaaattggatagacggagaaatgtctaagaagcgactgccgacgacgttttatgacagatccgatccttttatagcaaggattacaaatgggcagaaactctaagtagaaaacagccgacgaattttatacatacgatatttgcattgggttatacaatttaattttttaagtaatacacagacataatac

SEQ ID NO: 13933 - DNA, 428 bp, Diabrotica virgifera
cacacgcgtccggttcgctctcgtaaccattaccgtatctaagccaattggattgctgcattcgagccctctggtatatacctacaatgcaccattaatttacgctgtgcccgctgcggttcacgcaacctacatgaatgacaacatcatcataacattcgatgctgcctaatcaactcctgccatctatgcagatgcccttgtatataaatacatcgctccagtgcgctcgtcctgcagccgttatctacatctatcgaagtgatcacgacatcagtcctgtttatgccgcctaagcagcacactatcctgctatggccaactcagcacaagtttggagattaaaggattgacatactggtgataatttaggattatttgtttggtattgatttattatgcataataatattcagatctaagtatat

SEQ ID NO: 13934 - DNA, 369 bp, Diabrotica virgifera
cccacgcgaacgatttagttgaggataatcaaatattggttagtttcagcgagtaaaacttggttaatgaaaggtaaatggtattgtgcgagaatatttgatggtctatacggagaacagtttattttttgaccctgtgcttgaaggactattaattataaatgtatctccatattaatttcgaatttatgacatctacacaattacggtttttactgtcgactgtagactttggtcaattggtttgtgaggaaatgttactcgtttttcactatatcctgttttttaagatgtctcatcacttgatctaataacaatatagttacaattacatacttagatgttactggcaatagatagttttacgga

SEQ ID NO: 13935 - DNA, 455 bp, Diabrotica virgifera
cacagctttatcccacagataggtgtaagctacgagcaagaattactgcaaaggaaagaggaaaccattaaacaaggatcacaaatgcattgggtaaacgatcactctgacgaagatatcatcaagtatctgagatatggtaaaggacctctcagtactaccggtcttcagttgatcggttacctcaaaaccgaattctccagagacaagactgactaccccgatgttcagatattgattaagaaaactcatcccaaaggaggttgttaccacttcaagggagcaaacttaaaaaaagaactccaagacatcttctgcaaaccttacgaaggcttcaatgttgaaatagtcctcctacatccaaaatcgaaaggttttataaagctaaatgatgtcgatccataccatcaaccatacataaatcctatggccctctcagacgaagatgagtatga

SEQ ID NO: 13936 - DNA, 418 bp, Diabrotica virgifera
  misc_feature (275)..(297): n is a, c, g, or t
cggacgcgtgggcttgggtgaagaatgtgcgaaaacaatatacacgggaacatggggcataattgctccaggcatatatgtttatgcgataaaagtattcgaagatataaatctccctcttacgcaaggtatcttagtggcggaatttagttgtagtaactcaagatgttctttagcaattgttgcaaaatacccgatgaaacgaattagtgaattggaatctcggattaatcggacagaaatacgaggtttactagccaaccaaactaattccnnnnnnnnnnnnnnnnnnnnnnncgcacttgaatataagaaaagcctttttgatgacgtaataaattttggaaatttttctgaatggtattattatcacaattctaaacatatattgtatgtatgggagaaaagcaattttttc

SEQ ID NO: 13937 - DNA, 444 bp, Diabrotica virgifera
gataaattcgaggttaaaacctgtgttttgtgaatttctctatcattgtatccacgtgcaatagctatatttgtacagtgggaaaaatgagggagtgcccatgaacgagcgtataaggcgcgctgtgttttcctgtcaccgtgtcatacaaaagattggccagcgcaagtacatgtaataattattattacatgtacttgcgctgggcaattttctttgtgacacggtgacaggaaggtgcagcgtgttttatatgttcgttcatgggtgttctttcatttttccgactgtatgattctttgatttgatttgtagcagactataataacaacaatttgcaaagattgggtggaaaacattcagaacaacatgtgtcttttaccatatgacattgtatgttttaataaatttggaagtatactgtgagcaaaatgaaagaaatga

SEQ ID NO: 13938 - DNA, 430 bp, Diabrotica virgifera
  misc_feature (10)..(51): n is a, c, g, or t
  misc_feature (69)..(86): n is a, c, g, or t
cccacgcgannnnnnnnnnnnnnnnnnnnnnnnnnnnnnnnnnnnnnnnnnaccccggtccactaaccnnnnnnnnnnnnnnnnnnaagaatttaggtttatatctttaattattatggcttctcacggaaaagcggaaactgaaaaactaaagcaaaatttggagaatcagttggacagattagtggagcagctgcaggatttggagaattgcaaaaatgaactggataaagaggaatatgaggaaacaaaaaatgacactatggatcaacttaaggaacttaatgatagtttaagtaaattagtaaaaggagacatttctctaattagtgcactaagtgctgttcagctggctacacaagctgccatatcaaaggcctttaagacgccagaagtcataagactttttggcaaaaaagaacctcaacaa

SEQ ID NO: 13939 - DNA, 376 bp, Diabrotica virgifera
  misc_feature (217)..(234): n is a, c, g, or t
  misc_feature (329)..(347): n is a, c, g, or t
ccaacccgtcgggaattaccaaccataaatggtttggtccggtccccttgcggggttgcaaaaattcaaccttcggccctaaatttcaagcctttcaaaccattatacttaaacccaggtgcttgaaaaaaaggttaaaaggaattatggacaagacaattacagctaaaccaaaatttgaattcattcaacggaatccaaacaattttaccattgnnnnnnnnnnnnnnnnnncaaccggaggtaccttacaaccttgacaaattcggcaaattggaaaaaaccttcaacaccttattacccacagaaaaaattaccaaagtggtccnnnnnnnnnnnnnnnnnnncctgcaaaatttggaaggtaccttggaaa

SEQ ID NO: 13940 - DNA, 443 bp, Diabrotica virgifera
  misc_feature (388)..(389): n is a, c, g, or t
cgatgcttaaaaatatttcttcggaaatagtattttacgaagaaaacccttcaaaggaacctagtgacataatattatctagttcagaagatagattgtcaaaaagagaatcatcttctaggagtatcataagccctcttggatcaaaagcggccttcgggaagccctcagctgttttgaaaacgtattatgaccttatattacggtttacatctttaaaacaaagaagcatttcatcaatagaagattggatgaaagaagtaagcacttcattgctcaaagatgaatcaaaggaaggtagcattccatggctcaaagatgaaagagcggagattggcattccatcaatcaaagatgagacagaagaagatagcagtccatggctcannagataaacaacggagattgggattccatcaatcaaaggtgaaacacagaaagat

SEQ ID NO: 13941 - DNA, 449 bp, Diabrotica virgifera
  misc_feature (442)..(442): n is a, c, g, or t
gtacgaattggctaagaagtattctagggggaacttgcaatgctataaccacgttttgataaaagaagctgataagttgtttgcagatcagaaacatgagctcagtgcccaaagatatgcagagactgagagtagcttagaggaaatatgcctgaagttcattgaagctaaccagcataatgctttgaagctgtttttgagatgcaaattggacacactaaaaccccaagataagacccaaatcactatgatagtcatttgggtcatggaactgtatttggtaaaactggaacagatgcgtctagcagggttagaacaaacggcaacatatgcagacttgcagaaggagttcgatgtatttttagccttagacgaaatctcaaattgtatcaaaaacaataagggtactgtttataatctaatgagcagtcatggggataanaataacg

SEQ ID NO: 13942 - DNA, 410 bp, Diabrotica virgifera
  misc_feature (382)..(382): n is a, c, g, or t
acccacgcgtccgcctttgcggtcgtcggaaggtgttcatgagtttgtacccatttttaaataatagatcaattaaagtcgacaaaacgtgattagtttattatgttagtgaaagaccggcacgcacagataggtcaatactttaattctaaactaaatggaattttagtcataacaataaaaaatcatcgaattataataaaatcaaaattgttattaaatcagtttcgattagtgtggtagctgtaaaacaattgcaatggtgtttaaaggtacattctttggggtgaggcatgttcaaatatttttacttttttggctatgcctgatgacatatgccttgagattcaacttatctgtagcaatagttgccatgacacanaagacctcagtcaatcctgatgtaccgt

SEQ ID NO: 13943 - DNA, 429 bp, Diabrotica virgifera
  misc_feature (17)..(17): n is a, c, g, or t
  misc_feature (277)..(295): n is a, c, g, or t
gacacgataattgctangacgggactttcctaaaaaaatgtccaaaataagtggggggtggacaaaaaaagggacaattttttgaagaaaacaagggtgatcaaaaaaccggagtgtcaatgtggaccaataagaactttgggtgtttaatggccaacaagtaatgagaaagtgataaataaacattcttaacaaattcttaaatagtttttagtataaaattaaaggaataaatctgaaggctcgtgtggtaaatacaataaattattttcttacnnnnnnnnnnnnnnnnnnnagaaaggaaatctcttccgcataacaagtcaaaaatgataaggctgaaataatttgcgattgtttgaaagcaatatttgcataatcaagtagtacgtatcttcaagttttgcgtgtaaacaaattttgtaaata

SEQ ID NO: 13944 - DNA, 414 bp, Diabrotica virgifera
acaaaagtgcttttacctaccgtgctgagcatggcgaacgataaagtagcaaacgtcagattcaacgttgccaaaaccttacaacggatagcgccgcaattggatcaatcagtcatacagcctcaagtcaagcctgtgctagacaaattgaatgttgacactgatgtggatgtaaaatattcagcgtccgaagccatcatgggcattgctggttgagtaagaagaacataagaaaccacctttcttcaaggataagattaacaaaagatcagaaacaaagtaattgaaatattatacatattaatataattaatcttaaatagattgtaatatcacatttgttgtgctcgtttatttcaataaaaaacaagtgtaatatagcgtttttagcagtttagcaattataaaagatac

SEQ ID NO: 13945 - DNA, 414 bp, Diabrotica virgifera
  misc_feature (333)..(350): n is a, c, g, or t
aatgaactaatatcttcctttagaactctcgtcatgttttcaaactataggttagccttacagaggctcactcgctctgaagttgttcaaaaaataatagaatcttgccccagcctcttggaagatccagcagctatagccttaattcaagaccctgagttaatgttttacctatcaactccagagcaaggaaatgaaattatagaaaaacacccagtgctacttgaagcaggaagttatattgttgcccaggttcaacaggaacaagccagcttaaatccaaaccaagccggtaccagcacaggatattcttattctttagaagccctttcnnnnnnnnnnnnnnnnnnggattcaagttccgacactagtttttcacagaaccccttaacaaggaatacttcattcaatgct

SEQ ID NO: 13946 - DNA, 416 bp, Diabrotica virgifera
  misc_feature (263)..(280): n is a, c, g, or t
actaattgaaaacaccttatttaattttacagtatacttaaaaaccataaaatacatcttcgtacattgtcttcagttatttaatagtaactattaagtgctctactcagtggcaacctcacctttactttcagtttatcctttcattataaaacataacaaattcttcttttgtatcgataagtcctggtccttgtgcaatgttatagtccccaagaattttttattgtgttattattattagaatcctgttttgcattacnnnnnnnnnnnnnnnnnntagatctttagcctatgatcatcatttcatcacagacatcttgttttattgtgctgctgacacttctagtccatattttaactctatacagtaatatagtaaacaaattatatataccctattccatgaatatgtg

SEQ ID NO: 13947 - DNA, 382 bp, Diabrotica virgifera
  misc_feature (162)..(180): n is a, c, g, or t
atgatcacgagcgccgcacttttgtttctgtgcttctgaattttttcttctattattttcatcgtaaaatttggtaaatttggtgattttgttggtatgcgttgcttttttaatgctgtaagcgcacttgattgctatactttgaaagattttgaccgtttnnnnnnnnnnnnnnnnnnncacaaaatacgggtggaatttacgctgaccaaaatcaagaatcggtttttagcaaggaaggtacaaatgcaaagatggcacagaagacatgtttagacaatgtgccaaagctctattaaaagcaaagttcagtgacccgcatttaccggtttttctgatgtaactgacgtggattgctcaacctgtaaagctgatatttgca

SEQ ID NO: 13948 - DNA, 259 bp, Diabrotica virgifera
atgcagtagagcgtacttgctgcaggtatatagttaagaattgtctgcatatcacttattacaagatggtcacaaccccatctgtaagcatcgagttaggaatcacatactcctgtgtaagattcatccaacatggcaaagtagaaattagtgctaactcacatggttatacagactcaccaacatatgtggccttcaaacatttggaacgtcacatcggagatgcttgcaagaatcaagtctccatgatccccaaaag

SEQ ID NO: 13949 - DNA, 395 bp, Diabrotica virgifera
  misc_feature (246)..(268): n is a, c, g, or t
accacgcgtccgctttttgagagggaggatggctcaaatattattatttgatttgttttcaagcagtctctgcaaagaggtttgagtcacctctcaacgtccatctcaaaacagatgcgccctggactataatacaaaaaccgaaaattaccagctgaaaaaatgtatatacagagtgatcaaaacttttttctgtaaaatttacctaaaatacatttattaataagcttcaacaataataaatgnnnnnnnnnnnnnnnnnnnnnnnctcttatacagtatgtctgcgaaacttggaacgtattgataactttttttaatatcagttttacgaaaaaagttattctttataaaatactctgcatcgtatataacataagatgcaaccatcaaat

SEQ ID NO: 13950 - DNA, 412 bp, Diabrotica virgifera
acttatatgactgtatttgctgctggtttaatgtaaaaattagataaaataacacttatttctacaatgtctcgatattgttctatagcttcatgtcagaagttaacaagatcaattaaaaattcattgaacttgagaaatgattataaggaagtagttcaaatatgtttgcagagtaagaatgtaaagaatacgtccagcttttggaagataatattgaaaaatattgcgaaagtcaaatcaaataattcttcagaggccgttagtgttttttccaacaatattgctgatcagcggaatgatattaacaggaagactaataatccagaactattacacatagaaattcaaaaactatgcagtaatctccaaaagcatatttcgcagaataagccactagcatggtccacag

SEQ ID NO: 13951 - DNA, 414 bp, Diabrotica virgifera
accacacgtccgtctaaatatacgaaatggtttcagtgaaaatggttttaaaatggttttgcgttttagggttagtgactgcggcgaatgcatactcaacgaaagattcgaaagctattaatcccaaagatataaatcaatggaacattgtacaaattgtccctaccaatagtcagtccaacaacaattctccaccatatgctgcacctccagggttcgtttggattcaagcacctgcttcaaattttgcaacttctttaggaggaagccactctaactctaactccgaaacaaaactaccaaattatggtagtaataacccaataacaagtccagttacggaaggagtttctggatcaggtttaaacaaactttgcctacaaccaaaagggcaatttcccagtaaatcttgca

SEQ ID NO: 13952 - DNA, 388 bp, Diabrotica virgifera
aggagagttctggtcttgctcgaaatgtacctttttcaaggtcatgtcgtggttcagggtgatggatctgagcttggagccgtaacaggcttcgcagaccagagatcgctcgctgttgaccaagacatgaccttgaaaaagggagagttctggtcttgctcgaaatgtaccttgaaaaactcacttaacaacttagtctgcaaagcgtgcaagacggacaaatatccagaaactatgtcttctaggagtccgtctcctcgccacgatagatctaaaaggaatatggttaggggtgcgactagttcgaaggtggtgcaaagtactcgaagtatagctgtcgttaagggcaaagttaatatacttacagatttggatcacaattcaatca

SEQ ID NO: 13953 - DNA, 401 bp, Diabrotica virgifera
aagaagattttattgctgttacaaggtattttgcttctaggtcaatggatattgatctgtgcatacctattatacaccacgtttcagagtacttatataatgaactgggattaatacaatattataaccattacaagacacattttggactgaattgactattttttattaaggtgtcataacttaaatttttattgttaaaatctgtgagtctattcagcgatatgcggttattagcaacttctctgagatatgcagaaaatctgtatgatatttgatcatacaatgttttgtacctctggatattttgagcttctccaatgtgataactacagtactttactagggattacattattatacaaagtggcgtttaaaaccgttcaagttcccgtccgact

SEQ ID NO: 13954 - DNA, 366 bp, Diabrotica virgifera
  misc_feature (218)..(241): n is a, c, g, or t
  misc_feature (336)..(353): n is a, c, g, or t
ttaccaaattttattgaaagatatgtaattaccaatgttcagagaagaatcttaattttaccaaccaaacctttaattattggaccttgtgtatcacggactaatagtgcctcagtaaatatctactaatttccaattcacaacagctcaaattttacgatttttaatgctacagaaatattttacataacttttatgtaatgaaatgtcaatcgtcnnnnnnnnnnnnnnnnnnnnnnnnctattaactagctttaattactaacaataggtttcatacttaatatgtttagaatattacgtataaatacttttaaggatgaacttaaccatacnnnnnnnnnnnnnnnnnncttttaaatccaa

SEQ ID NO: 13955 - DNA, 219 bp, Diabrotica virgifera
acttagtcacagcatccgttatggcttgcaaattgtacaagcctcgtaagtgttagcataatacgttcccattgtattcagtctggtaggatgtctagtaacatttttggatgtagtgttaggtgctagtagattgaaaacttagttttttttacataaactagtgttcatcttgctcaactatactactatgtacagacacacattacttcatactgt

SEQ ID NO: 13956 - DNA, 257 bp, Diabrotica virgifera
  misc_feature (15)..(71): n is a, c, g, or t
aagatagcgagcggnnnnnnnnnnnnnnnnnnnnnnnnnnnnnnnnnnnnnnnnnnnnnnnnnnnnnnnnnttatttttgtaccgttcaacgaaacacagtgataaacaatttttctgttaatacagacacgatcattgtgggaccgttgtgtatcacgtatcagaaaatcctgatcatatacatattatgcccgaagttaaaattcctaaaaacatatggttcttataggtggtggaatattttaactaatttttt

SEQ ID NO: 13957 - DNA, 420 bp, Diabrotica virgifera
  misc_feature (2)..(32): n is a, c, g, or t
annnnnnnnnnnnnnnnnnnnnnnnnnnnnnnagtgcttcctcctgttttttattatattcttatcatcttatcgtaaatagttaatccacgtgtgcgttgatcgtaatccttcattcgtttattactactgaagctgaaacatataaaattaccataaatataaaatcatgttcaatccaactgaaataaaacaagaggttgatgagtttgagacaacttgcaaaaaagaaatggaggacgaagtagatgaagacaaagttctacaggatacctttaaagctgaaattaaggatgaacctaccagtgaaagtgtaaattatgatgcatttgattatgtagatgtcaaggaatgccatataaaagatgaaatcaagcaagatgatggtgtctcttgtaaagatatgaaaactgatgccag

SEQ ID NO: 13958 - DNA, 436 bp, Diabrotica virgifera
gaacttatacaaaaataaactcccagcttaaactatagcacagaaagcaagtgacatggatttgaacgttatttttcgcggtttttagatcaattccataagtaaaaatctcagccaacagaaagtacgaatacagaaagcatatttcttacaatatttgtaaatatttcaatagtttctgaagccaacatatgtttttaacgtgttcccaaaataggaacgttggaaatttaaaaaggttaaaggagctaaatactattatttgaacttcctctgtgtttgaatatgttgttaactattacctagcacttttcctgtccactaatcactaaacaaaatatctgtagtaatttctctaacccattatgtattttgcatgtccacagcacgtttaactaacactaacagaacgtttttagctataacaactcttgct

SEQ ID NO: 13959 - DNA, 177 bp, Diabrotica virgifera
  misc_feature (138)..(168): n is a, c, g, or t
tatagatccccaatcggaagctatccgtcaagcagtaggaagtctcaaagataagaaaaaggatgaaaagtctgaagacaaacaaaagaagtagtaggaccattcatagtagttttttcatttacatatttacgtacnnnnnnnnnnnnnnnnnnnnnnnnnnnnnnnggtatgctt

SEQ ID NO: 13960 - DNA, 352 bp, Diabrotica virgifera
cataagcaacagcctcaacaatatcatacaaagtgacagcaattgttgccttcttggtcgcatcccaagccgtagttaattctcgagctctctcgggcgaactccaggtccatttgaactccaataccaatccaagttccaatacaagtttgcagattcttttaacggttaatttaagggacaaattgaaaggcaaattggaaggccaattagaaggccattatcccgttaataatcccatgggaaaccttgccgtatccgttacaatggtgaataagccgacggatttcccaatagaatccaaactactctcaaagtaactcccgctcttaacacagcacttaatcaagtc

SEQ ID NO: 13961 - DNA, 415 bp, Diabrotica virgifera
gacaaaaatgtacaattcagaatacctttgtaaagatgaagagtttaataattttatggtaaaagttagtgaagtaaataatattgtacaaaaattggcttcaaaagataaacaaatacaagaaattggcaacatagaagcgcaaagatatcttaatgacgatggacagaatttgaatgtagacgataatgtagaattaaaagttaaaaatgcaagaacactgattaacaagaaagttctagaaaatgagcaaaaagatccaaatagcatgtcacaagaagcatttatgaaagaagttgaaaaagatgctgataagaggtacaaagataagttggtaaggaaagaaaaaatggaaacctttaaaaaacaagccacgcttgcattcagaagaagggaatttgaaaaggcattaact

SEQ ID NO: 13962 - DNA, 392 bp, Diabrotica virgifera
  misc_feature (21)..(40): n is a, c, g, or t
gtgacgacggaagaaaatttnnnnnnnnnnnnnnnnnnnntatagtaatctgtaatattacgaaatgctagacctgtttatttacagactaatctagagatccacgttagtatatatgtttgtatacagtgatgagcgcactaatgaccggaaaaatagcgcaaacgatggaaaacatatgaagttatgagataaaaagagatgaacttagtggaggtgttaactttggcgatggtaacttgtagattgacagtatattgattgtttccaacctttagacgtattggacgaatttgagaaatgccactgccacagtgacagttttagttgacatactcctctgatacgtctaaaagtgggaaacaatcaatataatgccaatttatgtgtta

SEQ ID NO: 13963 - DNA, 434 bp, Diabrotica virgifera
  misc_feature (3)..(22): n is a, c, g, or t
  misc_feature (186)..(214): n is a, c, g, or t
cannnnnnnnnnnnnnnnnnnnttatatttcaaatagtaatgacatacttccccagcgccctctatatatataattctgctaacaaatttgaaaaagtgtcatatgtcaaattcttggtacacagtaccggcacatctccatctactgaggccgaaataataaattgttggatcatattagttttnnnnnnnnnnnnnnnnnnnnnnnnnnnnnctcacgcttattttgttcatttcgcagctaaatattcaagcaaaattaaatgtattatagtctgcgacatgcctgtatttcacgttaagtcaaatgccttttgagatatgtgtttattttcagatgttcaataaagcctataaatttagtaaaattgatattttgatcggcaccaacaagtttcatacagtttgtgaggttttgttataaaaagctgaat

SEQ ID NO: 13964 - DNA, 442 bp, Diabrotica virgifera
agcttcttacaccggaggaattggcaacgctacagaactctggaagaaagacaccctagatgttttcctacaactagacgaacttttcgggaaaaactacaaatctacgacgaatgcgtttactatgttcggaagatatgacgacgaacatgacttactgttccacgatgtgacagagaagttgagaactgtaccgacccttaaagaaaacgatccaatgccgtttgtgtacgaaacctctttaaatagtgaccgtcaatgtttgatgtctggttcgagtaatactagatttacattttcattgtttttatttgtgacttgtttatatttagtttattccgttaagaatgttttactgtgagtcgacaatggcagcgcattgggcactatagataataaaagtttacaaggaaggcgagcgtctgttcgttttgcgattgtt

SEQ ID NO: 13965 - DNA, 434 bp, Diabrotica virgifera
  misc_feature (346)..(346): n is a, c, g, or t
gaaaagccctattggtttgttttttgtttcgttttcataatattatgataataactataatgatagctaatttattacattcctccgtttgttgaaataactaaacatttattgtgtcattttttgtttcctaaacaaaggcagaataagtatacaaaattttggattgaagaagtggtcttttaaacaccagcagttcccttctaccacagagagaataccccaaccaacgggtattctgtgcttctacatcttaactgaaggcagatggcccactagattattatatggttgcaaagttattttccaacttcatacaaacagtgagtgtgttgtatttatgtcncctatttaatagtttttgtcaaatttcaatatttttattcagttgatttgtataatatggagtttaacatcgaaatttgaagaaaatt

SEQ ID NO: 13966 - DNA, 429 bp, Diabrotica virgifera
  misc_feature (389)..(409): n is a, c, g, or t
cattttcttaactacacgcttaatttagtagtcttcttactgatcatcatcacatgggttaaatagttctgtataggcactgcttttccttcggttaatctgtttgacttttttctatttcttggttaatgttcttattcatttttaaatcctgttaacagaatatttccaactttatttatttcctttcgttttttatttctatgtagctttaactcttgcttactcgacatgcatctcagttaaattgttgacaaacctgttttctttgatatatcctattagattttctagcagttgtattaaatttaagtactattctccgtcctctttgttcctgatttcttgaccatttttacactatattgattcattccggcagttctgcnnnnnnnnnnnnnnnnnnnnncctttaacctctacatgaaa

SEQ ID NO: 13967 - DNA, 432 bp, Diabrotica virgifera
cacacgcgtccgatgaatggtagctgacaatttcggaaatgcgtcacttggccaaaataatcttcgaaatcatcagaagacatttctgcatgaaactctttcgtagagtttgaaataaattccaacaaatcgtttatctcctgcaatatgagtgatattcaaccgaagacgtttaccagttggaaattttaatccagtagccaaacgttaagtacatttctgacgagcatatgaaacctgtttatcatgccaatatattctacttttcttacaaaatgtacttcattaatccatttcatccagataaaaaatattacctttccttatgaaaaaatattattaggtgatattaaatttcacctacaaattatttgttctttctatataagtacaaattttctatcgtgcttcacccaaataaagtctaatttg

SEQ ID NO: 13968 - DNA, 415 bp, Diabrotica virgifera
  misc_feature (384)..(402): n is a, c, g, or t
gccgggcaacaaagatagaatttgtttgatttgttgatgttttctattttgatgacgatttccgaagtggaggtcgaagcgtaaaatatatataatttcaaacttaaattgtggctttattcccaaagaaaatagtaaattacaaggaaatagcttccgaacaatatttacaaatatagataccgttgatgtatattcgaatcgtagtccgttcgttgcaatcaacacaatagtgccttgtaacagtaagtacataattttagtacaagttattacatatgaagatgcgaaaaagattcataagccatctctttcatcgtacatatgtgtcatatgtcatgtcactttagacgaatatggcctatcaaggaccaacacgtcgtnnnnnnnnnnnnnnnnnnnacaacattgatat

SEQ ID NO: 13969 - DNA, 430 bp, Diabrotica virgifera
  misc_feature (371)..(371): n is a, c, g, or t
caaacctttaaagataaagaatataggatacatgttcatagtttcatttgtgatgctccagctcgagcctttataaaatgtataaaatcgcacaacggttattcagggtgtgataaatgtactgaagaaggagactactttaaacataggatgatttttaataacattttggcaccaaggagatcggatcagtaatttttgctaaaatctgatcagaatcatcatactggaatttcacctttggaagtcttaaatataggattggtttcaaaatttccaattgactctatgcattgtttatacttaggtgttatgaaaaaacttcttctcacatggatatgtggtgacttgcgtgttcggttatgtggtanggatgttacaaacatatcagaaaacttagttttttatggaaaatttgttgtctcagagt

SEQ ID NO: 13970 - DNA, 152 bp, Diabrotica virgifera
  misc_feature (11)..(113): n is a, c, g, or t
acccacgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggggggccgctcaggtggttcctgtcttatttaggct

SEQ ID NO: 13971 - DNA, 209 bp, Diabrotica virgifera
cgaactcttggacggtctccaccgaccaacgcggtagagcaaatcagcacattggcgtatatttgacaattgtagtgcaatgtatgcagttgtgtaaaatagagcataccgcagaccactaacagtgacgtcaccgatcgatacatcagcgccagattattgccgcaaatcgtcagcaaacttatataaacattatcttccatgttcca

SEQ ID NO: 13972 - DNA, 424 bp, Diabrotica virgifera
  misc_feature (20)..(32): n is a, c, g, or t
  misc_feature (35)..(47): n is a, c, g, or t
  misc_feature (226)..(258): n is a, c, g, or t
cactatttcaaattaagtcnnnnnnnnnnnnntcnnnnnnnnnnnnncacggtttgattattttttagacactcaagtaagtttagagaatattttaactgtagtcttgagaaaatgtagttaaaatgtagttgtttttgcgtattagttggacatagtccagtcaacatacttttgatctctataaacgcgacgaacaagatgaattttgctgagaatgtcaatnnnnnnnnnnnnnnnnnnnnnnnnnnnnnnnnncccgggcttccccctaaaactttcctcgtagggggaacccttctataagataaaatgtttggtttcaaacaagaagtgcagctgagataattttgaacaaaaatgtcaaaattggcactttttgggtagaatgaacagttctctcataaataatgcttgaagcgac

SEQ ID NO: 13973 - DNA, 431 bp, Diabrotica virgifera
  misc_feature (408)..(408): n is a, c, g, or t
aataccggagataatgcggacttcactgactaaaatagtattagattcaaaagctttcagtaataatatggagacaatgacattcatgaagactctaccaaccccacccgaagaaagtaccgtttctaaagcaatagaagaattaaaggaactggaactactagataataatgaaaacttgaccccacttggtaaaaggctagcagagtttcagctagaaccaaagctggcaaaaacattagttaattcttatatattcaaatgtctctctccaatagtcgatattgtcactcttttctctacggatgttgaattattctcatctggtttaattgacaaagaaaccataaaagaaataaaaagcgagttttctaaggacagcgaccatctagctatgatgaggatgtntgaaaaatttatggagtttgatg

SEQ ID NO: 13974 - DNA, 437 bp, Diabrotica virgifera
aattaatttcattaaatctatctaaaaaaatggaaatatttaatgaagcccagcggcaaaactcaaagtttaaatcagtgtggaatcaaattgatgcagatccaaaaacgagtgatagacttctatcaacatattcacctgatgaaaggttagcaatttatgattattgtgtacaaagtacacaaggtccaccagtaccagaagaaattagtatgagcattaaagaatcaaacagaaaagaagatacaacacccactgaagaggaggcattaaaaaaacaacgtgatgccaaacgacgcccagttaaatataaatctgtacataccagccgcaacaaaagttatatagaagttatgagggaagttattcaaaatcaaacagatatgtacaaggattatttaattgaaaagcaaaaagaagaagaggcaattgagcgt

SEQ ID NO: 13975 - DNA, 427 bp, Diabrotica virgifera
accacgcgtccgaaaacatatcctgtcattaaattttatcttttattcaaaattacaatggttattatctaaactagtctaaaaatgtcctattatttaacataatgcaaaataaatataccacgaaacctgatactgctatagagaaaaacaaacaactattacttcaattggaaatggatgacgaggtaaaacaaattataaattatccagaaaaatacgccgatacatttttggacgttactgttataaaaccggttaataacaaggagttcactagagaaaagaaagtaatgtctggtaatcaagtaaagcagttcattacttccatgaatttaaatgaagatctactaccgtctactcatgaagaaaaatgctcaggtgatagtcgtagaacttcaaatcaatctccaccaaacagcagaaa

SEQ ID NO: 13976 - DNA, 356 bp, Diabrotica virgifera
aaagactcttcggctattgaggattacacatacgtctcatcatccatgtcccattcactctgatacactacttcaccacacccacatagtcttcatacacgtccgacatgaaggaagtcgtggtagtggcggccaattttatcacgtcatcggttagtccggatgcatcgataacagttaagttgtatcccaaggttgtccaagtggtggtgaatttgtcagtcacagacacagttggtacagttggatcagcagatgcatcaatgtgtgcagtcatcgaatctagatcgggcactcaagtagatatagcgtacatctaacgcacctcactttctaactggtggaatcttcttcct

SEQ ID NO: 13977 - DNA, 376 bp, Diabrotica virgifera
gttaaacatcaggagtatgtcgattgctacattgattatacaaagcttcggtattttgacatgggaatgaagacagtgactcagtggatcagttatgtgtaaaaatctcgacatacgttacgtcgagaaacacagacgtcaagtagatattttcgacttctatactgcacatgatcaactgacgatgtcgatcacaaactcaatctatgctaatagtcagttcaactttgccacagttggcttaatttcgacaaatgtgccgtgaaacatttgtgaatattcattgacatgtccagcatgtgtcgactcaggtaattatattgcatattataattgacatattcaagagtgatgtgcactgtaatgatgattgata

SEQ ID NO: 13978 - DNA, 382 bp, Diabrotica virgifera
  misc_feature (30)..(51): n is a, c, g, or t
  misc_feature (118)..(139): n is a, c, g, or t
  misc_feature (150)..(177): n is a, c, g, or t
  misc_feature (314)..(331): n is a, c, g, or t
aagacgcttacggaatagcttaaaaggatnnnnnnnnnnnnnnnnnnnnnntagataaattttatgtagagatagttacatagtatagtgtgagaatatattaattttaagaaagtannnnnnnnnnnnnnnnnnnnnntgtatcatggnnnnnnnnnnnnnnnnnnnnnnnnnnnngaaatgcggatttaaatgagcttaaaaattatgagttttaaggtaaaatatatatgttaaataattgatttgggcagcaatgttatcacctgttaaatataaccaagtctttatgaaatacattaaatttcactatnnnnnnnnnnnnnnnnnntatggacgcggaaattagaacgtgcaaatgtatcaagggatgagctttttt

SEQ ID NO: 13979 - DNA, 69 bp, Diabrotica virgifera
catgttggttttgtttgttgttttcgtctttttggggatctgtttgggggttcggttgggtgggggggg

SEQ ID NO: 13980 - DNA, 282 bp, Diabrotica virgifera
  misc_feature (6)..(6): n is a, c, g, or t
  misc_feature (14)..(14): n is a, c, g, or t
ctgtgncaggtgtnggcgctattgttatgtcatactcaggtcaacatctatgtctcctacatatgatgcctctcttgacgatggagggttcacatatggtccttgagatatacattggagagtttttgaggttcaatagtattaattaatgttacatcagtatttatatttgctgtttatgtctacataggtattctcgccccttcggattagtttgtcgatcgatggacacaccaccagtcaacgtctataaatgacactaattccctagtcatcgttctt

SEQ ID NO: 13981 - DNA, 437 bp, Diabrotica virgifera
aaaaactggaagaagtagagaatcctcaccacacccaagagcctttactgaaatagatactagtaaaattcaaaatgtacgaagaagtgactctcctgatgtcaaagcagtagatcaaaaagtcgaagaaacatttattcatagaaatgtgtctgaagaagtagtcgaaacgaaagaatctttacctaaaataagagaatcaaagcagatttctccagttgaaatcggtacatttatcgaagaagaaagatccgctatattaaaggaaaatgatcacgtcgtcgatagttcttgggtcataatagaagaggaagaacttagttatataccagaagtaatacgacctgtcatttggttgaacagaacagatagatgcagatactactgaaaaagatgaacctacacaagttaaacctgaagatagtttacctgaagat

SEQ ID NO: 13982 - DNA, 428 bp, Diabrotica virgifera
  misc_feature (3)..(64): n is a, c, g, or t
  misc_feature (139)..(159): n is a, c, g, or t
  misc_feature (268)..(321): n is a, c, g, or t
aannnnnnnnnnnnnnnnnnnnnnnnnnnnnnnnnnnnnnnnnnnnnnnnnnnnnnnnnnnnnnctgacgattattacttgagtctacacaatgccatccacaatgaagatccagaattgtatgagtgcgtggtatgcnnnnnnnnnnnnnnnnnnnnnagcagaacgttgtacgagcatataatcgaagagcatgaaaaagagggaatgtattgcaatgaatgtgacaagacgttctcatctcagacatggttcgaaagtcacaaannnnnnnnnnnnnnnnnnnnnnnnnnnnnnnnnnnnnnnnnnnnnnnnnnnnnngctaagtttactacgaactattatttgatgcagcacatgcaagaatctcacaccaaatacaaatgcaatgagtgtgatgtaacgtttccctacaagcaaaatttaga

SEQ ID NO: 13983 - DNA, 134 bp, Diabrotica virgifera
  misc_feature (106)..(127): n is a, c, g, or t
cgcgtgggtttatatttttgatacgttatttgctgttttgtcgagtcagactgtcaaataaatcatacaggtctaaaaaaacacataacaattcggaaactgttcnnnnnnnnnnnnnnnnnnnnnncctgcac

SEQ ID NO: 13984 - DNA, 434 bp, Diabrotica virgifera
  misc_feature (316)..(333): n is a, c, g, or t
gtgatcatcaaccaagagggcctacgcaagcctgcttctgtgtttcctactagttgaattagtaacttcagagataaccttcatagagggtaagtttagacgaggtcctgtattcaaacatcacagaagtcataagaagcatatagtaaaatctagtggctctacgttgaggctcagttgtgacgcttctggaactccaacacctaatataacttggtacaaagatggtttatccccactcccacgtagacttacaccaataaaaacttacaaatggactttggtattagaagatatggagaaagaagacgcaggnnnnnnnnnnnnnnnnnnttgtaatgaagtaggttgtaaagacttacaattcgacgtagaagtaaatgagcgtgaacaaaatacaccacgtctcgttaaagagcttcacaatatgaccg

SEQ ID NO: 13985 - DNA, 414 bp, Diabrotica virgifera
  misc_feature (26)..(40): n is a, c, g, or t
acgaaaaaccagccaaaattgtgtcnnnnnnnnnnnnnnngagaaaatcgggagaaaaaagaaaaagtgggggaaaaccgtatggtaaaggtgatagtccagtggtggcagcagttttggacgacgtcaagagaatcaaagtcgctggtccaaaggagggcagactgtacccaaatctatcagacattgaagcaactacagagaccgaacctgaaacatacacgaggtcaccatcgcctgacaacagcaacagcagttttgagacaagtaataattcggacgatcctaacactagttttggtcgcgaaattatacaggcagtgtgtaagaatcagacgccacagaaaagggcgatttttgatgagagtactgccagcgatgtatccagtatattagacgatatggacaattatc

SEQ ID NO: 13986 - DNA, 420 bp, Diabrotica virgifera
taaccacgcgtctgctcaaaatatcacaaaaatgattacgtgatttcgccactaaagtttatgaattgcaatcttcttgaattttacgaaacatttttgtttctaattatttttattagatttattttagagttgctgattatatttttggctaaattttgtcataatactagttacgtgcaatattttgctattagaatgtagaaacaatgtgcctttcgcgatttacattgtttggcctttcaaaacgattgaaatattttacttcgccactttacacatatctgtaaacataaaatcgtagtaagactgcacattagaacgcaataatcaatcagtttttatagaaatcagcacatgaatttattgacttttgtgtaaatatcagaggaatgtcaagtacgactaacggatgaactc

SEQ ID NO: 13987 - DNA, 150 bp, Diabrotica virgifera
  misc_feature (4)..(4): n is a, c, g, or t
  misc_feature (6)..(6): n is a, c, g, or t
  misc_feature (15)..(16): n is a, c, g, or t
  misc_feature (18)..(18): n is a, c, g, or t
  misc_feature (20)..(20): n is a, c, g, or t
  misc_feature (24)..(24): n is a, c, g, or t
  misc_feature (33)..(33): n is a, c, g, or t
  misc_feature (53)..(53): n is a, c, g, or t
  misc_feature (67)..(67): n is a, c, g, or t
taangnggtagaganntnanaganggtggaggngagaaaggggaagaattgangagagaggaagtanagtttagtattgggaggtgttaggaatggggtagggaaaggtgttagatgtagtgtatggggagatatattaatgtgttgtgg

SEQ ID NO: 13988 - DNA, 428 bp, Diabrotica virgifera
agaggaacaaagatgtagaatattatgattaaaactcaagagttggtgatacgaaagtattgaccactggaattttattgaaaggtacccaatatgtcttttgtataaaaaatatgactaagttaaaattttatcgattttttattcgatatttttttagattattttaaatcgataattatatcgattaaaaatgtaagatagactataaaccaaattgggtcatggcctcctgcaattttcgcccacattgtcgatcacgtgtcgctgatctttaaattctgactgtgtatcaattatcgcattgttctctcatttaatgttcttggttgtattttagtgcacagtgttcttctttacaatctgtccttctaattatatactacatggcttgtccatgggactaaggagattagcgaactctggtg

SEQ ID NO: 13989 - DNA, 365 bp, Diabrotica virgifera
taaatttagtcgtgttaccgtttggctctacacaacggattcctaaattgtcagtacctacaatgtctccatacattggtccgtactgtctaagctttggactcggtacatggttggttgctcctgaatgactttaagatactgtcaatttctgatgtgtgcttggttatctcatgtacatttgctcatagctttactggaactcttttgaatgtagccaaggttaagtatcattcgttcaatatataactgtcaagagacagttgctgtctgtcattctcaaatgatgcaatatttttcacgattaacatgtagtagttgatcaggtacagaatctttaaataattttgggcttgattattgtt

SEQ ID NO: 13990 - DNA, 258 bp, Diabrotica virgifera
atgcctgattagcactgtgaatcggttgaaaaattaatttattgagatttatcccgctaatgaaatctcataataatatttttcccgctgaggccactcttacatattttattactcaagctttaacttctgctattgtattgttttcagtcttttagctttaaattcttcagattttattttaagatcttgaattttaagatataatttaatcctaaattcagctttaatagcacaacttggagcagccccctttca

SEQ ID NO: 13991 - DNA, 418 bp, Diabrotica virgifera
acagtgtacatgttatgtgtggtccacatcagcattgtgagagtttttaatcagcgcgttgtcaaaatatgttttcaaagttacgtgtcgttctttcgttgggagatgtcgtactgtaccaaaaaatttcttggaatcagtaaagaaaaattgacaaaaatttcgtgtttttgacaagttgtttctttatccaaaattttctcacaaatagtgtacgtacacatcgtgtttttacagaaatttggcaaaatttgaggtgttacactctaataagggctatatacatctcaacatctcgataatatatacagtgttgcacagtatagcaatttttatccttgtacataacattttgttgcatatattccttttcctgcttctgtgacctaatcagaaagtagatgcagtgtttttgttg

SEQ ID NO: 13992 - DNA, 438 bp, Diabrotica virgifera
atattgtctctatgtatgtggctctatacgggcatttggaactaatgtaccttttgccaagccaaaaagtttttattgaattttacgtgtaattaatggtatacagccagctacaggaaattcttccatgtgacttcatgtgacttttgattgacttttatatcagatattagacgataatggtttgggtcgatatgtcgttattgtgttgactctcttcctgaatctcttatttactggactataaacaatctgatttctgatatcatccattcatacgtatacatttttgtcgccattctctgatgtcctatcactctcgacgactacatacagggtgtttcattgagaattgtccatacagttgctggaaggaccttggcacgaagtacgaggattggacttataacacctggataaaatgtggttccttaccgg

SEQ ID NO: 13993 - DNA, 367 bp, Diabrotica virgifera
  misc_feature (298)..(310): n is a, c, g, or t
  misc_feature (312)..(326): n is a, c, g, or t
agaataattacaaagatattattttcaaatttaatcgtgcgcaataaatggtatttttaatgatacctaaagatatcaagtcgtttttatagtaagtgtatgtaaatcgtctttatgtatctcaaattgtttctgaaataaactactattaggtagcattataatatgtagatattatatatttctagattattcatatgcaataattttacggatgatctgaaatgtcatctatcattaaaattaagtttttaaaggactgattaagataaagatctttcatacacaaatcataggnnnnnnnnnnnnncnnnnnnnnnnnnnnngtactttttataggttttttattacaagagataattaaatt

SEQ ID NO: 13994 - DNA, 383 bp, Diabrotica virgifera
acaaacaaacaatcataaacaatgacgcgctggtacattgatttttgtccgtttcagaactctttcataaccaaaaaggacgatatgtacttcaagatgaagaaactaagggatatggagtgtgtaaaaatgaaggaagcctctagtgccttgtggatgatcaaaaacagtgccaatagcagctgggtggaggagttattagcggagagtatccttctcgaaacacagctaaggtacaaacttatagttaacaaaatccgagaaagcaaagacatggatataccactcaaaacaaggaaacttacaggatcggtcgcgttatcaaatctacagtacgacataagagaacaagacaagaaaacaagcgattccacaacatttta

SEQ ID NO: 13995 - DNA, 196 bp, Diabrotica virgifera
aacagtctgatctaacctcgcttgggcattcgcagtcccaccatctaatccttactgcttttggccccatctcggcgacgctccgtgctcctggtggtgggtgatggagactggtgcttcccggtggggtatcacagtcggttaatgtgcggtcgattttggcgagtcaggtagtgtgtggtagtgatttcagatg

SEQ ID NO: 13996 - DNA, 213 bp, Diabrotica virgifera
ttcatggttcaccacttcacatgagaggctaagcaactacgatgcagcatacaaaccgtgtcaacggctgaatagactgctgcagcaggcacaagcccaattcagaaacgattgtgcggattataccatggatgcaatcaatggtttagactcaggtgacatagttgcgactccattttggggatcccagactggttcaaaagtgacctggat

SEQ ID NO: 13997 - DNA, 363 bp, Diabrotica virgifera
  misc_feature (72)..(72): n is a, c, g, or t
aaaaaccttcattataagtggtaaatatagctaccatgtacacttaaagggttaatgagacagatgctgtanggttaatgagacaaggaaatttgagagtaggtaaaaacaaaataagaacactgtgtgatttctgttatagacgttggcggaaggatcatacaatagtaggagagagagaaggaggcaagtcgtatatcgagacaggtctgtgctaacctgcgtctatagcttcaaattaagatatatttttcagcaaatattgacaaatacactaacggtgttcgttttcatagtttttaaatcacataataatggacaaaactgttaacttcttgacgagccgatattttagaactggta

SEQ ID NO: 13998 - DNA, 372 bp, Diabrotica virgifera
  misc_feature (54)..(130): n is a, c, g, or t
aacgtcgtaactcatcctactggagtcgcattcagcgttgcacgaccatcacgnnnnnnnnnnnnnnnnnnnnnnnnnnnnnnnnnnnnnnnnnnnnnnnnnnnnnnnnnnnnnnnnnnnnnnnnnnnnnctgctagattgttgttgatcccatccaattcgagtttattcacaagactggttccacattaggcgagatgtaccaaattagggaatcacgtatggactatgaaagggattatacggtatacccggttggctttcaacgtaagagacgccaagacatggtgccacacttacagatatcttccgtcagtaatcaggcacccctgacgtaaccacattctacaaccttcttaacatcatctagat

SEQ ID NO: 13999 - DNA, 399 bp, Diabrotica virgifera
  misc_feature (3)..(3): n is a, c, g, or t
agncgtccgcttaactatatcttttattccacggtacatgcagcaaggcagcaagcacgtaccatcgtgtatcaaccacgctgtataccaagttggcccttttagtatacaggactagacacggggaatgttaacaatggattgactcccgactttataaataatggtacatacagaagttttatcgtaaatcgacggcatcgctattttatgtcacgtaatacagtagccgatgccgcggcatcagctacttaaggcaggtcacataggaagagtggacgataaccgttggactatacgaattgttgaaatgggacaagagaaagggggataagtacgtgcagaccacataccagacctcttgacaacatcaagcgaccgactgttccaccatggatg

SEQ ID NO: 14000 - DNA, 411 bp, Diabrotica virgifera
  misc_feature (31)..(53): n is a, c, g, or t
  misc_feature (157)..(175): n is a, c, g, or t
  misc_feature (199)..(221): n is a, c, g, or t
acgcgtgggtaaaaagtagataaaaatagcnnnnnnnnnnnnnnnnnnnnnnnttcgtattttgagatagaatctcacacgcgactatcgacgttacagaagtgagcgtgactactccggggttaagagcataagcgtaaaatttgcttgcaatacnnnnnnnnnnnnnnnnnnncttttttcgaatcctgaaaaaacnnnnnnnnnnnnnnnnnnnnnnnaaaagctgattgaaatattacaatattaccgagggccgaaagttcctaagaacaaacaaaaggtttcttttgaataagatatttgaaattaagaatacactcaattctcgcgtttttttttcactctgtaacctattcatataaacattatagtgaatttcagactttcggccctcgaaaataatataat

SEQ ID NO: 14001 - DNA, 353 bp, Diabrotica virgifera
gctcagacgtcactggaactgatgcgtcaggcaattgtgggtataacctgtgtctccaaaatgatatgtaaatgacgacgttggcatctcttattctgcatgagaatcaccactgttcgaacaatttcagcttcagagaaatcggtatgttatcgtcagcaaatacctttttaagagcttcacatggtacccgtcgtggttcgagtcaacttgaagtcgcagctgtatgggtagtgttgatataggcatgctgtctaggagtacattcattggagaatcgggatagtgtcatatccgatggtcatcatcagcaatgggcatgaatgttccttctacacataggtttctagttg

SEQ ID NO: 14002 - DNA, 405 bp, Diabrotica virgifera
aaaaaaaacaacagttggtttaaaccaagattttaagcatgttggtttaaacctgctaaccctggtttgcggacagtaagagtaaaatggggtggagagtcatattgttgaaaataaacagtgtgagcagttccctgaactctcaagggcggttcatgcgatgaaacgccgtcaaacattgggcacgttcaccagaacgttcaattttgagtgcgctcagcgctttgaaactgtttaagctttttctggtcaatgtcactgaatttaagctaaacttcaacgttttgacaaagccgtcgccattttattcagcgtagatttacatcgcttaatatagataacgtgtttaggaaatttattgtaatggcgcgctaattgaaaatatttacttttacaataatttta

SEQ ID NO: 14003 - DNA, 384 bp, Diabrotica virgifera
tacgctcgacgaggcaggggggctcgccacgcacgacaacgaagaattttgctatgtgctgtcaggcgaactggaactgcatttcgaacagggtgaaccgacgctgttgcgggtgggcgaaagtgcgctgttttcgtcgcttcggccgcatgcatacgtggcgccgggcggtgccacactgctggtcgtgctgacccctgccggatacgcgcaacagaaacctgctttaccgtaacgcgtcccggcatacccgcaacgccgggtggcatcccgcgcccggcgctcggcgctcgataacggcacgatgcatcggaaggcaacgtgcgctcgaacggtatgtgtcgccgttccgtgtcgccgtgagtcgtaccggcgcgcgccccg

SEQ ID NO: 14004 - DNA, 55 bp, Diabrotica virgifera
acgcgtccgcgacgagagggctgtcggccacgtcgtgctccgtcgaggcggcgtc

SEQ ID NO: 14005 - DNA, 274 bp, Diabrotica virgifera
gttaaaaatgttaaatttttttataacaaccgaaaaagatcggcgagaggctgccataatagagcatcgtcgtgctatgagaagaagaacgagagcaaagaatcttcaatcgccgtgctagacttataggaatcgacgcgctagcattgcagcaccatgtagaagagaagagcatagaaatgacgaagaacgacacattgacaggacaatcaaatagcaacgtagcaggtctgacgaagatgcgatggtaggtgagcatatggagtgtgcagaa

SEQ ID NO: 14006 - DNA, 287 bp, Diabrotica virgifera
ctcccgggtcgacgcgaagacccacgcgaaggtctgccagaacgagctgctgcgaggcgactgatggcgaagccgcacaccgtggtcgtctacggcatcccgaactgcgacaccgtgaagaaggcccgcgtgtggctggacgatcacggcgtcgagttcgaattccacgatttcaagaagctcggcgtgagcgccccgctgattgaagactggctgaaggacgtgtcgctcgacgcgctcgtgaacaagcgcggcaccacgtggcgcggcctggacgacgcgatgaa

SEQ ID NO: 14007 - DNA, 397 bp, Diabrotica virgifera
  misc_feature (51)..(72): n is a, c, g, or t
tacacacgcgtccgcaacaacctactgcgttttagttcgcggttttgagcnnnnnnnnnnnnnnnnnnnnnncgcgaagcaaactgttgtgaggttagaggttagtggtatcttgctaaatcaagtttgaacaatagtaaatatttaatcagataattaaggaatacaaattattctaatgagcagttttggatagtttaatggtgattagtataaagaaacatttgaaggtgtgaagttataggtacacatattaaacaagaataatatacataaacagataattcaagatgaagcacaaatatgggcttgtcgttctactgatttgtctgccagtgatactgagtataagagttcctcccaatccatgccctaatatgtttcactactacaaaga

SEQ ID NO: 14008 - DNA, 322 bp, Diabrotica virgifera
  misc_feature (2)..(179): n is a, c, g, or t
  misc_feature (181)..(204): n is a, c, g, or t
  misc_feature (207)..(242): n is a, c, g, or t
  misc_feature (262)..(309): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnacnnnnnnnnnnnnnnnnnnnnnnnnnnnnnnnnnnnnatcaatttacattatttacnnnnnnnnnnnnnnnnnnnnnnnnnnnnnnnnnnnnnnnnnnnnnnnngaaatatatacgt

SEQ ID NO: 14009 - DNA, 329 bp, Diabrotica virgifera
tatttgggtacttcactgaacaacattcggtttgtgatttgacacatataagcctagttttcgtatagctatagctctgcatctgcataagtatatagcccagacatataacagcagttttttgtcagttttttacatgttagatttttgcaaaaagtgtttttttcaggaaaatactcacatgatgagttgtatgtatcaaaacgtctgggaacatggatactttgttgcataatgaacaaaatagtcactcgtcaataactcgagaagtgtagacttggtgaggaaactcgagggaagataactggatgtagatctgggcactttaa

SEQ ID NO: 14010 - DNA, 410 bp, Diabrotica virgifera
  misc_feature (225)..(245): n is a, c, g, or t
aggggcaatggcggtcgaaggaatgaaaacagaaggccgtataatagacggcctaatagaggacgtattaaggagaggcctaaatatgattatgatgacgaagaagaagatcgatttgacgatgaagaggatgttaatagcaggcgaagaaaacccatcgataaaaataaaaaatctagttccagaaaacgaccatcagaagaaaccagtgaagaaacagtatcnnnnnnnnnnnnnnnnnnnnnagacacaagaacaattataaaaccagtcagtggaaccatatatgaccgaccacgggtagcgcccaaaattaaactaccagtaccgaaaaatgaagcaaataaatatgcttacaaaccatattcaacaacaaaagttactcaaaaagaaaatgatgaatatgaaaa

SEQ ID NO: 14011 - DNA, 395 bp, Diabrotica virgifera
  misc_feature (14)..(49): n is a, c, g, or t
  misc_feature (58)..(77): n is a, c, g, or t
  misc_feature (93)..(136): n is a, c, g, or t
  misc_feature (156)..(187): n is a, c, g, or t
  misc_feature (203)..(224): n is a, c, g, or t
  misc_feature (226)..(258): n is a, c, g, or t
  misc_feature (271)..(289): n is a, c, g, or t
  misc_feature (298)..(320): n is a, c, g, or t
  misc_feature (324)..(372): n is a, c, g, or t
agccaagcgtccgnnnnnnnnnnnnnnnnnnnnnnnnnnnnnnnnnnnnggaaaagtnnnnnnnnnnnnnnnnnnnnggaagttaattagaannnnnnnnnnnnnnnnnnnnnnnnnnnnnnnnnnnnnnnnnnnnggaacctggggtaccagggnnnnnnnnnnnnnnnnnnnnnnnnnnnnnnnnccaaattaaaagaagnnnnnnnnnnnnnnnnnnnnnngnnnnnnnnnnnnnnnnnnnnnnnnnnnnnnnnngaaaggtaatccnnnnnnnnnnnnnnnnnnnttttaaggnnnnnnnnnnnnnnnnnnnnnnnccannnnnnnnnnnnnnnnnnnnnnnnnnnnnnnnnnnnnnnnnnnnnnnnngggagaaccttaaaattaaaatt

SEQ ID NO: 14012 - DNA, 67 bp, Diabrotica virgifera
  misc_feature (3)..(23): n is a, c, g, or t
agnnnnnnnnnnnnnnnnnnnnncccaccccagacttaaggtgttacttcgtgaaatcggttatatg

SEQ ID NO: 14013 - DNA, 333 bp, Diabrotica virgifera
atctacctttattatagctgaaactattattactataagattgtcactttggtaaagatatattacgttcaattgaggatctccggaacatgtttcttcacctgatcatgatgtacatgatctaactgtatcaactatattttctcgcctgaccacaggttaatttgttagggcgctgtattttaaccgtgcacaggtatcataatcattaatatttttaatctatgctggaataaacggttgatcttattgggtgctgacattaatcagtttctacatagttttcgatttaactgacaacgcgtacagttttttatcccacgagaagatgct

SEQ ID NO: 14014 - DNA, 438 bp, Diabrotica virgifera
cccacgcgtccgaccaaacgcacgcatgcaaccatgtttaggaacatctgtcttgctctcctcctttttgttgaagtggcggtatgtgttcaaaaactccaagaacattttcaatggaacattttagattatgagtttcccacagaagctattcgaaggaatgctttactgacaggaagatttaagccagaaaataatttgccagttggtatggaaatatggcaagacaaattatttatttcagtgccgagatggaaagaaggcattccagcaactctgaactacgttccattgaacagtccagtcaaaaatccccgattaattccatacccagattttccctccaatgaactgggtaactgtgaaaatggtttgaacaccgtatacaggatgaaagctgatgagtgtgatcgcttatgggtccttgacactggtacc

SEQ ID NO: 14015 - DNA, 406 bp, Diabrotica virgifera
  misc_feature (366)..(390): n is a, c, g, or t
tgggtcgacacaagactctagacagagtcgttcatatttacgccaagctgggcgtgatgctaggtactgcatgctgaacgcgggagagagctgtggaattcgctcatgcgttgtttctgaggatgtcaactggcttatactcatccctgtaaagaggtcaacatgaaataatgcttttccatcgatcttcttatcatttgaaacccttgaagtgaagttacttcacgttcattttaggttttgcagattttttgttttacaataatcaattaaacttgtcttctcacaaagtctattttatgtggtttttggataatgtaagcgtactgtttaaatatgatattttaagaatttttcatattatgnnnnnnnnnnnnnnnnnnnnnnnnncgagtttgtgtacttt

SEQ ID NO: 14016 - DNA, 130 bp, Diabrotica virgifera
cccaagcgtccggcaagctagtaccatagtaccattagtacggtgagttgtgaaaggttcgttcgactcaggaaaatgaagacggttttttgtgtggtggcgcttgcgctttttggatatgtcagcgctc

SEQ ID NO: 14017 - DNA, 400 bp, Diabrotica virgifera
actatcaaggtgtcatgtgttttgataaattttgtttccgcagctagtacattgtttcagtgttgggatttattgattcgtgtggcgcctgcagaataacgaagagaaagcgacgttgccaactgtagttctcattttgtctttatatggatcagtcgaggagctcgtgaaattctagtcagggaaactgtgtccgatcaggaagaaagtcgcagtggttatcaagaaatcacacaagtaatattcaaaatattgtagactttttagaacgagtaaaataacctagaaaaaatggaaaactctacaaatatttttgacgaactgcacaaagtgataaacgtgcatgaagattccagaaccaaagatttctttctaatagccagtccaattccttcaattg

SEQ ID NO: 14018 - DNA, 412 bp, Diabrotica virgifera
gaattgttgtcacaaatggaacgaggaattcaaaaatgatttttaattttaaataccataccatggcatactattttttaaataccattacccgtatgcgcgtcaatgatgaatataaaattcttaattgtatgtcaaaaatgcacaatagctacctcttgaaatccaccaaattgcattacaatgttgccagtaacttcggcaaaatcataaaaaatgtgtaatttttttgtcttcaacgccctgtatcgactggcgttacaaaaatgttttactaagcaaaccaaccccaattttttttccagttttttacctaccctagagacggtgttacctttttttgaaataccctctatgccttgagagataggtacatgtacatcctatcaaaaataacaattttgcaactgtt

SEQ ID NO: 14019 - DNA, 436 bp, Diabrotica virgifera
  misc_feature (334)..(352): n is a, c, g, or t
cccacgcgtccggtttttattttgaacattgtggggaatctcactaaaactgctaaaccttctaccacgccactcgaatcacgaaggataagttgacagatttacatttgcacttgcgtttttatccctcgcgtttaaaacggcgtgcaatcctctaggactggagcgtcctcggtattatcgacacacgcttggaacggcgcaatctttctgctgcttaattacgcgcgattggaatgagccattcaatcacttgaatcacattcaaagaatgtaaatgtaaaggtatggtttgttcaacagtaattggtttgagttcaattagtgctgtcgnnnnnnnnnnnnnnnnnnnctgacctggcccatggttaagacccacccggagcgattagcgaccgaagtagacagagttggtcttttgcaattaacactgact

SEQ ID NO: 14020 - DNA, 259 bp, Diabrotica virgifera
  misc_feature (54)..(54): n is a, c, g, or t
  misc_feature (185)..(213): n is a, c, g, or t
ccaaacgtccgtgaaagcacaaacaactattaaaatgacagtgactttgacctngacagctgcgtcaaatttgtttgcatacactgccaaagttcttgtaatccttgtaagttaatgtagatctttttgtaatgtacaagatttgtagatattttgtcctgtaaaatcatttcctgtttaaaagnnnnnnnnnnnnnnnnnnnnnnnnnnnnngtaaagttttaaataaatgtttgtgaaagtgaaaaaagcataacaa

SEQ ID NO: 14021 - DNA, 331 bp, Diabrotica virgifera
cggaagctttggctgaagctttggagagtgcagctgaagttgatgtaacaccttgttagttctagtgccttgtgtatcaaggattagtaattactgcctggacatataatacgttcaaacatagaacatcttgcaacatacaaggattatagtggaataactcattcagatatcttctttggggagcatggattatcatgggtaaatatatcgaaggattcgctagcataagttatttttatttaacattacttgatttacatttccttggattcacatcattaatatgaaataatttgacagaagataccaataggcaatgttcattaca

SEQ ID NO: 14022 - DNA, 421 bp, Diabrotica virgifera
taaagcgtcatataacttttactagcagtttacaatgattttctttatggatatttcattcgtagtgtcacacactatcttattttcaggttacacaagcttattttgtggaccttgtggctcagggattaatcactgaggcctagatatttcccactttctggtttataacagcacgtgccttattcattgtcaatgtcacatagctattttaaatccctacattgttctgatacgttagccgttttcagttacagtcacaattttttaagacataccttgtctttatctattttcaccatacttatgccgtaccagtcttctattcatcatcattcctatttttagggatgtgcttaacaatgttgttttagtaatctcaaacttctatgtaaaacctatgccaattccatgttcatat

SEQ ID NO: 14023 - DNA, 460 bp, Diabrotica virgifera
  misc_feature (413)..(413): n is a, c, g, or t
tacacacgcgtctggtactgcgaaccgaagatggcgtctcaagttgaaatggtgccagaagcccataactagtgtttttttgaagtatttagtcttcaatgatgcgaaatcattcctttagatggtgtagtatctgaatcaaatgccttttgcaagtattgcaacccagaactcatggaggatttgtttgggcgtggcatactattgcgtattagaattttgaagccctgtgtagtcaaatatggtccagtttttaataatatggttgctggagaatcttgccaatcgtttccttttgctgtacacaggtttttgtagaagatggattgttgttcctgtttccaagttatgcttcctacgcctcttgtcaatgacaccgatgtctgtttgttttgtttgagtgtgacaatganatgttaataacaagaatgtactgtaaatcttgtttataatataaaaa

SEQ ID NO: 14024 - DNA, 59 bp, Diabrotica virgifera
  misc_feature (25)..(53): n is a, c, g, or t
aagactctagagaaagtcgtattannnnnnnnnnnnnnnnnnnnnnnnnnnnngaaagg

SEQ ID NO: 14025 - DNA, 416 bp, Diabrotica virgifera
  misc_feature (320)..(320): n is a, c, g, or t
  misc_feature (356)..(356): n is a, c, g, or t
cttatgcatgtggtcaaaagaatattctttcaccgaatatactgagtacgttcgtgtacgtagtatctcggaatgttcgtaaaagtttattcttagaatataccttaatcgaatattcttagtatatgcgtaagtatatgcaaaagtatatgcttaacacatacttgtatatacttttaaaatatcttaaaaagaatatactgtatattcctagaggaagaagaataatgtttaacctatagattatcaacttcgcgttaagaataattaataaagtttaggtattttggtaggtactactgaactatctaattcatttntttataccgtgttaattgtatggaaataaggttaanacttaattctattgaagaaaaatgagaaattctcgtttcgttttcaattgaagtgaatat

SEQ ID NO: 14026 - DNA, 208 bp, Diabrotica virgifera
tgcataaagtcatattatgtcttttggtgcgttattacgagtatgttactgtcaccttgtttattgcttgttattcatgattacgctgacgagatgccatcgatgatgcaggctttcagcgtcctatcaatctcttgcgtctccgctttggactcccattacaactgtcataatgacgcagttaccgcgtataatacagctgctgcgt

SEQ ID NO: 14027 - DNA, 407 bp, Diabrotica virgifera
  misc_feature (267)..(284): n is a, c, g, or t
aatcgtttaattttcaatatttttttatgaaagttgtttcacatgtactttttataacaaatgttcagtagtaataaccagaggacattgataattgttcgaaaaatttttataacagatttcgaaagcttgttccttggaaacagaccgacgccgtaggcggaggtctgttgcctgtaagcaacaagcttgagaaagttgttaaaaaatttttgagcatttatcaatgttcgagggttattcggatagaaaattttttgctgatannnnnnnnnnnnnnnnnncattaatattctcatcagtattacaaccaaatcgtgacattttgaaatattgaatatttgaaatgtcaaaattgaaatgaaacgaaatgtaggtatccatagctacatgattgactgaaaaca

SEQ ID NO: 14028 - DNA, 331 bp, Diabrotica virgifera
aagactcttgagggaagcgatgaagaacgtaggaaagtacactgtccctaaccatgataaagctgccttcgagttggagttgacgcgtacttcagcagttgaaactctagatctccagcgcgaagccgttgggcccaatcgttctgagtacggtgaacacagagctcagttcgggtctacggtggaggaagttatcttggcaagccgtactgatgatgcaatttagagagctgagggaggagacgtgactgcagatcgtgacgatggcagtcgagctattgaggagtaggcggatcctattgttagtcgtagtcgtgcagctttggagagc

SEQ ID NO: 14029 - DNA, 402 bp, Diabrotica virgifera
cggtcgacattaccgggtccacgatccgaacgtacggcagatcatcccgttcatctcgaagccggtcgtgcgctacggcctgtcgccggacgcgcaggtgcgcgccgaggacatcgacgcgcgcgacggccggatgcatttcagggtgatccgcgaagggcgcgcgccgctcgcggtcgtactgaacatgccgggcctgcacaacgtgcaaaacgcgctcgcggcgatcgcgatcgcgaccgatctcggcgtgacggacgacgcgatccagctggcgctcgctgaattcaatggtgtcggccggcgcttccagcgttacggcgacgtaccgaccgcagatggcggccagtacacgctgatcgacgactacgggcatcagccggtccaaatggcgccaccatc

SEQ ID NO: 14030 - DNA, 90 bp, Diabrotica virgifera
gaaaattgaataaataaaaactattatagactaactagaaagtggggctgaattcgaggatgttgtcagattgggataaaaagggggggg

SEQ ID NO: 14031 - DNA, 164 bp, Diabrotica virgifera
agattactttcaactaatcgataatatattggatctttagttatcagtcttggaatttgagcatgaatggtaagaacttccctttgaattttattagaatcatcactccgaacgccctgatctttaagtcgcacttgagatatttcttggggcatctttagaac

SEQ ID NO: 14032 - DNA, 66 bp, Diabrotica virgifera
gcgtccggatctagatcgcgagcggtgtatctcaatgtaaatatattttgatatagatatttttag

SEQ ID NO: 14033 - DNA, 375 bp, Diabrotica virgifera
  misc_feature (182)..(199): n is a, c, g, or t
accacgcttacgccagttcccttattatgaacatcgtgaaattttaacaaaacctgtttttacttcaataagtttcattcaattgttaaaatgatttctaatattttaaatataggttgtccttctctttatgactctcttatttcgtctaaggctcatggattttttatttcttcctctgnnnnnnnnnnnnnnnnnncaggtccaatattttgtaccctactagtcagtacttttgttatttttcctaccgttggttttgcttttgactcatatagcgttgtggtattcttttggatttatgtgatttctttttctgatcattattgaattggtgtaattgatttctttcttctcttgtaattatagaccttt

SEQ ID NO: 14034 - DNA, 212 bp, Diabrotica virgifera
accaagcgtccgctcactcgtaaactcaataccaaacagcctaacgcccaccctgaggtacgacaatggtcaaccgccgatttaaacgtgtaacacagctcgaagttatcaaaaatcagtagttttgggcttccttttaaaggtccaaatggcctgtgataaattggttgaaaaaatatcgacaaattccagaaaacttaactgctaagggg

SEQ ID NO: 14035 - DNA, 388 bp, Diabrotica virgifera
  misc_feature (8)..(93): n is a, c, g, or t
  misc_feature (99)..(294): n is a, c, g, or t
  misc_feature (296)..(335): n is a, c, g, or t
  misc_feature (337)..(359): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnntagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnngnnnnnnnnnnnnnnnnnnnnnnngttaataaaagaattcgggaacaattttt

SEQ ID NO: 14036 - DNA, 404 bp, Diabrotica virgifera
gtggggctatgcgaagatgtcgtcattccggtgtcagagtcatcgttcccccaagatgcgcttctagtcctacaagaattacttgccgctacgtcagacctcaaagaactccaactccaccaccactgatggaaggggaagcactggctagcagactgctagagcttggtcctgttggcgctaaattcttaggaccagtgatacttgaagtgccgcattttgcttcactaagaggtaaacaaagggaaataatcgtcctgagatccgacaacggtgaaacatggaaagaacatactttggaggctagtgaagaagctatacaagatgtattaaatcatagttttgatggagaagaacttagtcagatagaagatctacacaccagtcgcataactcgcatccta

SEQ ID NO: 14037 - DNA, 188 bp, Diabrotica virgifera
tcgcgtattgcgtaaaagtagtgaaaggtgtttggatcagtgatcaaatcttagtcatgtgatgaggaaatgaatatttatactacgtaaattagatgtctgatacttgcgtgttacggagtaggatgttgataattatatcataagtaatttcggctgtggtacaacagtggcattagtatatttat

SEQ ID NO: 14038 - DNA, 321 bp, Diabrotica virgifera
attgcgttaattaaattgaacacttttgtaagatatgaaacatgagtaagattgtcacgaattttagactagcgtagaaattaaccaaaaaataatcataaattttggaaaagtatttctgtacataaaagtatttctgtacagcgagattggaagtttcggttttattattgattctattataaaaacgtttctacaaagtcgcaaagtgtatttcattttttactgaaggaaaagttttgatgttttgtatataaaaagagaattaaatattcatcatctgtattgtttgatcaaattttgtaataaaatgttcatttt

SEQ ID NO: 14039 - DNA, 407 bp, Diabrotica virgifera
  misc_feature (285)..(350): n is a, c, g, or t
gcactcctggcactttgatgatgggtctcatcatggtaatcagctgatgaggtgtcaaggggtgtggttgtagagtgccctgttggtttcatattttttctgtgtaccgaactttcaataaagaaaaaaatacatagatacttacagatgattttccaacacttctgacgcatcaagacgtgaactgccatgttatatataatagtaacggctcgcagtttgctatggatgctcacgagtcttttttcaacactgctgatgttaagtgccttcctcagtccatcnnnnnnnnnnnnnnnnnnnnnnnnnnnnnnnnnnnnnnnnnnnnnnnnnnnnnnnnnnnnnnnnnntggagtatatgccaaatgtagcaaaccgattggatttgaatatccaatttgtacact

SEQ ID NO: 14040 - DNA, 179 bp, Diabrotica virgifera
attaagccttaagtcgacgtcaatactcctccacatagactaccaagaattcaacctcacatggacgatcatagaatctcctcaaaaatcggaaccaactcaaggtaaccctactgattcacaataagacgatgtagaagaacaccacctgttcgtaatatggcataagtccaatgcag

SEQ ID NO: 14041 - DNA, 184 bp, Diabrotica virgifera
  misc_feature (2)..(21): n is a, c, g, or t
  misc_feature (23)..(89): n is a, c, g, or t
  misc_feature (100)..(119): n is a, c, g, or t
gnnnnnnnnnnnnnnnnnnnngnnnnnnnnnnnnnnnnnnnnnnnnnnnnnnnnnnnnnnnnnnnnnnnnnnnnnnnnnnnnnnnnnnntgatgagaagnnnnnnnnnnnnnnnnnnnntatttagttaaaatatataggtttatataaaggaatttcggacaaattttttttaaccgtttatt

SEQ ID NO: 14042 - DNA, 421 bp, Diabrotica virgifera
  misc_feature (382)..(407): n is a, c, g, or t
acggcgttcattttctttttaatcgatataagagcggtaacgccgaagtgccgaagtttctttttgtttgtaaacgtaaatcagtcaaaatacagaccttaaagatggcgagaggtgggatgcgtggccggggcggcatgaaccggaatgttggcggccggcctccatttaaagttaaaatgtttttgccgaggcatccatttgacctggcactttgcgaaacttcgtttcctcgtaccaaagcagctccagacgacacagcttttactcaagctttattaaaaaggaacgccgatctgtcacctacacctggagaacaaaccgctattttgaacttggttactaaaattcagacagttttggacaatttggtagttgcacnnnnnnnnnnnnnnnnnnnnnnnnnntgatgaagtccgac

SEQ ID NO: 14043 - DNA, 96 bp, Diabrotica virgifera
agctgaatgtgctgtactcattgttgcagctggtactggtgaatttgaagcaggtatttcaaagaatggacaaacacgtgaacatgctcttcttgc

SEQ ID NO: 14044 - DNA, 296 bp, Diabrotica virgifera
actacatcgccatcggccggcatttatttttgcttttcacatctcagtttgttccatcgtttctactatatccagattacattagacatttcatcctaacaacagacgcatcgggcgatgagttgttcagcagttttaggtcaagattaaacggcatagacctacctagagcatacgcatcaggaagtgttaatcagggagaatgtagtaagccgacaatcattaaggaaatactaacgatgcattggggacttaagcatttcagatgttagttatagggcagcaccatcgttttt

SEQ ID NO: 14045 - DNA, 426 bp, Diabrotica virgifera
agggaagataagataattccagagcgatagatataaataagttccctcctgcagatgtccaaaataacgaatacagcggatcagataatcagaagttcttggataattcaattcgtaaaacttctaccaaagttttctcagattttaactttcagctaactacgccgagaactaaatatttcgatacaaaatatgaagaagctagacaaaaacttgaacaagaatacgaagagaataatccagaacactctgacgatcaccacatggatatcactcaagaagtggaagaagatgaccgtgaacatgatctccacatggatcgattatttggtagtgtcagaaataaccccaattcctctatagattacaaagaaaagactaagatctctcgtaacaataccgttgatgataattcagagcacaatg

SEQ ID NO: 14046 - DNA, 281 bp, Diabrotica virgifera
  misc_feature (3)..(72): n is a, c, g, or t
  misc_feature (80)..(98): n is a, c, g, or t
  misc_feature (193)..(214): n is a, c, g, or t
  misc_feature (218)..(244): n is a, c, g, or t
ggnnnnnnnnnnnnnnnnnnnnnnnnnnnnnnnnnnnnnnnnnnnnnnnnnnnnnnnnnnnnnnnnnnnnnngggagagnnnnnnnnnnnnnnnnnnncgaaaaaatttagggtttgtgtgcccctgtggtatccacggagggtataaaatagagaattattagatttaataattttcgacatttttaagagnnnnnnnnnnnnnnnnnnnnnngggnnnnnnnnnnnnnnnnnnnnnnnnnnntgaagaaaaggtgattcccgctttaaaaatatccaaa

SEQ ID NO: 14047 - DNA, 402 bp, Diabrotica virgifera
  misc_feature (118)..(137): n is a, c, g, or t
cccacgcgtccgcaacaacccttctttggtttctattttttttcggtttagaattttcggagatttttcttcgcgggtttttgtgttttatgaagataaattttaacagattgaatcnnnnnnnnnnnnnnnnnnnnttgatttaagaagaaaattggatttaacaatgtgagaagtttcaattaaatatgtggtttttttaaatacatagatcttatcttatgtgaatgaaaatgaagatggtaaagtgaaaatatatttaaataactgatccatccaatccgtcctcatgattgaaccaacagacaagaatggacctaataaaatcttattacaaccgctaccagccctcttggtccgaccagttccctgctacatcattcttccctcaaatagatccgg

SEQ ID NO: 14048 - DNA, 354 bp, Diabrotica virgifera
aaaatatttttcatccaagcgatattttgatactacatgtatttgctacttgttctggtaatcccaataagattgtttatttttaaaaatctgtcccgaaaagtgtaaatttttaattgatttttgggccccttaaaaaacggggtgctaatttaaggacgaataatcaataaaataatttggtcctaaattgaaacccccggttttttaaaattagaacaatttacaaggtaggtaaacaacagttgaaacttagttaggtacaaaccgcctttaaaaaatttttccttaaattactaagaggcattggaaattggaaaattttgggattttccaaggaaattttgtaaattg

SEQ ID NO: 14049 - DNA, 333 bp, Diabrotica virgifera
cggacgcttgggtcacccacgcatcttttaatacaagtccttgattgtttgatatatggctcgttaaattcaagttgaataccaaattgtttaaaggccactcacattagcccatgttatcatgcgccaatgactgaatatatacacattctggatcatcggacttgactcatcttctgtgggatatggctactgtaaaattactatattaattgaatattatactatggatggttagactgtagccatcacagctgactttatacgaattgtgtcaggattacgtgataacaccatcattatgtgtaacaacttggacgatagtaattacac

SEQ ID NO: 14050 - DNA, 404 bp, Diabrotica virgifera
  misc_feature (62)..(88): n is a, c, g, or t
ctcaaaataaatttggtcccttgtaggtaagttattggtgataccaaaaatctcaagtaccnnnnnnnnnnnnnnnnnnnnnnnnnnnattatattataggttttgctattgtattttggactttttattttcctaaaaacaaaaattggttaagatatggctgttcaaaatttgcatacgctcgtgattagttactagtttaagcccatttaactgcagccttttcaaaaataagcactttaaacccattaatcttacagatgttataaacaataaaatgtaaagtaatttttgaagtggtaatgattaatttaattttggatgctaattgggagtgattttcacgatttttttttaccaacaaaaaaatggaccaacattcttttgatcgtaacttacttac

SEQ ID NO: 14051 - DNA, 323 bp, Diabrotica virgifera
agttggatttatcaggagctatgtccggaacacttgtcgttaactattcagcatgacaaatgggatagcgcaagatggctcaatgttcactatttccaagcgtcgtgcacgaaatgaaagatgtagcgcatgcattcatgtaccggatggcgcctgatgtgttgccaccaccttagttaatgggcctcgctgcttcgatgcagatgtagagtatacccaagataaaaggtgtctggtcgaattcgtatattttccgagaggtatacaatatgttgtgaataatcaacagttacgtcaggctcgtaatggggacaccgtaggtg

SEQ ID NO: 14052 - DNA, 414 bp, Diabrotica virgifera
  misc_feature (387)..(387): n is a, c, g, or t
  misc_feature (396)..(396): n is a, c, g, or t
acacacacgtctgagaagatgctctgaacgctgcattagatgctggataccgccactttgacaccgctaccgtatatggaaatgaagccatcatcggtaaagttctaaataaatggttttcttctggaaaaattaagcgagaggacctattcattacaaccaaattgcccttatgtggaggacaccccgatagagtagaaatgtttattaaacagtcacttgaagatttaaaactggattatttggacttatatttgatccattttccagttactagtaattatatcggcgttcctgttacaccaccagattaatttaaattggaacctgtggatcatctttcactttggcagaaaatggaagaacaagtcgacgcaggcagaacanagtccatangagtctcaaactttactc

SEQ ID NO: 14053 - DNA, 313 bp, Diabrotica virgifera
agatcccaagtactgttccttttattctaattttactttcgaacagttgcatttactttacttccaaacaatcagcatgggtaaggagatgattcaagttaacatcgttgacattggacacgttgattctggtatctctactactactgagaatttagtttacactatgtggtggtagcgagacgcgtgccatcgatcagttctaaagagaattccaacaacgtggcttatggttcattcatatatacctgtgtagtcgacagacgtaaggccgaaagagaatggtgagagtagcattgataatgctttgtgg

SEQ ID NO: 14054 - DNA, 85 bp, Diabrotica virgifera
  misc_feature (2)..(35): n is a, c, g, or t
  misc_feature (37)..(49): n is a, c, g, or t
annnnnnnnnnnnnnnnnnnnnnnnnnnnnnnnnngnnnnnnnnnnnnnagggcttttttattgaaatagcaatttaaagtagtt

SEQ ID NO: 14055 - DNA, 378 bp, Diabrotica virgifera
ctctagagagaatcgtaggatagtacatttccataaagtatacctgcatccgtctaaatgactacctcatggaacgatcctgatgcagcactcagagctaatctcataattttcgctgatgctatcatagctcctgtaacatgtattttaggtaccaacaaatctaccgcaaccgtatgcaagcgtcttgctgacatcggcgtcgaaatcaacgatttataccgtcgtatatacatacaacttcatttcactaccgatccatccaatgcgcaatacatttcagctgtaattttgttccacgaatgtttataccatattgccgataatggtactccattcccagatcttcctatacagagatgaatcatttccgggatt

SEQ ID NO: 14056 - DNA, 366 bp, Diabrotica virgifera
  misc_feature (311)..(346): n is a, c, g, or t
acacagacgtcccgttaatgcgtcagctgacgcttggggtgacgcatggttttatttattgatagttaatacgtaatgtgagagaatagtgtcaggtttagaaaggacgtctttattatttgtaccatgagtatcagggactatgaactaatacttatatggttatgactttcgtaataaggcgagcgttgaaaattcaaatttttactgacatgtacgtcattgagataactattatgcatggagatgttactcatttttaagtacccctaagttttgaagcactcaattaagcatacccactaacactnnnnnnnnnnnnnnnnnnnnnnnnnnnnnnnnnnnnacctgatcttagagatgagc

SEQ ID NO: 14057 - DNA, 390 bp, Diabrotica virgifera
tccacgattccgattgttcatggttacaagaacagcttgcaatataactggtacaaggtgatatcccccataatcatttcaaatacaacgcatatattttttactccccgtttcttatgacactagacaacaggaatttacaagtaatcataaatgatatgttaatatcaaggtttgacaattttttcacattgaatgtgtcgagtatttggaatgtacaatatggtataactatttcaacactacgattccattttagttacatttctccatgataaatcataagatccatacatgaataatttcttcgctagattccaaagctatattggtcaatgcaatacctaaaatattacgcattttctaatgctacaacgatagcttgcaata

SEQ ID NO: 14058 - DNA, 74 bp, Diabrotica virgifera
aaggcattcatctgtttggcatttgcggcctttgtctcagtcgctcgtgcatgagtcattggagaagcttactc

SEQ ID NO: 14059 - DNA, 384 bp, Diabrotica virgifera
  misc_feature (23)..(35): n is a, c, g, or t
  misc_feature (38)..(56): n is a, c, g, or t
gacgaccatgggtccaatggccnnnnnnnnnnnnnccnnnnnnnnnnnnnnnnnnnggtggaaatataaacatttagattttaataaaaattagaaaaagcaatttggaaagttaaaaccaataacataaattcaccaaaagataaaatcaattcagttcaaaattacttacgatggactgcaaaatcagtcctgaatgcttctgatagtattacctgccctttaaacagaaaacatataatgccaattgaaaaaattgaggaacatgtcaaaaaatgtagccttatatctgctggttacaaaactaatgaagacttcttgtcagaaactccagaaccttcctcgtctttaatttcattagatctatctaaaaaaatggaaata

SEQ ID NO: 14060 - DNA, 316 bp, Diabrotica virgifera
tagtttgactcaaaatacgacaatggggagaagacaatcttcgaccatcttggcaagaaatatcaagcctacgctcagtatctaagacgtattgggcccagtgggactcatttatcttggatgacagcttgctcattctagtaatagaaaatgatgatggttcaatgaggataacacagttggtgattccaaagaccataatagccgatgtacttcgtcagttacacgatagtccatcaagaaggcattttggtgtaaagaaaacccttcaaagaattcgggaacgattttactggtctgacatttccgacgatgt

SEQ ID NO: 14061 - DNA, 384 bp, Diabrotica virgifera
  misc_feature (283)..(283): n is a, c, g, or t
  misc_feature (367)..(367): n is a, c, g, or t
aatagtaaagaaaaagtaaattaaattgagtggataaatgcggcaaaaaatttgtaaaccaattttaaccaaaagggtaacgaaaccaggaattaaattccaccacaaatcccccatttaaaaccgggcaatacgggttttggccaacataacaaaaacgttttggaaaacacttacggtacaacaacacacaaagttttacaaattcaaacattacacacagctgaaaaacttgttttacctgacaaaacggcaaatgattaccaaacctaccgacctgcancaagagatatcgatattgtgaatgaaagacatggagacacgatttataagcatcctatggtacctggatatgaaggtttcgtancgcgagaacatggcaaa

SEQ ID NO: 14062 - DNA, 422 bp, Diabrotica virgifera
aaaaatattttggtataccttgttaggtcctatttacttatcaatggaattttgaataagatggagactcctgttttaactaaaaagcaacttaaatcaacactttcagccaaaaaacaacgaccaaaagaaacaataaaaaatgttttggctttacctttcaataataattattggccggaagtatcacctgaagaccagaaggaacttaaagatcttataatacaacacatgccaatgataagagataagcagattaaagttccatggaaagagttaaagacagttccaaaagcgaatagaaaatcgtttcgaaaagaatacaatgaaaaacttcttggaccccaaccccccaaaaaatgctgttctggaattagtttcggaatcaacagcatgtcaaaattgttggaaaaaaattttgc

SEQ ID NO: 14063 - DNA, 360 bp, Diabrotica virgifera
agtccaagatgagagtactcaatcatctttctcacgtggccatgagcaacagctcattatgatccaaatatcaactctcccttgatgtctactaaattagcgtggccgctcgaaccctggccacgatgctctggtaggactatgcaatcatctacattattgacaacaggaatgaaaggattgggtacaatatggtggccataaccaacccgataactactgtaagcagtacgtgcaacgcatcaaccattctgaaaatatcaatataccctagatatatcactcttgggatgactaggttgtgcaagacttaactctagttcaacgtgatcagtagctactcaggatgatcagacttca

SEQ ID NO: 14064 - DNA, 66 bp, Diabrotica virgifera
atattaattaagagaaactgtgttaataagtgtaattaaccacttttaataaataaatgaattaaa

SEQ ID NO: 14065 - DNA, 308 bp, Diabrotica virgifera
tagtaaacaaaaatttgacttaatgatagttaactaggattgtccgcgaacctgttacgggtctttaatgcatctttattctaccgaaccctgactatcatgcacaagaatcatttcgaataggcgttcctgacgttccagccccatctaacccagtaagtaccttgtttattccacctcaaaacctcatcataatatttttgtcatccgatgtccccccattataaattcctcttgacgcctaagttgatctttaaaatcaatttgatacatggccattagaattcaatccatttaggtcagtcaac

SEQ ID NO: 14066 - DNA, 206 bp, Diabrotica virgifera
ccagacaacattacgatcagaatggatgtcggagtacctgatcctgaaccagaccccgtccaggtcgcaaaagactctgaccagcttccacatgcacagtcaaaggtacactgtcaccaagtagcatccgaccattatgccatttggatgtacctaaaccatacccggttccagtaaagaatttcctagtggaacggttcctgctt

SEQ ID NO: 14067 - DNA, 395 bp, Diabrotica virgifera
aattaaagatcaacagtgtattgtgttggtatgcgtgatggtgagagtagaaggacaatctcaagattctattattatggacaaggactttccggtggggctggaaaatttagggttccaaaaggaaccttccgattatgaaaaagaacgcaatggagatttaactgctgtaacagttacaacaaacgaagaagcaaaggaaagatctcaatggggcaacagtacggagtttttgatgtcctgtatcgctatgtcggttggattgggaaatatttggcggtttccttttatcgctaacaaaaatggtggaggagctttccttataccgtatctgatcatcctaacgtttatcgggagaccgatgtattacatggagatggcactaaggcaatttt

SEQ ID NO: 14068 - DNA, 222 bp, Diabrotica virgifera
aggacacgtgggtgtcggtgaaatcggtgctgttatagtaaaaaacaaacacaatgggtcccaaaacgtaataaaaatgattccaaaatgtggcaatttctcacacaaggaattgggcaaaccaattccgtcaaagacttggtttaaacaacccggccgttaaaattcgcaaaaaggaataatcgtattaaaaaagctcttgctattgcccctaggcctgct

SEQ ID NO: 14069 - DNA, 299 bp, Diabrotica virgifera
agctccaatcacgtttggttcagatgattgactgggactatcgtatgcatggatgcacgcatcatagttcatgctgtccaagatacagatcttcatgcttatggtgcataggaaatatacgacagttattattcgtcacaaataactacatcagccaatacgcccttagtcactgctacacctgtaagtccagttactcgcagagtatgtcgcaaatttcatttccgaaaacgtcctcctaaaatttacacgcatcaagggatttctaaacgaagtcatgaagttttagaagacaggga

SEQ ID NO: 14070 - DNA, 418 bp, Diabrotica virgifera
  misc_feature (87)..(106): n is a, c, g, or t
agcttgtcaagttaaactttattctacccaataataaagacgaaaacagcttggctactgcgttcatcattgtatacgagaataagnnnnnnnnnnnnnnnnnnnntgaaaaaacataatagccaggggatagtggaatatgaaggtgtaaacacgaggtaaagttcaaaccaaaccctgatgccccaagtgcatcattaattttaacgtcatatatgattttaagaatgtcccgaatcattgcatgacattttagttaaatctgagagttgccagaatatttttaaagttataggtataatattaacctagattgacaattgtcatttacccgttgacattgtgaaagtcagtactgtcacgatcgagtacttttacgtcaaattatctttattcgcatcattgattggttatctat

SEQ ID NO: 14071 - DNA, 422 bp, Diabrotica virgifera
accacgcgtccgcgagagaatacgaatctaaaaattacaaaattagtttaatagattgcaacaaaatgtccgtagcagactttttcatagataaaaatgtattcattactggaggcagtggatttctaggaaaactgataatagaaaagcttctaagatcatgtccaggcatcggaaaaatctatgttttgttaagaccaagaaaaggtaaagcaattgaagagcgtcttgaaaaaattatcgaatcacctatatttaatccattgcgtcatcaaaatccagatgctttgaggaaactcattccaattaaaggcgatgtttcggaattaaatttaggtataagcaaagaagatcgagagttactagttaacactgtacatataatataccattcagcagcttcagttcgttttgatgacttc

SEQ ID NO: 14072 - DNA, 359 bp, Diabrotica virgifera
  misc_feature (78)..(78): n is a, c, g, or t
  misc_feature (246)..(296): n is a, c, g, or t
  misc_feature (343)..(343): n is a, c, g, or t
accacgcgtccgctacatcttagagaagtgagaggggaacggtgcttaccacaaatctataagagcgcgtgggaggangggcaacaggtgtacgatgaaggggggaagggtattccaaattttttacgatattgtttatggatgtttccattttttgtgaacagattaaattcaaaatttattaaaaattgtaaacaatattttaggttaagtatatgacattttatgaaattgactaaaatttgnnnnnnnnnnnnnnnnnnnnnnnnnnnnnnnnnnnnnnnnnnnnnnnnnnngacccctgcatagaataacgttgtaggtaactaatattgttggcaantcttgatttactgtgt

SEQ ID NO: 14073 - DNA, 376 bp, Diabrotica virgifera
  misc_feature (199)..(217): n is a, c, g, or t
  misc_feature (316)..(339): n is a, c, g, or t
atccgatccagttagggtacatgttcaagattgagaatgagaatcaagtctcacatgcggctcattatctttgtcaccacggggcgttcaagtattcttctatcactaagaaatgtagggttgtttttgacggttctgcggttaacgattcgggaatctcgctaaatgatactttaatgacgggtaataaattacaggnnnnnnnnnnnnnnnnnnngttacggtttagggaacatgttatagtaattgttgctgatatagctaagatgtaccggcaaattttgatttatgatccaaacggggaatttcagggaannnnnnnnnnnnnnnnnnnnnnnnccgaagtaggagtttataggttgaacatggtcaccta

SEQ ID NO: 14074 - DNA, 416 bp, Diabrotica virgifera
  misc_feature (200)..(219): n is a, c, g, or t
  misc_feature (253)..(270): n is a, c, g, or t
  misc_feature (308)..(330): n is a, c, g, or t
atcatattataacaacgaacaaattatgcaatacatttaaattttgttagagtgagaatttgttatttttggaatgagtgttgtttgtacatagaaaatatttagtatatctttttaagtacctatttgtttatcttatagttgtgttagtgtgtactatttaatttgtttgccagtgtacctagagatgttgagatgannnnnnnnnnnnnnnnnnnncttttcttacgttacagtattcacgattcttttnnnnnnnnnnnnnnnnnnaactttaatgaactgagtatgatcaagattttataccnnnnnnnnnnnnnnnnnnnnnnngctttaaagtttccgtctgatcttttaactttttcgtatttttatcagttcacactcagttattactcaatgtagaacaaaatatg

SEQ ID NO: 14075 - DNA, 381 bp, Diabrotica virgifera
  misc_feature (91)..(118): n is a, c, g, or t
gttagatcaacatcaatacagtaactgatttttctttatgttttggagccaaaccgcaagtagtgggcagtcccgataagtacttagcctnnnnnnnnnnnnnnnnnnnnnnnnnnnngtggcaatttatttctctacatagtctccttttagcttgatacatttgacctagcaatacttgaacttctttaacccgtctgaaaaataccttttttcgaagtctgcaaaataggcttccatggcggcgatgacttcctcattcgacttaaatttctgcccagcgagtgtctttttcaagtttggaaactaatagtagtcgcacggggccaaatccggagaatacggtggatgaggcaagagttcgtagcccaattcgaccaa

SEQ ID NO: 14076 - DNA, 381 bp, Diabrotica virgifera
aactatttatttgtatttctaggactagtagtgtattgtctcgtaacctctccactcattctattggtaattgccggcacattctacgtaggttaccgcctaaacaagagacaacaggaaaaaccgctagtcctattcggcaaagaattaaccttagcgcagcaatacgtaatcgtaacgttatgttcactaccgatatttttcatggtaggcgcacacggggcgatattttgggttttgggtgcttcgatggtcgtgatcacactacatgcggcattttacaacattgaagcgctcgttacaagagaagacgattcctacgccttactggaagaagtttaactaaataagtgtatatttatgggaaatgtatataatttt

SEQ ID NO: 14077 - DNA, 389 bp, Diabrotica virgifera
tataatttgaaaacgaatatttgacattatatttaacctccaatattatgacagacgtcagtgaccatttacaatcgctccaaatataataatgacgtcatatcgtcgccttagtattataagttgataactccaaaattggcgtttttgagataaattcacagggtgtattttatgtgcctccatattgtgtaaaaacgtgataatcgcctccaaaacgggtcaaattttatttataattgacgaaagttgataaaacgcagatgcccctaacattcagtgctaaaacttgacaagatgagttatcaactacctttacgatacactaaatgctataactagctacctcgagctcgaaaaaatgtctcgaataaaaattacttagtttt

SEQ ID NO: 14078 - DNA, 106 bp, Diabrotica virgifera
ctagcagcattcgcttccaggcatgaagctcatgacggtcgagctgccgtttgttagtaggttaagacacatgtaagttttgtgacccagcgggactcagtgcttt

SEQ ID NO: 14079 - DNA, 67 bp, Diabrotica virgifera
gcgtatgacgctacaagaccctaaagtgagtcgtataccatgcaagttcatactcctccaagagggc

SEQ ID NO: 14080 - DNA, 369 bp, Diabrotica virgifera
ttccattcagtatacgtatacccatgtgcgtgcagaatatgttaagaggcaatatggaacagatcactacagcttactcaaactttgaattcagtcaaccgcactcgagacaatttaggagtgacactcgagaaagatgtaagatctgaagtgacgtatcaacttgacgaactctgcaaggtggaagatcacctcgacatcttaatagccacatgttaacttatcacagttgttcttcaagcacggatttgtagtctgacacatgtggtaggtgacttggaaaaatgttgcatagatatcgactgtttggcacagatggtctacgaacaggcatgcatcttagctcgcgtgtagaatgttgctctgacg

SEQ ID NO: 14081 - DNA, 99 bp, Diabrotica virgifera
atattcgaaaaattccactgactattagaagtgctacacttaaacaattttttcatcaaaactttgtaaatatacttttttttcgacatgaaggttttt

SEQ ID NO: 14082 - DNA, 236 bp, Diabrotica virgifera
agctgatcgtcatgatggccatcatctggcaatttatgctcgagttgggccgactaggattagttaattagcagtgatcaacctgcagactgtgaggtcattagaacggggttcaagagagtgggagcttcgttatatcagcacttgaacaacatggggtgattgtcaggtcgtaccaacttgagattagtgacgtaggcaagtcaattgcttctctgatccaattggattgggta

SEQ ID NO: 14083 - DNA, 127 bp, Diabrotica virgifera
  misc_feature (32)..(32): n is a, c, g, or t
tacaattccctatactgacgtcgtattaatancgtccgtcccacgccgtccggaatcaaaaaataatcaattttgaaaaatttacacacaatgtttaaaaatttgtaacactaagcatatatctcac

SEQ ID NO: 14084 - DNA, 78 bp, Diabrotica virgifera
cgacgttgcggtgccggtgtgttcagctgcttactagcatgaggaaatcagtgatgtgttaatatgaactagttttgc

SEQ ID NO: 14085 - DNA, 199 bp, Diabrotica virgifera
  misc_feature (41)..(59): n is a, c, g, or t
  misc_feature (62)..(142): n is a, c, g, or t
  misc_feature (160)..(192): n is a, c, g, or t
atccaccaagcctccggcgaagcctggggtttaaaataagnnnnnnnnnnnnnnnnnnngtnnnnnnnnnnnnnnnnnnnnnnnnnnnnnnnnnnnnnnnnnnnnnnnnnnnnnnnnnnnnnnnnnnnnnnnnnnnnnnnnngaccttgggtaacagggnnnnnnnnnnnnnnnnnnnnnnnnnnnnnnnnnccaattt

SEQ ID NO: 14086 - DNA, 144 bp, Diabrotica virgifera
acaacctgcctcctacgatacaggggattttaagtttgcgtagggattttactttgagttgttaatagtgttaagccaagaaacttcaatagtaattctgcaaaagtactggggattagtgcgggtgagtttaatctttggggg

SEQ ID NO: 14087 - DNA, 106 bp, Diabrotica virgifera
  misc_feature (2)..(31): n is a, c, g, or t
annnnnnnnnnnnnnnnnnnnnnnnnnnnnngtatcacaagtataaattttaagtaagcttgagacaaaaacagaacaaataaaagggcgtacaaaacacaacact

SEQ ID NO: 14088 - DNA, 394 bp, Diabrotica virgifera
  misc_feature (95)..(121): n is a, c, g, or t
aaaaattagatgccgccgtcaatcttcaggttgttaaacttaaaatatttgttgaatgttttgtgtctatttgattaaaattattatgatactcnnnnnnnnnnnnnnnnnnnnnnnnnnncaaaagtgcagcgattgttatcttcgttatttctgttcaggaccaataaagaattttacagaaaacttaaccttaaaaaattagacgctgtcaaacaagaattaggaaaagatttgattatatttggaagaaaatggttatttcatagcacataaacatcaacaagtataatgtggcctttgctacttgatatgactaaagaagaatcggtccaaaacttaagaaacttggaacttgaagcatactcccagcttgtttctgctttaagagcac

SEQ ID NO: 14089 - DNA, 68 bp, Diabrotica virgifera
tgacaaggggaacgcaccctggacggggactatatccccggcgggtatgggggttacccgcaccgtga

SEQ ID NO: 14090 - DNA, 406 bp, Diabrotica virgifera
aaccgaccacgcgtctgccgaggcgtggggcaggcttaacgttcgcttcgatctagttattcaaattagaagctttgttgatgttgattttcactgtctagcagtcgatcgaatcaaaaggcttaaacataagctattgagagatacttccgatgcagaatcgggacaagacgatgatgttcaagcagataagatcacatagcctgagtcagagtcttcgaagtcatcaggtcaagaatagaattcctgcaatctgggtaaaagtaagttcgataaattgagcgagttcaaggatacctggtgtgttaatattagagagtactacaacgctgacggtgaaattagacctggtagccaaggaatcatgctaaccatggattagtcggaaaaattcacaggtttcgtt

SEQ ID NO: 14091 - DNA, 377 bp, Diabrotica virgifera
  misc_feature (7)..(49): n is a, c, g, or t
  misc_feature (261)..(278): n is a, c, g, or t
aaaccannnnnnnnnnnnnnnnnnnnnnnnnnnnnnnnnnnnnnnnnnntttttaacatcctttaaaatccgataatataatgtaaccccaactgtttaatatcaatttaagggtttttacccgtacattttggtggcttaaagcatgtaaacctaagttgataatataaaacgggcgtaattttgtccgggaaaaatttagttaatccaacccgtgtaagtaactcacaaaattagagacaacccatttggaggtgccgnnnnnnnnnnnnnnnnnncacacacatccatacataccgaccgaccgattttattaccagacatcgctaacttcacattgaggagggtgtcatccacaatgaaagtggtattacatt

SEQ ID NO: 14092 - DNA, 378 bp, Diabrotica virgifera
  misc_feature (319)..(339): n is a, c, g, or t
aacacgcgtccgaattttttatcgtattttgacaaacaatcatacgtattaaatcaaatcataaaataaagaaaaatacatttttccagttaaaattcgtttcatgataatatggcgtataccataaagatatttaggatacacgttacgttagaagtaaatattggttctttaaccttccgatgaccaacctttttttgttacacggatgaccaacgggggtaaaaaatgaccccaagtcaaaaatgacaattgacaaaaaaatgaagttgttttaagaaatgtaataatgtattcgtaattttaatgttactattgnnnnnnnnnnnnnnnnnnnnncattagtaaaacatatttttaattacaactgaacaaaaa

SEQ ID NO: 14093 - DNA, 418 bp, Diabrotica virgifera
  misc_feature (45)..(69): n is a, c, g, or t
  misc_feature (302)..(317): n is a, c, g, or t
atccgaattactggacaaaatctaattattggggttcccataaannnnnnnnnnnnnnnnnnnnnnnnnctgcagaacttacagaaatgtctaacattgtggatagtttaacagaaatgggattcagtaggcaaagagcagaattagcagtaagtcaaactggtagcaataatcttgaacaagtaatggaatggctattgtctcacgaagaggatgaagccatgccagtaactacaaatcctccaaaagcaccagaagcagcttcagaaattgctagtgaaaatgataataatactcaatcnnnnnnnnnnnnnnnngtttctgaggaggctgaagctgtagctaaatcaattaaatgtgatgaatgtgggaaattgtttaaaaccaatgaagaagttgaatttcatgcttctaaatc

SEQ ID NO: 14094 - DNA, 440 bp, Diabrotica virgifera
  misc_feature (26)..(26): n is a, c, g, or t
  misc_feature (192)..(192): n is a, c, g, or t
accaaattgtctcccaccaccaacanattaaaggatttagatttttcattcaataaggaaaatattgatgaaaacaaggataaaacccctgtggctaaacaaccttctaccttcgaatacaacagtaaagagataaccagtatgatcaaatctcaatcccttagtacctttaaggatcaatcttcacctcanataggtatggtaaaaagtcagtcagatctggtcacatttaataaccatatagttggcatacctataatggaagttgaaagagagcagtatcaggagataaatgagaaattacagaagtttgaggatgaggaaatgaagaagcaaggtgtgattcaagatttagaattgcacaataaattgttaaagcaagagatggaagaattcaagttagaattacaacgcactcaaaggtcattagaacaaaccaa

SEQ ID NO: 14095 - DNA, 427 bp, Diabrotica virgifera
aacacacgtccgctgacatttctacatccgaagcttgatcgagcaaagttttagcttgaataagtttaattacttttttattaagactattgaatttaattgaattagaaatttccaccttatcctgaacatctgacatagttattaatattgatacaatctattatttcgaccaaagaatcatacattaccttaagttgaggtaatttaatcttccatagtggtcattgcgtcaggccatggagttggagtatctacattgtaaatgtcgtgtaccccatcttcaatgctatggcatgctggacgagccatacagtctgtaatcaacaccccgaggtgtgagcgggaacacaaagtgtatcaatactcttacgcttatgaagcgcacctggctcatcataagggccttcacattttactctttttc

SEQ ID NO: 14096 - DNA, 346 bp, Diabrotica virgifera
aaataatgaaaaatgaaatgatgcaacaaacaattgcaatttgcaagtatatttatctacagaatgtggaaataaagtttatccgaatttactttatataactatgtatagaatcaaccaaatttagtacttttagaaggttctgcaagcttacaagtgaaaatggttgttatattatgttaatatcaagactgctgcaatttctatttaggaaatgtgacactggaagggccttaagctgactaggccatgttcatacaatcaaattataaggatagagcctaccttgattagtggattactgcgtagaattagtcctaccactaagctcgtagtccgtagccac

SEQ ID NO: 14097 - DNA, 355 bp, Diabrotica virgifera
aaatcatggcaactatacgtgaacacatgggacctcttcctcagattcagcaactccctgatggtgaatatcaagaagtgcccccaaatataaaattcggtcatccaaagttttataaactgaaagagattttactagagcattttggtgaaactggagattctagtagggttattgtgtttttcgagtatagggaatctgtaatggaagctttcgtactactgattcagtcgaaaccagtgttgaaacccaggatatttattggacaggcgaatggagtcagccagaaaacacaaatcagtgtagtgaaagccttcagagagggccgctgcaacgtgctcctatccacaagcat

SEQ ID NO: 14098 - DNA, 381 bp, Diabrotica virgifera
accacacgtccgcagtaatcaagaccagcaaaaatgaattacttggaattctttgtttgcattgttgcctacgcatctgccacagcagtgaatctcgcatcattcttggaagccaccaacacaacaacaacatgtgcttgcaaacaatccttggacaatatccttgccaaaataaaagaacaaaacaccaatttgaacaatgctaatgtcacactgaattccatagaagtaaccattgtcaaaaatgtcagtgtcgaagttgccaaccaaacacaaacactatgcaagttagaagaacgcctttctgtactcatcaaaaaagaagttaacattggcgttatactcgacgtccaaactactaatcttaccaacatcgtcaac

SEQ ID NO: 14099 - DNA, 386 bp, Diabrotica virgifera
accatattcggggcacctacgcgtggctcatcaaaaaccgatgttcgtccacgttgaaactcattaaaccaatttttgacagttgccatcgaacgagaagaggcaccgtacacagcatccaagcgctctttgatgtcgctgcgggatttcccttccaaaatcataccataatttggatttggctgaaattttgacattagccgtttacgagaacgcattaaatgacagtacacttcatttgcgatagtggcgccatcgggcggagaggctaagaacttatctgactgccctagtatctgagtgtttgtactatgtattcaaataatattagcgatattttttttgtaagaaatctcaagaattataggaaataaagattttgaatt

SEQ ID NO: 14100 - DNA, 430 bp, Diabrotica virgifera
  misc_feature (19)..(157): n is a, c, g, or t
  misc_feature (257)..(275): n is a, c, g, or t
  misc_feature (295)..(323): n is a, c, g, or t
  misc_feature (365)..(390): n is a, c, g, or t
taaatagattcatataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaccctacatctaattttaatttaccaataaactgattaagaacagtattaggtctattaattattccatctagattttgattaatcccctctcgnnnnnnnnnnnnnnnnnnnaagattattataacattacnnnnnnnnnnnnnnnnnnnnnnnnnnnnntataaatcccaaggaagaacattaatttttatctcactattnnnnnnnnnnnnnnnnnnnnnnnnnnttggattattcccgtatatttttactagaacaagacatat

SEQ ID NO: 14101 - DNA, 412 bp, Diabrotica virgifera
  misc_feature (14)..(411): n is a, c, g, or t
taaggacacttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 14102 - DNA, 411 bp, Diabrotica virgifera
aaatcgtatctgcgtacaaagtacacacatgtacaagaattcatctgtactcagtagatatatcttaaaaacaccctgtaattatctacgataattactttcagttatttatgtcatcataacaatattacaaccttcattcgattatacaaatattgttatcctagatcacgattcactaataattgcagagtcaattataaccacttttcatggtcgatgctgaataggcatttctaaatatataaacagcaaaactataacaagggaattcttattattatattagacattcgtcattctattttgtgatcagacgtaatatttccacattaaagatagtgtctctttttcttcacgagacgttctttgggtgcggtgcttacagcttatgctcatgcgagtgtaaat

SEQ ID NO: 14103 - DNA, 427 bp, Diabrotica virgifera
accacagaatagtagagagcagcgaaaagttcggtttatcacttaacatcaaaaaaacaaaaataatgatggtgtcgaaatctccacaaaatttttctgacataaccgtacatgatcaaagaattgagcgtgttagaaaatataattacctgggaactgtgaataatgaaaacaacgacaactctgaagaaatcaagatcagaatagaaaaagctagagctacttttaccaaaatgaaaacagttttatgcggaagagagctaagtttaaatcttaaaattcgcctcatgagatgttacgtgctgtcagttcttttctatggaatggaagcttggacactgaaaaaggtcgatacaaggaaaatagaagcattcgagatgtggatgtaccgcaggatactgagaatatcgtggacagagagagtgac

SEQ ID NO: 14104 - DNA, 142 bp, Diabrotica virgifera
  misc_feature (104)..(130): n is a, c, g, or t
aaatagatgcaggcttgccagtatctttaccttttggcataccctataccagtcctgtttttgtgacggtacgcgccggtacgccgtaccggcaccttttgggnnnnnnnnnnnnnnnnnnnnnnnnnnnttataaacaaaa

SEQ ID NO: 14105 - DNA, 438 bp, Diabrotica virgifera
  misc_feature (393)..(406): n is a, c, g, or t
  misc_feature (408)..(422): n is a, c, g, or t
agacgttcgatccaagtcaataaggcacaaattctctgcccacgaaagcgctgtaaaatgtatagccatcgaccctcacgaagattatttcgccactggatctgctgatggagatattaagatctggggtgtgacggttccaaatgtccttctatccctaccagcagaacatgctcgtagcagcttcttcaagaacattggtcaaggagtcacccagttacacatcgataatcattctcgattattttcgtgcggagctgatggtagcatgaaagtcaggcaattgccagaaagggaatccctattgagtcatcattaaattaatagaaatatgtgttacttttatcaaatatgatgcctacgttatttcagcctaaacaatagtactatgannnnnnnnnnnnnngnnnnnnnnnnnnnnncagagtttattctaat

SEQ ID NO: 14106 - DNA, 413 bp, Diabrotica virgifera
  misc_feature (29)..(46): n is a, c, g, or t
  misc_feature (320)..(320): n is a, c, g, or t
gaatacttaaatttaagactctatgacgnnnnnnnnnnnnnnnnnngggtttgtttcccatatcttacagctatacttctagttctgtcccatagcgtcctactatccagttattaagggtttttatctctctatgtcagctcatactggtgccgatattcacctgatcttccacttctgttttgagatttccgcagctagatagtgtaattcctagatatttacttcatcacttattctattatctgaccctccagctccaataaaccgccagctacgacaaagatcaggagtggctgatgcagtagagggaatagcanaactgaaatggaaacgggcaggtcacgtggctcgaatgacagataacagatggacaaagtggatactggaagagagaccaccaggagatgatg

SEQ ID NO: 14107 - DNA, 341 bp, Diabrotica virgifera
  misc_feature (12)..(43): n is a, c, g, or t
  misc_feature (62)..(95): n is a, c, g, or t
  misc_feature (97)..(120): n is a, c, g, or t
  misc_feature (134)..(159): n is a, c, g, or t
  misc_feature (177)..(189): n is a, c, g, or t
  misc_feature (192)..(220): n is a, c, g, or t
  misc_feature (233)..(269): n is a, c, g, or t
  misc_feature (307)..(319): n is a, c, g, or t
  misc_feature (321)..(340): n is a, c, g, or t
gtaattagtaannnnnnnnnnnnnnnnnnnnnnnnnnnnnnnngatttatgtgttgtaccgnnnnnnnnnnnnnnnnnnnnnnnnnnnnnnnnnngnnnnnnnnnnnnnnnnnnnnnnnnctattaaattaggnnnnnnnnnnnnnnnnnnnnnnnnnngataagttttgtgtaacnnnnnnnnnnnnntcnnnnnnnnnnnnnnnnnnnnnnnnnnnnncattaaatttacnnnnnnnnnnnnnnnnnnnnnnnnnnnnnnnnnnnnncaataatattagatatttttacggatgagcttacaggnnnnnnnnnnnnngnnnnnnnnnnnnnnnnnnnna

SEQ ID NO: 14108 - DNA, 58 bp, Diabrotica virgifera
atgcataattatggagtaacatccttgcctatcacggttcatcctgtagcattaactc

SEQ ID NO: 14109 - DNA, 353 bp, Diabrotica virgifera
  misc_feature (217)..(251): n is a, c, g, or t
ctgaatacgctctatcgatattcactttgacactgacgttagtaatttctttttttaaaagttcagttgtcagaagtgactggaaattactacaaaaccaacgcacctgctcatagccaatattattaatagtaaacagacataaaaataacaagcatcttacgccaatcaataattatttatttgcaccattataatgtattaataacaactgagnnnnnnnnnnnnnnnnnnnnnnnnnnnnnnnnnnnagaaataaacttcacaaaattttatgagattagtagacactcccactatttctaataattcttcttttttaatgaaagattaaagttgatttcagttgattt

SEQ ID NO: 14110 - DNA, 375 bp, Diabrotica virgifera
  misc_feature (83)..(100): n is a, c, g, or t
  misc_feature (285)..(303): n is a, c, g, or t
actacataagccgaatgacaacaaatgtatgagttttgttatgctctactttatctctttatttagattgattagcaaattcnnnnnnnnnnnnnnnnnnctaaataaagagataaagtagagcataacaaaatggcgcccaacgtggagccattttgttatgcgacagtgacaacagcgaaagacagttccccaatagaaagacgattagtggaaagaccacgaaaacgatggaacgacaacttgctggagacacattgaaaaaaacagacagtcttgtctgcnnnnnnnnnnnnnnnnnnncgcgacagagtcagatctgcacgtagttctgcagtaaatttttaaattgctgctttgttttcaactttccta

SEQ ID NO: 14111 - DNA, 374 bp, Diabrotica virgifera
acgagatgtcgattctgtaatttactcataactttctaaacgtaataagtatgtattggaagacgtgttttgtgcaaactgtgatacttattttaggatatttcattataaccgatggttatgaacaaaaatcaagagtcaaacgacctagagctccccctccagaacctgagaacgacgtagaaagtgatttcgaggaacgaaacaaagaattaaatccgaactacgtacctccgggatttcttagtccgtcggtcattgagtatctggagctaggaaagtccataccaggaaaacccggttctgattatcccgttttaagcatagtaccctacacaaatttctattgtgatgatcaatcgtatcctggattt

SEQ ID NO: 14112 - DNA, 215 bp, Diabrotica virgifera
aaattggaggtggcagtgacggtggattcggaggtggattctgacgcggtttctgaagtggtcactactatcatccaattgcagatctacgtcggggtacccccagcagaacgtgaataattctggcgtcattgactagtctccgttgttcaagcccagagtcactactagatcatcgtcattatcgccccatccgcacccgctccatctgctct

SEQ ID NO: 14113 - DNA, 364 bp, Diabrotica virgifera
agctgcatgcgggcaattcactaacatttacagaatcgcattcctgctgctatgctgcagtgctgcaatcgacttatctcttttacctgttgagtgtgtgccgtgtaagtacgcggattcgaactccggttagtttcgcattaggccagtacttcttgtatttattattggcaggttttgaaaaaatgtttctttatgtaaactgttgaacgtgagggttttaaccacagttcagtgataagaataaggtatttaaggtagttgcttgtgctgttgcggtgcgttttgtattgacatgcgaatttggggagcctgaaagaagccagtggccagtttcttacaactatttcgagaagacaggacg

SEQ ID NO: 14114 - DNA, 128 bp, Diabrotica virgifera
  misc_feature (4)..(4): n is a, c, g, or t
ctcngccttttttctccgactcagagaccctgaagagttttaggtgctgagtaagaagttttttgaggactgaagtgatttcatgtattctcagagccgtgtacgaggagttggattactaattgggg

SEQ ID NO: 14115 - DNA, 366 bp, Diabrotica virgifera
  misc_feature (18)..(18): n is a, c, g, or t
  misc_feature (40)..(58): n is a, c, g, or t
  misc_feature (81)..(81): n is a, c, g, or t
acggacgcatggtttatnttttaaggggataaatatttcnnnnnnnnnnnnnnnnnnnataaaatcattataggaaattanaagtagagatgaataaatgtgtaaatgtgtagaagttaatgggaatatatctattcagaaatatcttctgcttaacttaaagtttaatacttaaatcgaaatgcactagcgcctgtctcttgaatcagatcgtgctctggaatctcggcttctataacgagacctcgaccgtttcggtgacctcgaccgttttggtgacctcgacattatcagcaatgtttccctgttgtggggatagttgaatgagttggaaacatcactcagttgacggggcggcaggtaaag

SEQ ID NO: 14116 - DNA, 429 bp, Diabrotica virgifera
  misc_feature (135)..(135): n is a, c, g, or t
  misc_feature (187)..(187): n is a, c, g, or t
accacacagtcgccaacgcgtccggtaaaaaattaacaaaacaacagtacaaagttacgtaaaagtttgaaaaacattcaattaaaatctttaccctatgtatttctgtaaaagtgaggaagcggctaattacanacagactgaaaaacacacttacactgattgcactacattcatactcctttanacgggaagtaagctacatagagagttaatgtactaaacgaagtggaaacccattttctaaattttttcgttgcggtttctttgagatgtttgttgctctgaaacgaattaatcatcttatgtgtcgggctttggtttgttcctggtgttggttattttgcaattaacgcatgaatatataatacaagtatttatgattatttcattcataggagattctgaccaataaaaacctacagaaat

SEQ ID NO: 14117 - DNA, 391 bp, Diabrotica virgifera
agaacttatagcatcacccgccctgctttatacggaagaagatgcgaaatcgttcatagatgaaatacgaactgaaaaagcgataaaggaatcaattgatgacgacacggaaacgaggtgttcggaggattcgatactaaaagaaatacatgtaaacgaaggaattagcaataataaggaggaagctgttaggaacgaaaatgtagaaaggaaaaagagcccaagtccgaagaaagaaacaaatgataaggaagaagacagcgacggtgaagacgaatccagtaataaaaatagtgataagctgaataacggccaaaaaatgaatagcgatgatgaatcagttagtaaagaaccaattgaaaactgtaaaagcgaagaaagtgataacaat

SEQ ID NO: 14118 - DNA, 435 bp, Diabrotica virgifera
  misc_feature (162)..(181): n is a, c, g, or t
agtgcaatttgttgaagattttggacatttattgaaagtaatctctatactttttgttgtacttagagtagatatgtagtaggttggagttgatgacacgatacaaaaaattacgctcaacatttttttaatgaaacacgtaatttgcatctatcagtagcnnnnnnnnnnnnnnnnnnnnctttggttgaaagactgatacattttgtacacacttgaacgaatcaaggaagtgaaaaaaatgtatatcaaagtgtgtaaaaagtatttatttccttagttaagcgcttaccaaattaagtatttccaaaatttatacattataaataaatcatgattcgagagtgctcttagtagcatttaacgtgtcttggtttgtttatttctactgcatcttggttgtaagtttagtatgtatagtgagatcattttttg

SEQ ID NO: 14119 - DNA, 138 bp, Diabrotica virgifera
acttatatccagttatctgcatctgaactgaaagtgtaagttattagatagtcagtattgttaaacaatcaaaagtttatgctgttttaattgaagctttattagctaatcaaatcaatatgcagcgctggtttttct

SEQ ID NO: 14120 - DNA, 417 bp, Diabrotica virgifera
tagatatcgtctcatgaaatagggcttcactgtacaggttaagcagtagcggcgacagaacacaaccctgtcttactcctctctttatatcaatattctcggattcttgttcttctgtctttatattggccttttgattccaatacagattgatgatatttcgtaaatcccgtctgtctatatctctgtttttcaataattctattagtttttcatgtcggaccctgtcaaacgccttttcgaagtcgatgaaacagaaataaatatccaggttcatatctaagcatctttgagagaggacattaaacggaaacaatgcctctgttgttccaagtcctttgcggaacccaaattgggtatcatccatatcaaacggatggtagtggtctctaaatcgtaattaaatcttagctgccg

SEQ ID NO: 14121 - DNA, 401 bp, Diabrotica virgifera
aacgaactgtacatgaaatcgaaaaactgaaaaatacgtgttcaataattttcaaaaatctatcgaatgacaccaaacacgatcccccactccaacccctggatgtggggagggataacattaaaaccttaaatggaaaccctcagtttttattacagatttggattccttacgtaaaagtaagcaacttttattcaagacatttttttgaattgtagatagatggcgctataatcggaaaaaaccatttatcgtgatatatatatataatggatttctacggctgtcgccgcctctccatacccagcttccaattttttctatcgtaacacgtatcttcatcaaattgcctcgaatccattgcgtcctgaatattgtcgctccagcttctccgtggtcgt

SEQ ID NO: 14122 - DNA, 368 bp, Diabrotica virgifera
ttcgcgtgatgtgtgtgtgcacttatggcttaatagattgataattcagatagtgtgtcatcagcttacgctcgcccattagggattgtggacctggagtatgcggaagaagtaatgggttcaaatatttcaattccatacacattttcaaggctactaacagcctcgatgttgtcattttcattcaccaacacgtctctatgattcagcgtctaccacgcagcgttagtcacatagctggacatcaaacatctgctgaatcatggtgtaccggacgagcagttgcacattttcaccttgttataggaggtgtactcatcgtactggtctaggagcattcggtaacaggtgtagtcgtgtgctcatgt

SEQ ID NO: 14123 - DNA, 399 bp, Diabrotica virgifera
gtcgtatttcgccctacttttcattattggagttgtgtatgttcattgtcgatgtaaactgaccatgaatgacaagatctgtccattggataatttcatacgaatggttaccgagataatttagattcgaaggatattagggatcgattgcaaaaacataaagacttctgttctaagaagtaccaaaagtaccactatttactcaaagacatttccgtacgtttaagagaacacaattgtatcagagctatggattctattagaccagtatttataatgttggaggatttgagattgatgactaatgatctattgcaatcggtacgacaactatgtgtgctgaactgtgaacaccgcatgacgatatgctggaatttggttaccaattacatggccata

SEQ ID NO: 14124 - DNA, 419 bp, Diabrotica virgifera
aggttggagttggtgaccttgtacaattaacaaaacttctcaataacaattcaaagttagatgccaaatagatttggcatttttcatgatgtttttaattttctccgatcttgaacatctatttttgcactattactaatttttcgtggatatgtaggtaaaatacatagtgagaattgagtaggatcaggaaaaatcgtgcagaaaaaatgacaaactaaatttaacaaatccaggtatctgaacttttttagttattgtaggcttatgtatataaataaaagctatacattttctgtagagattttggcgccttttttaaataattaacaatttattgtaaaaaatgccatattttcaacttaggttttcttcgtataggtctataatgactaaaacaaatcacatacctgaatttg

SEQ ID NO: 14125 - DNA, 355 bp, Diabrotica virgifera
  misc_feature (156)..(185): n is a, c, g, or t
accaagcctccgggaaaaaaggttgtggaaaaaaaaccttaataaataaattttggaaaatccccatttaacaaacaagccaagggcaattgcataagaaatttccaaccttcccggaaaccggattaaggataccaaggaccaatccgggcgggnnnnnnnnnnnnnnnnnnnnnnnnnnnnnnaaggaaaattagaaaccacccaaaaaacttgggaaaaagggccttaaaaggaacatccggaactttaacagaccaaacctaaggccccaaacttaagaccaccacttaaaataccatttgaaaagaatttgaaattgacccccaaaaaacatgggccattaaaaaccatt

SEQ ID NO: 14126 - DNA, 379 bp, Diabrotica virgifera
taccacgcgtccgatgcagatgaagacgaaagaatccacgttaaaggaaatgctttagaaaaagtacatggatacaggatacaaagaagatatgacgatgagtatatgggcataggtcccttccacagaggaagaccctatcaaagtggtccattcttcgttggtatgcctcgcagaacagaatctagcgatgataaacacgtgatggctcgccatgctgaaatatatcctaaagaggacgaaattcaatctatcgaatccatagtttcgaacaccgaacgggctctgaagattgtatcagattaaatagcagacgccaagaatcccgtcaagaagttggatccagctgcagcagccgctgcggcagccgcagccaaag

SEQ ID NO: 14127 - DNA, 269 bp, Diabrotica virgifera
aggcatcactatacacatcattaccaaaatccactcgcctcgcacgtccttcgtgcaatgcaatgcagtgtcatactgaaacgacgtcaacagggattacatctacacattagacacgatcaagtcccactcatacatgagttccttctcaggactcgtcgtggaatggcaatcatcgcacgagacttcgcgtccgactcatgacggagatggttcgtcgtagttccaagcaaccaacatgatcattcgtgtgcgcgtcaaggatcagc

SEQ ID NO: 14128 - DNA, 374 bp, Diabrotica virgifera
  misc_feature (241)..(265): n is a, c, g, or t
tgcgtcacataaagctagtttttaaaggtggttcttgttcatatttcctttggtttttccttagaacatatcaaagcaatcttgtccaacacttctctgatgaaattgtacagtgtaattatcctaaaacttccttttcgatgagtttttcttaatcagtttcgatttttatctaaaatgtatacacctcttcttctaaaggtgtctatcttctggtgatgcgtatcatcagatacttcannnnnnnnnnnnnnnnnnnnnnnnnaatatgaaataacaatataccgtaatattaagaatttcttctgtttaccatacaccaattttcatttttagatgctcattagtcattcggcacctctatttttaatcaa

SEQ ID NO: 14129 - DNA, 303 bp, Diabrotica virgifera
  misc_feature (235)..(279): n is a, c, g, or t
cgtggcaaaattattcatttaatccagttcccatgtacagttgaatttcgccatgttgaggctccctcggtctggggcggggtcaatggtcgtcaaggttcaaaccggagtgcacctggacgtccctcaatccgttgttatcgacgtcatcctttgcggtcaagtgcatgaaattggttggcggctaagtggaggttgtatcgtagttttcgggaaaggtgagattcttgccggnnnnnnnnnnnnnnnnnnnnnnnnnnnnnnnnnnnnnnnnnnnnntgtagtactggagggggagttcgt

SEQ ID NO: 14130 - DNA, 401 bp, Diabrotica virgifera
aaataatgtcattataataatcaaaatttgcgcgtactatatgaagagcttccacaaaaatgcgttggccgttagtacttcttaagtaacgttggtggggacatttataatacctattcccttttcaggtcgcaaattgtgtcagttttagtctaaaatattataaactgagttgtgctacccttgctcaaaattatttcggtgaaaaatgtcaaacaaaagaaagtggttatcattagaagcaaaaatcgcgattatcgaagagtctgaaaaaaccaaaaagagttcccggatactcgcaaagcaattcaacgtgggaaggacgcagatctgtaccattttgaaagacaaagaggccatttataaatcgtgggaaagaaacggctgctgtgttaagtcgg

SEQ ID NO: 14131 - DNA, 343 bp, Diabrotica virgifera
cgatgactctacttgtgcgctatcggtctccggccagtctttagctttagatgacatttaccagcgatttaggggtgcattcccaaacaagtcgacgcgtcgagggagcttcacactggactcggacaccccgtcgcacacgggattcgcaccctctaggacgggtcgttccagggcacttggacgggggccgcacccgaagcatgctctgcaagttacaactcggagcccgaaggggccagatttcaaagttgagctcttgcggcgtcagtcgcggttacggaggcaatcggggtggattcttttcctgggcttagtgaggggcttaggttcagcgggtagc

SEQ ID NO: 14132 - DNA, 281 bp, Diabrotica virgifera
taatttgttctgagttgaataacatgtttatttcagtttgtttatttactaaaaattgtctagatatactggcaagattccaaaaggatatttttctgattacatcaacgttgactaaagcagcctgaaagtagctgcttcttactctacagcgttaacaaggtacattttagtaatgtaatctggttaccgtttaattttactcgaacatagatgtctctaaagagtgcactaaagttattgtgatactgtgagattatctggcaataaacctttctgga

SEQ ID NO: 14133 - DNA, 355 bp, Diabrotica virgifera
  misc_feature (47)..(72): n is a, c, g, or t
  misc_feature (92)..(108): n is a, c, g, or t
  misc_feature (114)..(138): n is a, c, g, or t
  misc_feature (312)..(329): n is a, c, g, or t
atgacaacaatgacaacaataaaaaccaacaaaattaaattagtaannnnnnnnnnnnnnnnnnnnnnnnnnggaactagtactttacttcnnnnnnnnnnnnnnnnntgcttnnnnnnnnnnnnnnnnnnnnnnnnngtaatcaaacatacatatggtgcatctcatcagtcaatttatcgaaatgaaaataaaaaaggatttacagactttttttctttttgatagttgaggtagacaaaatatatacctatagaatagtttttgctacatacttctatgtagcgaaaaagcttaatattaacattacannnnnnnnnnnnnnnnnngcacaattattgcaagacaagtgtga

SEQ ID NO: 14134 - DNA, 319 bp, Diabrotica virgifera
aaccaagcgtcagcagtgctctacttgatttaatacaatgaacaatacattggtagttttgtgtcagtgcataataatttttgaaagtaaagctcttacatttcaaggttcaaaatatcctcaaactcaatcaacctcagtcagtgtcaaactacagacagtttaaaagaatcagtactatagttggatttgcctttacaggaaccttctttgaagcgttgctacactgtaaactacccaatatggacataatgagtgttgagacctaagcagaaaatgagtttccttttgataagataaaggcgccatctggaggtga

SEQ ID NO: 14135 - DNA, 308 bp, Diabrotica virgifera
  misc_feature (12)..(36): n is a, c, g, or t
  misc_feature (40)..(68): n is a, c, g, or t
atcagcccacannnnnnnnnnnnnnnnnnnnnnnnnttcnnnnnnnnnnnnnnnnnnnnnnnnnnnnntgttgctaccgttttgtgcgtcgaaactgccgcctacgcagcgccgactaattagcatattgaagctagcatgacaggtcatgagcattgtcaattccaagagtcaactatacttgactaccaagtatgggaaaaacttaaacatggctataaagcagataacacaaaactgccagaacataccctatgtttgaacgtatatactggacttcaataggagaatggcgatattaacgtgga

SEQ ID NO: 14136 - DNA, 241 bp, Diabrotica virgifera
agtttgcttacaaatattgctgagacacactaagactggggttactcatattccaacaaatttacacaccttgcatttggactcacgttcaaccgtcactgcggggatgtacgatcctaaggatgataccatttccgcacatcacaccatcactgttgccacccacggaagatctgatctatagattgacgctacagacactgatagcgctgaccgtgccagtgatcaacatgacgtagtc

SEQ ID NO: 14137 - DNA, 401 bp, Diabrotica virgifera
aggtgatatgccacctagtgattcagaatctgataaaaagctagagagtgatgatgataatgatttttaccaatcagataatgaagagcatacagatcctggtgagaaatgggttgattatgtggactgctttggaagaacacgaaaatgtatgcagaaagatctagaatatctaaaatccaaagataatgaaatgaaaaaagtcgtagaagtgaaacatcaacagttagataatcctgcatcacaaaatcttgaaaatgatgacaactttgttcaatcaagtactgaatcactggctgagaatgaagtaggtcaatcagaattgctgtctagtgatatgagaagggaactgctacgacaacagtgggaaaaagaggaagaagagctgcgtaataaatcag

SEQ ID NO: 14138 - DNA, 323 bp, Diabrotica virgifera
aactcacatatcacgtatgcgcacctgtcagactgagaatttatgttgcttagcacataaagtataattactaactgatattgtggaatgagctatttttagctactgatttgttataacagcagagattactttgaaggtaatgtaattcgtcagactgattgtaatattcaagaatcgtgtcacatagcactttagattatgaggtatcgttgacgttcgtggaaaatcatttgttctgattctgtcatgagtgttaagtaaagggaacacacatttcaacagaaacgatagatcgttgctctgaatatcaatttgtgttg

SEQ ID NO: 14139 - DNA, 391 bp, Diabrotica virgifera
  misc_feature (139)..(160): n is a, c, g, or t
agcccacgcgtccggtcatttgtcatataaatagcaaccgcgccaagaaaatcatcaagttcgtttggaaagctgcattactagctaatctgaacgtctgtcgtaattttgtttcatttgtggtgtaaaagttaaaacnnnnnnnnnnnnnnnnnnnnnngtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtaatagatgaagtacgtaccg

SEQ ID NO: 14140 - DNA, 336 bp, Diabrotica virgifera
aggtttcgtgtaaaacttcacgtactgcgtttagaaggggaattaccaatggagctgaatggtatccgttaactggaggtatgcaagactacaattacgtctggtacggatgtatggaagtaaccctagaagtatcgtgttgtaaatatcctcctgcgcatgaattacccaaatactgggaagataataaacaggcacttataaagtttttggcagaagcacatcgaggtgttcatggcttcgtcatggatgaaagtggaaacccgttaggaaaagcttctttgaagattaaagctatggacgttggtttccaaaccaccaaatatggagagtttt

SEQ ID NO: 14141 - DNA, 359 bp, Diabrotica virgifera
agagtcgtgatattgttgaatttttgtatgaagcagctctgaaaacactaaaaatggtgttagaaagtactatgatttgtgtcgataatagcgactatatgagaggtggagatttcctacccagcagacttcaagctcaacaagatgcagtaaatttagtatgtcattctaaaacaagatcaaacccagagaataatgttggtttgttaacgttggcaaaggtagaagtcctagcaacactgaccagtgatgtgggccgtattttatctaaattacatcaagttcaaccaaatggggaaataaacttgcatagtggtatcagaatagctcagcgagctctaaagcatcgccagggaaag

SEQ ID NO: 14142 - DNA, 222 bp, Diabrotica virgifera
  misc_feature (47)..(99): n is a, c, g, or t
  misc_feature (101)..(113): n is a, c, g, or t
ctcccagtccaatacactactctacacagactcatagcaagcggctnnnnnnnnnnnnnnnnnnnnnnnnnnnnnnnnnnnnnnnnnnnnnnnnnnnnncnnnnnnnnnnnnnaacattaaccggggcaccaaaattattctagatctatagccctttccgtacaacaccttttagtacatatactatacaaaccgacttggcttaaacgcggttcaaactc

SEQ ID NO: 14143 - DNA, 364 bp, Diabrotica virgifera
agggagtgggttgaggttgaggaggtggtttcagcggtttgtgaaagctgaaatcgcttcaataaatttacaaaatttttaaattcctttaaataatagtttgatgtatttttaacaaattaattgcaaatgaaaaaattattcttcaaaattataattatgtcaagaagtatgagaatacggctaaaaaatttattttagtgactcttcaatagtgctcaacattgattaatgtgattattatttaagcagtaccattcacatttacatattcttctctcggccgcagtagaggagattttgattatccaataaacttacgatggaggatataatatcgtcagtgcatcggccgatgtaacat

SEQ ID NO: 14144 - DNA, 70 bp, Diabrotica virgifera
aaatactatttaataattacgcatcaataatatagcaaactcatgatatctgaaagattaggattcatat

SEQ ID NO: 14145 - DNA, 392 bp, Diabrotica virgifera
  misc_feature (363)..(382): n is a, c, g, or t
agccaccattatcagaaacagaaaagaaagcgataataacggagttagagcctgtttatagagaaaatggggtattatctagaactatggaagaagcagcaaaggttaaacctaaaaagaagaaagttacaagaatcaaagagttagagaaattagacaaggaattcgaagaattgaagaaatctgaacttgaaaaagttgacgatgcattcaaagaaaaaccaaagtcgaagaaaaaatctaaacctgtcttaatgaaaatagttaaagtagagcaggtagcacaaaaaccgaaaataatcgaaataaaagaagaacctattaaccttgcggatatcaaattgaagaagtccagagtgcccnnnnnnnnnnnnnnnnnnnnggtaaaaata

SEQ ID NO: 14146 - DNA, 342 bp, Diabrotica virgifera
  misc_feature (33)..(63): n is a, c, g, or t
agatttgtaaacaaaggaaaatgtggatattgnnnnnnnnnnnnnnnnnnnnnnnnnnnnnnncaatatgagcttaactaaaagtcaccacgagcaattggaattatgtactaccaggccggcatacagacaaggacgaaaattaactgcagtcaaggtttacacaattaatcaggaatcccaacatctctacatctatggtgtaccttcactcaaattacatcatgagctaaaaactaaatgtcttaggtatggaaaagtggcatctatagctgtagtagaagacgcaaacaatgttccctttactgaatgttaccatatcgagtataacagaatacagtc

SEQ ID NO: 14147 - DNA, 175 bp, Diabrotica virgifera
  misc_feature (3)..(80): n is a, c, g, or t
  misc_feature (95)..(137): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnngttttatatattagnnnnnnnnnnnnnnnnnnnnnnnnnnnnnnnnnnnnnnnnnnnattagtttagatttagtagatgatgaataatattaggt

SEQ ID NO: 14148 - DNA, 323 bp, Diabrotica virgifera
agaaatatgttgtgggctgataaatatcgtcctaaggacttatcaagtgtagactaccacacagaacaaagtgtaaatttgaaaaatcttacaaaagatggtgatttcccccatttgcttatctatggtccattgggggctggtaagaagactcgagttatgtgtttgttaaaggaattatatggtggctggagtagacagattgatcgatggaaatgatgcactttaccaccccttcaaacaagaacttagaaatcatgactttgagcagcaacgagcacatagaagtcaatcccactgatgtaggtatttacgagagagtt

SEQ ID NO: 14149 - DNA, 345 bp, Diabrotica virgifera
agcccacgcgtctgggaacagacagctgatgccgcaactgaaacggcatctacagaggtacacaaatcaggtgtcaatggcacatatgtatcattacacagttctgggtttagagattttcggtcaatatcagcatatcgcataactatatgggcctgcgggttcaaacatccttcagaatttcaacatgaatgtgttcctcaagctgtcattggcattgctaatctgtgtcaatctagatccctgatgggaaaataggctgtttttgcataacctaaactccggattataaatcccacagaatatgtcgctaaagttctcatcatatgccataccacagagtta

SEQ ID NO: 14150 - DNA, 402 bp, Diabrotica virgifera
atcagcgcaatctctccggttagattacaagaaataaagtattacaagaaatagcaacgacctaagaaaaagtgaggcgaattatccaactgcttgtctgttacactttgattggaactacaaccttatctgtgtgaaagtgatagttggcgattgtcttgtttgaatcggttcaggtggacatttcttcagttaactgtaaacttctgcagaaactggaactcaactcgctgaggcctaatcgctggtcaggggattggtcattgaaacgtgaaagtgaatttcacacacaaaattggaataactgttaattggactcaatataatgaacacattagcaaaaaagtctacatgcaggtgaaaatgtcaacacaataggtttctacaaaacaaacatggctc

SEQ ID NO: 14151 - DNA, 399 bp, Diabrotica virgifera
accacacgtccgaaacaatgcattttggtgtattgaataatacttatagttaaagtgtaatgtaacaatagtaacaattgatatattagagattgttaaatatggtgtctggccctatagatgtttccgttctaataatagataatgacacttgtttaattaacaaaaaatctaataaaattattagtaatgtgtatgaaggaattccagagactttagtactgaatgttgtgtcatggctgctacttattctgctatttgccattttgaggaatagagcttgggattatggaagactggcattggtacatactgaaaaatggactcaattattttacaagaatacagatgatgcagttgctgtagaagaatcagatcatgaggtgtcgttgatacctg

SEQ ID NO: 14152 - DNA, 398 bp, Diabrotica virgifera
agctctattaaattttgtacataacgtttcttttccagaaaatccttaatttgtttatattctaatcttgcaaaaatttttagtagtctgatttctatagttaatttttgtattatttcatcattagtgagtttctgggaacaccataagcgttttcaaactttatagttataactgactctttgtaaactttaagtgattctttgagcttccgtgtttcatttaataacttgtacagagtctctaatagtactttaattcattattaagctactatgtaatatgcaatcttatgtaaccactgcatacgtttgttccaaaactttgattgctttcgtgatcgtgtttgtggttgtgttttccaggttatttccgctctttagataacttccagaagt

SEQ ID NO: 14153 - DNA, 403 bp, Diabrotica virgifera
  misc_feature (261)..(280): n is a, c, g, or t
aacaaacaaaagtttgaaacagaacgagaaaatgtgacgcttgtggatgtaaacaaacttggtctgttgactgccgaagaaacttatcgaatgatgcaaaaacaaaaggaaaacaaaaagtgccttcgaattcctcgtcgtccagaatgggatctaacgatggaagcggaacatttgcagaaattggaatatgaacaattcattttgtggcgtcaacagctggccgaagcttctgaacaacaaggacttttgtttacaccnnnnnnnnnnnnnnnnnnnntctggcgccaattgtggcgtgtacttgaaagaagtgatgtgattgttcaaattgtcgatgctcgtaatccaaacatgttttactgcgaagacattcacacatattccaatgaaattcaaccgg

SEQ ID NO: 14154 - DNA, 266 bp, Diabrotica virgifera
  misc_feature (122)..(149): n is a, c, g, or t
  misc_feature (193)..(218): n is a, c, g, or t
aacccacgcgtccgctagtgccagtggcgtgctggccatataaatgaatcggtgcaatcaccgataggccgcggcctcttgaggccggtcaaataggttcataaaaaattttagatataacnnnnnnnnnnnnnnnnnnnnnnnnnnnncgaatgataattttgttaatagtatctattaagaaacatttcannnnnnnnnnnnnnnnnnnnnnnnnnaaaatacaagttaagtaggtaattgaataatactatacacataactag

SEQ ID NO: 14155 - DNA, 247 bp, Diabrotica virgifera
agtatccataacgtttcaaatgtagtttgtatgtatacatacaaactacattttttgaaaaaacattaaggtttgaaaatattagtatttattacattaaatacaagaatatgttcgtggaacaaaatatatttttcaattatttgaaagtgtactttttgagaaattttgtacgagtgatagttattaaattcctttttaaataaaggtggcgtagggaagggaaggggaaagaagaaaagacggg

SEQ ID NO: 14156 - DNA, 155 bp, Diabrotica virgifera
  misc_feature (131)..(154): n is a, c, g, or t
aacggacgcgtgggatttactttacaacaataaaatcttttttagtaaacctggagacaaattttacttactgatacctaactactactgtgagacagtatttgatttcgatcacagaaaaatttacttcnnnnnnnnnnnnnnnnnnnnnnnng

SEQ ID NO: 14157 - DNA, 361 bp, Diabrotica virgifera
gttcttcttagtggcggtgcgggctcgttttttaatattgtgtttgattacggagtggtttctacatattggtatatttttcaaattgggctctgtgccgccattatttattgtattgcgaatacgtgtgccaaatatctcgaaagagtgttcaaggttgcagccgcagtcttggaacgtgttttggctacctgttgatcgctactgtatcaccttaatattacaaaatttggcaattgacacatgttttaaaatttgaaggtttgtgtcaacctctatcgtctatcctttagaatgaaatctatgatatattactgtatataagtaatctaatgtgttgcgtgttcaccctgtatcgtat

SEQ ID NO: 14158 - DNA, 182 bp, Diabrotica virgifera
aggtccacaacatcaaacggtggctatgcgtggattcgactgtctatgggatctcgcggtaggacctaaaatcagtacaatcgcaccctattcacaatcccacgacacggtaaagccctgcagtttcccattgtattcttctttatatacatccccctttcggcaatctgtattcataacga

SEQ ID NO: 14159 - DNA, 142 bp, Diabrotica virgifera
agggtcttcttgttcaatcaccatctcgatcggggaggccaccacacagcatatagtaggagggaccagtttactcgtacaaggaacgtgaggaagcacagtgaccgcagggactgctgtctcatcatcgcggggagggtgt

SEQ ID NO: 14160 - DNA, 98 bp, Diabrotica virgifera
  misc_feature (2)..(28): n is a, c, g, or t
  misc_feature (77)..(97): n is a, c, g, or t
annnnnnnnnnnnnnnnnnnnnnnnnnncgagcgcgcccttttttgtgtattttggtttggttatttgtttgtgtgnnnnnnnnnnnnnnnnnnnnna

SEQ ID NO: 14161 - DNA, 395 bp, Diabrotica virgifera
aggtctaggtatcgcgggccgacccacgcgtccacccacacgtctgccacgcgtccgatgagtataaaccagaggaaactgttattgaatttgatgttcctcaaaagactcaatcttcaacggacatcgaaattcccactgaataccatcatggtaagaaaagaattgcacatgcaagttttgaaacattatttggaccttcgaagcctcctgtgattacagccaaacctaaaactgttcaaactccaggtcaaacgttagcaaataggtataaactcgccaaacaagcacaagccaacagggaacaagagttactgataaaccaagttcaacaaactgtagtaactaaaagaccagcgccttctttacttgaagcagctagagaaaaaaagaaa

SEQ ID NO: 14162 - DNA, 248 bp, Diabrotica virgifera
agctaaggcttataattgacttctttggtggtactcttagcgcaaattcgggtattcctatgacaatacatcgtaaagcgtgtgccaatttcaactggccaggtatattcgtatcataatctcatacccaataacgtctcaatccaaattgatcatacacatgcaatatcgatgtatcatatggtatatccgcccatgaacatagtcgagtcatatctcgaaaatttctaggagtccaaagtgacttc

SEQ ID NO: 14163 - DNA, 411 bp, Diabrotica virgifera
  misc_feature (295)..(323): n is a, c, g, or t
aaataatattaatatacacggattgtacgacatatgacggaagctcgagacaaatgactgtgaatgaaaagccctattgagatctaacgtcatttgtggcctaaatttgagacaaatctccctatcttgtcgatctgtttctggcaagtacgcgacaaccttttgcgaaagtttgtaatactgaaaaacatgtagataggacctttagatttaacagaaaacagtaactctagatggtcatttttatattaaatatctaggtattttattaagttttttctattctagcgcttgnnnnnnnnnnnnnnnnnnnnnnnnnnnnngtgattattatatactgatagtaggtagagattattttgttgtatgttctcgtttatgttaaaaaaagtctaattgttggatattttg

SEQ ID NO: 14164 - DNA, 413 bp, Diabrotica virgifera
  misc_feature (195)..(215): n is a, c, g, or t
  misc_feature (337)..(352): n is a, c, g, or t
agcaagcgtccgacaatctcagaaagtgcgagttcattattcattcatttccatcgttgatatatttcacatccacatcacagctgatcggcatgtactcgtgaatccgtgtcgtcaatgatatttgctattgtggaaaaatcaaattcccctagacttgcatgaaaacttgcagaattaaatggtaccaaaccnnnnnnnnnnnnnnnnnnnnnagttgcatgcaataatcaactgacgacatactgcgcatgcctttaggcaacttgcttgcgtcttgcaggtagaattgcaagctgtaaagctgtctttagatatttcggaagtttttagaaannnnnnnnnnnnnnnntttcctcgtttaccacagatcctaagtcagttgccgcgtccgcaagccttgtaaagcactg

SEQ ID NO: 14165 - DNA, 373 bp, Diabrotica virgifera
attgaaaacaacaatatgttcaagttactagttttcatttttgctattacaacagtgatcgcttatgaaactgcttttcaatacccagtgacctgcccaccttttgacccatcggcacctccagtctacgaacctgacccatactactgtgatatattttacgaatgctctggaagtactcccttccaattccactgtgctcctggaacaaacttcgacatcaagacgaatctatgtgaattcaatgttgactgtggagaccgttcaacaactgtaggaacaacgaccgaaggaacacaacccccaaaattttaatcaaataatgataataaagatatgcccaaactataataaaacttgaaccatttttgtt

SEQ ID NO: 14166 - DNA, 350 bp, Diabrotica virgifera
  misc_feature (6)..(22): n is a, c, g, or t
  misc_feature (24)..(51): n is a, c, g, or t
  misc_feature (160)..(174): n is a, c, g, or t
  misc_feature (176)..(189): n is a, c, g, or t
attaannnnnnnnnnnnnnnnncnnnnnnnnnnnnnnnnnnnnnnnnnnnngaattacggttaaaaagtttcaaaatttgaaataaggtaataattagttttaaaaaaccataattttagtttttacaaattttttatgaaaatatgaaattaaattagnnnnnnnnnnnnnnncnnnnnnnnnnnnnnatacaaaattgtatacttagtaaaaatacatacgtgtaatagaggggttccgcaccatttctttcacccgtttagtaaaaacaggtcttcttgggaacaaaataaaagctcgccctggcacagaataaatttggagggcccgggaaattgggcgcgcgcaa

SEQ ID NO: 14167 - DNA, 287 bp, Diabrotica virgifera
caccacacgtccgcaacaacagaaccaccaacacgagctaattaaacgtcatcattttaatattataggtacgataatattttattgttcataatttcgtattaagaagatagtcggttcactgaacacggacacggatggctggtgaatttagtatgccaatttttgttttttgccatttctgccaatattggttattaagtttggcaaaattactatctacgtatttagtgataatatattaatgccaaatttgccaatctggtatacttacttactggagtcac

SEQ ID NO: 14168 - DNA, 102 bp, Diabrotica virgifera
atttggagtacagttccatccgttgcagccttgggtgttttcttcaggtgcggatagcactattaaattatattctaattaaattataatatttttttacgt

SEQ ID NO: 14169 - DNA, 199 bp, Diabrotica virgifera
  misc_feature (113)..(131): n is a, c, g, or t
  misc_feature (138)..(162): n is a, c, g, or t
  misc_feature (165)..(190): n is a, c, g, or t
tggagtacagttccatccgttgcagccttgggtgttttcttcaggtgcggatagcagtattaaattatattctaattaacttataaaatttttttacgtacaatgtgtaaatnnnnnnnnnnnnnnnnnnnaaaatannnnnnnnnnnnnnnnnnnnnnnnnttnnnnnnnnnnnnnnnnnnnnnnnnnnggggcaacc

SEQ ID NO: 14170 - DNA, 80 bp, Diabrotica virgifera
  misc_feature (2)..(27): n is a, c, g, or t
cnnnnnnnnnnnnnnnnnnnnnnnnnntttttcttttaatataaaagctagactctattgagcctaggaagtatttgaat

SEQ ID NO: 14171 - DNA, 418 bp, Diabrotica virgifera
attgcattggaaatggatttctggagaagatcagctagaaaattaaggcttgaaagaatacaaaatgaccaagtcagaaatataattaagtcaaccatcatagataaaattcaaaggagacaactgatctggtatggtcatgtagaaaggcttcacttattttccccgagttatgcatctagtttattgttactacctctatgtgaataactaaacatgtagttaaaataacacccatgatttataaattcctgaaataaatgttatttatattcattatatattgttacataattatattctctaacaagttcaagtcgattttaatggaacatatcatgaaaaagaaggaaatcaaaattatcatcgtgtcattatatatgctcaaagtagaagtataattgccaacaaaatattt

SEQ ID NO: 14172 - DNA, 379 bp, Diabrotica virgifera
  misc_feature (53)..(53): n is a, c, g, or t
aatatgtacagtctgggtctcacagagtcacctaactgtgagtgtggaaaagnaagtaatctactacatattctcctcgaatgttcacatcaatcagtaaatataaacaaattttatgataatcttaatatattaaaaattccacttcccgtctacctgaacaatttgattttttctgaagagattaatatattaaaaacaatttacgaacatatcaaaaattgtaaatatagattgtagcaataaaatttaccctgtatttaagaaattttgttaaaacaaagcaagcatgtttgttaaaacaaaacaaacatgtttgttttgttgttattttgttttaaatcctgtagatttaagtaattattgtatattataattg

SEQ ID NO: 14173 - DNA, 193 bp, Diabrotica virgifera
  misc_feature (124)..(148): n is a, c, g, or t
atgtaaagcttgaggaagggtagcacattagatttgatttctaccagaatgctaacaatccaagaatgcacttcgaccaagtccaatgtcctgctgaaatcgttgccagatctggttgcagtcnnnnnnnnnnnnnnnnnnnnnnnnnttggttttaaaacaattatgttttacttaagtatatactcaattt

SEQ ID NO: 14174 - DNA, 375 bp, Diabrotica virgifera
ctgttactgcatgtcctacagtattgttcagtggtggtggatcaagtgaagcacctgtccaacagccaccacaacaagtagcaccccaacaacagtatgctgggacaggagcagctggagaacaaggcccatgttcttgggaaattaagcaatttttacaatgttcatctacacagtctgatttgtcattatgccaaggattcaatgaagctctacaacaatgcaaagttagaaacaatattgctgtttagacaagctcgtgatatattttaaattccggtgttactgagatgttaaaattattctaaacattacctcacagaatgcactatatatgtagataggaatgttacagaaatgttaaattaaatgttt

SEQ ID NO: 14175 - DNA, 406 bp, Diabrotica virgifera
acggacgcgtgggtgaaagaagacaacaaatagaagctcgcagactcgagagagagaagaaaaaactggaagtcgaaaaagagcgaattgcgcgtgaaaaagtagcattggcaaggattgaacgggaagcacattgggagaagcaaaaaaaaatggagtatgacatgacaaatatgtacgaaaaggatatggacagaagagttagtaaaaggtctgcaccttttcgtcgggaagaatttgaaaggaagagaccagcatatgatagacatttcaatgagccgcctccacctccaagtctaaaaaccagggaagccagtccacaaagcttcagtagtcgttcaaaggaactttacacgaaaagtgtaaaatactctgtgccaaagcgagattcactttaacctgaaaa

SEQ ID NO: 14176 - DNA, 381 bp, Diabrotica virgifera
  misc_feature (82)..(101): n is a, c, g, or t
  misc_feature (110)..(289): n is a, c, g, or t
  misc_feature (296)..(317): n is a, c, g, or t
acccacgcgtccggaggatagaaaaggctgctatatttgtgtttactgtgcagaacatcaatttagtatttgtaaagattgnnnnnnnnnnnnnnnnnnnntattcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccnnnnnnnnnnnnnnnnnnnnnnccttcaaagtgaaataaaacctaattaaaaatttcaccaaaattaaaattaatggagccttttt

SEQ ID NO: 14177 - DNA, 102 bp, Diabrotica virgifera
ggaagctcccagtatctgttcattaagcactgtgagtctggtggatacacacagcattatcgctaaacttgccaacgccctatcaccagcacctttcgcatt

SEQ ID NO: 14178 - DNA, 240 bp, Diabrotica virgifera
  misc_feature (99)..(186): n is a, c, g, or t
tggataccacccaatttaatatataaacaaaatataattatctagtgatacaataaatataaagatatagtaaatatgtatgacaaaaattggcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctaaagggttaaggctcaacaggacccacccttaagttcacggctcttca

SEQ ID NO: 14179 - DNA, 224 bp, Diabrotica virgifera
  misc_feature (17)..(35): n is a, c, g, or t
  misc_feature (157)..(192): n is a, c, g, or t
atatgatatgcacatgnnnnnnnnnnnnnnnnnnnctgttaataaatgaccttaatatataatttacgaaaatattacaaaataataaaatgacaaatcagttgcttccttttactataaatttatatttgtaactgaaaaattatccaataaatcnnnnnnnnnnnnnnnnnnnnnnnnnnnnnnnnnnnntgaacgaaaaaagaaagggggcggggcggggg

SEQ ID NO: 14180 - DNA, 182 bp, Diabrotica virgifera
  misc_feature (16)..(46): n is a, c, g, or t
  misc_feature (48)..(68): n is a, c, g, or t
  misc_feature (89)..(139): n is a, c, g, or t
  misc_feature (141)..(156): n is a, c, g, or t
ctttttacttatttcnnnnnnnnnnnnnnnnnnnnnnnnnnnnnnncnnnnnnnnnnnnnnnnnnnnncttaattactattgtgagacnnnnnnnnnnnnnnnnnnnnnnnnnnnnnnnnnnnnnnnnnnnnnnnnnnncnnnnnnnnnnnnnnnncttatatacctattactttccaattt

SEQ ID NO: 14181 - DNA, 104 bp, Diabrotica virgifera
  misc_feature (11)..(48): n is a, c, g, or t
  misc_feature (74)..(74): n is a, c, g, or t
cattgtatacnnnnnnnnnnnnnnnnnnnnnnnnnnnnnnnnnnnnnnccattcggttcaccggtctattaccnaccggcgcgcggcgcccccaatataaagtc

SEQ ID NO: 14182 - DNA, 390 bp, Diabrotica virgifera
  misc_feature (203)..(203): n is a, c, g, or t
  misc_feature (294)..(294): n is a, c, g, or t
aatcatttcaatcaaaataatggtaaaaatgtctcaagtaaaattattggcccagctttcagagagaattcttctgagacaaagcattgctacaccagctgtgagatgtatgtcagattgggtacctaaggaaaaagaaacacacactggacagaaatgggcttctgatgactacagattatctaggcgtgtatgcacgccanaacatggggggcgagggggggcaatcaatcttgtcgatgaggttgcgccagaagcatgtaaagatcgtgtactatggtgtgatgggggtantggccccgaacgtcatccaagagtatccatcaacttgggcagacccggcaatcatgcctgtgggtattgtggattgagggtttatagggaaggaca

SEQ ID NO: 14183 - DNA, 183 bp, Diabrotica virgifera
atgacgaccaagaattccacgctgtctttgactacaccacatactggcccacttttaaaaacctaggcatcttcgaagcaaccgttaaacaacttttccttagacatcactacaaaagaacctacaacatgaccatgattaacccacaatggactggaagaatcagcgcaaaaaaagtcccca

SEQ ID NO: 14184 - DNA, 385 bp, Diabrotica virgifera
  misc_feature (269)..(287): n is a, c, g, or t
aaacttgaggatgtccctaaagatacaacaatagttgaagttaagcctgctcttaatgaaagtgtagaccatgactactgttttgtaaaaccacaaatagaagaagaaaaagtggaaccaatacctgaaccaccggttgaacctcccaaggtagaagcgaaacaagaaaaaaaacctggcagctcctccagtagtagtagcagtgattcggactcatccagttgttcatgtggttctaattgtacctgtagttcaagttcaggcagctnnnnnnnnnnnnnnnnnnnttctagttctgaaagttcttctgaagaaggtaaaaagaggcaattagccaagaagcagaagaggaaagaaagagcgaagaaactgaaaaaaacaaaaa

SEQ ID NO: 14185 - DNA, 55 bp, Diabrotica virgifera
acgcactaaaagaataggggggtagctcgacaggcatgaaacttcattactcttc

SEQ ID NO: 14186 - DNA, 364 bp, Diabrotica virgifera
accatatgttgttctggaagtcaatgaaaccaataaaactccaaaaattaagttagataacgaggttattcgaaaatttcatttcaataatgttaaaccattttatgaggttattaactaaacgaagttgaagtgtaacacggcaagtagtagatatgaactttcattttccatattataaatgactttaatcagtaataattgcaacatataattcgattaccttgtggtacacttcatctacggccttctcacaacaacacaaattagaatgagttattgccggtgggtttccttgtttcaagtggccctaactgccctgttcggagcatatccagagaggctctaaactacaagcccaaaa

SEQ ID NO: 14187 - DNA, 245 bp, Diabrotica virgifera
  misc_feature (57)..(81): n is a, c, g, or t
  misc_feature (126)..(153): n is a, c, g, or t
  misc_feature (155)..(189): n is a, c, g, or t
  misc_feature (194)..(217): n is a, c, g, or t
cggacgcgtgggcggaccgtgggatttatttaggtataatattttagtacatagcgnnnnnnnnnnnnnnnnnnnnnnnnnctattgtgagagagtattttattttcataatcagaaacaattaannnnnnnnnnnnnnnnnnnnnnnnnnnncnnnnnnnnnnnnnnnnnnnnnnnnnnnnnnnnnnncaatnnnnnnnnnnnnnnnnnnnnnnnngtaacatagatactttaaataatttttt

SEQ ID NO: 14188 - DNA, 415 bp, Diabrotica virgifera
gaaaggttccacctagagactacgtcggaggcgaagacaacggcgagtcccccaacctcatcaggtctcagttcagcggaggtcaccgtccaagcaaactcgttcaaagccaaggaatcggttacgtcgcatggggtgaggaagaaaactccgtcaaagaatatgaggtaatgggcgaattcaccggatactgggttgccatttcaccaggaaacatcccatgaaacgctttatcaggggtacagaactaagatggtgaacgtcactacgtacgaactgtcgggcatgacagagcattgatcgttggaaatgtacctaaccccatggagtcagttaaatctcatactggggtcaagagatgtcattcccatactacaaaagtttggtaaactaatcagaatcaaattgtttaagc

SEQ ID NO: 14189 - DNA, 66 bp, Diabrotica virgifera
agcactgtttttcttgtttttccaatcaatcacaccctcattgcttttctaagttaatattacgac

SEQ ID NO: 14190 - DNA, 291 bp, Diabrotica virgifera
  misc_feature (90)..(111): n is a, c, g, or t
  misc_feature (159)..(190): n is a, c, g, or t
  misc_feature (192)..(205): n is a, c, g, or t
  misc_feature (242)..(262): n is a, c, g, or t
  misc_feature (265)..(282): n is a, c, g, or t
caccctttaacttgtggtttaataatattaatacaaacaattttcacatcagttattacaggattaataaattataattactgattttcnnnnnnnnnnnnnnnnnnnnnngtaggaggaatattaattctttttatttatataaccagaattgcttcnnnnnnnnnnnnnnnnnnnnnnnnnnnnnnnncnnnnnnnnnnnnnngaatttttactattatttctatattaagatttatttnnnnnnnnnnnnnnnnnnnnnccnnnnnnnnnnnnnnnnnnatgaataac

SEQ ID NO: 14191 - DNA, 345 bp, Diabrotica virgifera
aaaaactctgaatatttggacgtgcactgacaatatgtcgattttattgcaaggcactcttatacaataccatcatatcacacgcatgtgcacttaggttccaggcatcgacccgatccatcacgaaagctacatattacatcgctggatatcccactggataagtgggatggtgcaaaggtgtcactctatgtgccgattttgtcacgacatagttcaccgttacaattactccatgctgcttcaaagcccaagcttactatgcagccaatcgtgtaatgcagattccaatcgtacgttaccatatatctgttaactgggtgttaaaatacatactactacctg

SEQ ID NO: 14192 - DNA, 348 bp, Diabrotica virgifera
aaagaaggctgtgtattttgacgacaaaactgataaaggtgtgcctctcacccacgatttggctctagaggtgttaaatgagggtaactagtccgaaatagaagatttagatggcgaaaatgatgttgcttttgacgttcagatgtttaaaaataacactgatgacaaggatattgaagaaactgtattagatgaagaacctgtattggatgaagaacctgttccttcaaagagctcttcttcagcaaagaggcaatggaaagacatgaaatttcagcaaaaaatgtttgttctactttagttagtatgtaatagcatattaaacagttatcaaaataaaaaacaaaa

SEQ ID NO: 14193 - DNA, 232 bp, Diabrotica virgifera
  misc_feature (2)..(15): n is a, c, g, or t
  misc_feature (44)..(77): n is a, c, g, or t
  misc_feature (95)..(115): n is a, c, g, or t
  misc_feature (128)..(141): n is a, c, g, or t
  misc_feature (144)..(164): n is a, c, g, or t
  misc_feature (166)..(192): n is a, c, g, or t
gnnnnnnnnnnnnnnaggatggtaaataagaattgtaaaaaagnnnnnnnnnnnnnnnnnnnnnnnnnnnnnnnnnngaacctggtgtaccaggnnnnnnnnnnnnnnnnnnnnncattaataatttnnnnnnnnnnnnnnccnnnnnnnnnnnnnnnnnnnnngnnnnnnnnnnnnnnnnnnnnnnnnnnnggtaatgaaaggtaatccgtttttaaaaaaacctaatttt

SEQ ID NO: 14194 - DNA, 190 bp, Diabrotica virgifera
cccacacgtccggaaaaaatttactacatgcacattttatcatatttgtgcgagaataaatttaggtttataagagtcagaattaattggtgcaccttgtgtcccagggattattaagttgtcactatataattaataggttccaagttaaattcgctgaaaacttgaaatttttagtgtcaaagaaata

SEQ ID NO: 14195 - DNA, 67 bp, Diabrotica virgifera
ggactcgccatgtaacggtgcattaatcgcggagggcgtagcggttacgcccaacgtgaccgcgaca

SEQ ID NO: 14196 - DNA, 324 bp, Diabrotica virgifera
  misc_feature (4)..(26): n is a, c, g, or t
  misc_feature (35)..(79): n is a, c, g, or t
  misc_feature (85)..(102): n is a, c, g, or t
  misc_feature (105)..(132): n is a, c, g, or t
  misc_feature (152)..(185): n is a, c, g, or t
  misc_feature (187)..(215): n is a, c, g, or t
  misc_feature (224)..(277): n is a, c, g, or t
  misc_feature (290)..(311): n is a, c, g, or t
tggnnnnnnnnnnnnnnnnnnnnnnntgaatagannnnnnnnnnnnnnnnnnnnnnnnnnnnnnnnnnnnnnnnnnnnncatagnnnnnnnnnnnnnnnnnnccnnnnnnnnnnnnnnnnnnnnnnnnnnnncaattaaatatttctatacnnnnnnnnnnnnnnnnnnnnnnnnnnnnnnnnnncnnnnnnnnnnnnnnnnnnnnnnnnnnnnncataaaacnnnnnnnnnnnnnnnnnnnnnnnnnnnnnnnnnnnnnnnnnnnnnnnnnnnnnncactatttttacnnnnnnnnnnnnnnnnnnnnnnctataaatttaaa

SEQ ID NO: 14197 - DNA, 312 bp, Diabrotica virgifera
caaaaaccttacactgacgaagagctagcagaatacattagacaacacgaacagtaccaacagggaattccccaaggttaccatcctggagcttaccaagttcctccagcagggtaccaacatccacctccaggagcaggataccaacagcaacatccagccggaggttaccaacaacatccacaagcaggataccaacaacctccaccaccaggatatcaacaccaacctcgcgtagggggataccaacaacctccacaacaaggataccaacaacaccacctcaagtagaggaatccaacaacaaccaac

SEQ ID NO: 14198 - DNA, 435 bp, Diabrotica virgifera
aaaacagttttttatcaacacaatataaaaagaggaaagagttatatcataatgttaatttaagcaatatagctgctttaatcatactaactaaagaattcatagaaataatgaataaaatggaaaaaataacgagaacttcagaagaatcaatagaccaatttctagagaaaacaagtgaattaataatatcatggctatctactaaatcaaaaagtgatgacgaaagtataaaaggaacttatataacagaagtagaaagaaatttgacagaaaatgatatattaaatagcactatttatgccatcagtacatggaatgacaatgacaatgtttattggaaattaagtcatgaagtataaagacaaagtctaaaaaagttatttttagataaagctgttatagatgttataaagaatactgtttcaagagaca

SEQ ID NO: 14199 - DNA, 393 bp, Diabrotica virgifera
  misc_feature (17)..(72): n is a, c, g, or t
  misc_feature (102)..(137): n is a, c, g, or t
  misc_feature (142)..(160): n is a, c, g, or t
  misc_feature (175)..(194): n is a, c, g, or t
  misc_feature (196)..(208): n is a, c, g, or t
  misc_feature (210)..(231): n is a, c, g, or t
  misc_feature (233)..(268): n is a, c, g, or t
  misc_feature (278)..(320): n is a, c, g, or t
gagcttataaataaacnnnnnnnnnnnnnnnnnnnnnnnnnnnnnnnnnnnnnnnnnnnnnnnnnnnnnnnncaacatgttactaattaattttatatatcnnnnnnnnnnnnnnnnnnnnnnnnnnnnnnnnnnnntaacnnnnnnnnnnnnnnnnnnngttctgatgataacnnnnnnnnnnnnnnnnnnnngnnnnnnnnnnnnncnnnnnnnnnnnnnnnnnnnnnncnnnnnnnnnnnnnnnnnnnnnnnnnnnnnnnnnnnnattttgtaannnnnnnnnnnnnnnnnnnnnnnnnnnnnnnnnnnnnnnnnnncccgtatttttaccgttccaaggtagcacaaaccttagtttttttatcgaaaactcgaatgaagggtttgatc

SEQ ID NO: 14200 - DNA, 369 bp, Diabrotica virgifera
  misc_feature (286)..(311): n is a, c, g, or t
accacgcgtccgcgcaagtattaaaagtgaagtgtgattacaattatttctagtgaaaatggattgttgtaagaaaggagaatcccgcaccattgtcaaacaatgcaaactgacaaagaaagatggtactgtagtagactgcgagtgtacctgcacatgcaaatgtgaaaatgactgcaaaggttcagcctgtcctggaaaaaatggatgcaattgtgactgtactgaagaaacagccaagttaggacctgatggcaaataccgatgcgtttgcgaatgtacatgnnnnnnnnnnnnnnnnnnnnnnnnnnttcatatctactttgtagtttgtagtaaggcgttttataaagactgtattttatttat

SEQ ID NO: 14201 - DNA, 459 bp, Diabrotica virgifera
cagacgcgtgggcgtggaactaactgaaaaaatcgataatgaagaattaagaaaggcagttatctataggtacaactcatttaaacaagctcaagaggaaatcaccgaatacgaacctacagaacaagaacttcgcgaattgctcacaagaggagacattttactacagaaacagtctgaacaagcagcaactgataccagtgatgtcaaatgtgaccaaaatcggaaaaatgatgacgctgggatagattttccacaaattcaagaacattcgagtagtacagaagacaacgtaaaagatgaagcaacaaaccatttagaagctactgtagaagtaaagaccatctcggatacaaatgaaaatgcctatcaaatcgataaaacaaatattgaatcgtcagaaaataaaatggaagcatcagaagatatacccgaaagtattaaagaacatataacaga

SEQ ID NO: 14202 - DNA, 376 bp, Diabrotica virgifera
  misc_feature (13)..(199): n is a, c, g, or t
  misc_feature (201)..(215): n is a, c, g, or t
  misc_feature (217)..(249): n is a, c, g, or t
  misc_feature (251)..(317): n is a, c, g, or t
  misc_feature (319)..(332): n is a, c, g, or t
  misc_feature (334)..(369): n is a, c, g, or t
cagacgcgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnncnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnncnnnnnnnnnnnnnnannnnnnnnnnnnnnnnnnnnnnnnnnnnnnnnnnnngtccttt

SEQ ID NO: 14203 - DNA, 436 bp, Diabrotica virgifera
ccacgcgtccggaaagtcattccagtggaggcgaggaagctccaacgaaagatgtgcaagaaccaaagcctgggccttctcaggaacctggtgataaggaaaatgatgaggaggaacctgcagatgaggaagcagctaattcatggctgaatgagtgttttgatgcctatgaagctggtggatatagtcccaagtttcttactcctgacgaaatagaaccaggaactattgttgttatagaagaagatgatctgaaaagattggaatttgcaagaattcaggttgtcggtaaaggtaagactgtggaaaatgttataacgaaggaggagttgatgctacaaaaagaggctcgtaaaggcatggatggagacgaggcacagttctctgtagagcaagctttggacagccaagttccaccttggtccgacaaataccg

SEQ ID NO: 14204 - DNA, 380 bp, Diabrotica virgifera
gggatttttcggttgacgtttgagaggtccacctgtcttctttgacatcttgtcatgaattttcgggcaccaatctgtctggtcggttggttgttgacctctcacctggtcgcagccttgtgctggttccgagcggggatgacatgcatccgcatgtgatgcatttttgatcttgatacatcgacttgttgtcgattgctatgcggctcgtagtgtggcaatagtgttgttttgaggttttgcacctgttcgagtggctggtttcagttgcttgtgcactggacgtgggtagccacattttctttttttagctgtcagaatttcacccttttgcatttctgtctgggttggttcacttagtttccaggtttgcactgggg

SEQ ID NO: 14205 - DNA, 177 bp, Diabrotica virgifera
  misc_feature (142)..(159): n is a, c, g, or t
gcctgtcgtaaggtcgtattgtccggggcgccccacgcgtccgaaatatcattgttttttaagagtatttaggatattttaagtttttttttgagagtgtttcgcaaacttaactgagataagtttccggaacatgatgtgnnnnnnnnnnnnnnnnnnaagcgcatttttcttgtt

SEQ ID NO: 14206 - DNA, 374 bp, Diabrotica virgifera
  misc_feature (79)..(98): n is a, c, g, or t
  misc_feature (267)..(288): n is a, c, g, or t
  misc_feature (294)..(313): n is a, c, g, or t
gacttttataaagtcaaatacttgggccccaagcaggctgtgaaaagaagcgataacggaatttgtatgccacttcttnnnnnnnnnnnnnnnnnnnngaacggcgtaacaaaatccagtagcaacggaaccgtcaacaacggctacatcaaaagtgaattctcggaatcgtacgaaggttacgcgaacggtagcacaaagggattcgtcacacaatctataaccaaaccaaacaacaccaagaagatagagtagataagatcaatnnnnnnnnnnnnnnnnnnnnnnctaggnnnnnnnnnnnnnnnnnnnncgattacatcaaatgatttgtaacaagacctggaatttgctactgaataaaattaatttat

SEQ ID NO: 14207 - DNA, 214 bp, Diabrotica virgifera
  misc_feature (32)..(56): n is a, c, g, or t
  misc_feature (67)..(107): n is a, c, g, or t
  misc_feature (160)..(212): n is a, c, g, or t
aacaaataaattaaatttacttatgaacaagnnnnnnnnnnnnnnnnnnnnnnnnnggattaatatnnnnnnnnnnnnnnnnnnnnnnnnnnnnnnnnnnnnnnnnncgatttaagttttaaatgagaattaggagtaaaaattttcatagcgtagaagnnnnnnnnnnnnnnnnnnnnnnnnnnnnnnnnnnnnnnnnnnnnnnnnnnnnncg

SEQ ID NO: 14208 - DNA, 283 bp, Diabrotica virgifera
  misc_feature (18)..(35): n is a, c, g, or t
accacgcgtccgccaacnnnnnnnnnnnnnnnnnngctcagcaaggggatcaactggatcagttgggtaggaggaggcagcacaatttggagcaacagatacaagcgagaaaccagtcgggtgtgagtgaggaggccctaaaagaagtctccaggatgttcgagcagttcgacaaagaaaaatccggaaaactcaaccatcaagagttcaagagttgtcggctagctcttggatacgactgacctatggtggaagaagggcaacctgatccagagtgggatgc

SEQ ID NO: 14209 - DNA, 276 bp, Diabrotica virgifera
  misc_feature (166)..(209): n is a, c, g, or t
atcaccttatagctattttggccgcgctcagaggaagaaatggtgccctcttaaatatacgatcccgcgattgagcgattgttttggaaactgcattagacaagtttacatctcatagggttgaactgtacgcacggtaactagcattttcaattgcaagtgcgcnnnnnnnnnnnnnnnnnnnnnnnnnnnnnnnnnnnnnnnnnnnntatgtgtactggcgatctcattatcatactcatgttaggtttggcgttcaccttatgatgaatgacc

SEQ ID NO: 14210 - DNA, 113 bp, Diabrotica virgifera
attcacaaaacctaaaatattcatgcaaacacttactcatgggtgattattgaatttaaatgttcgtacatctcaggtacgaaccagaatttatgaaaagaattgattaagca

SEQ ID NO: 14211 - DNA, 206 bp, Diabrotica virgifera
accacgcgatccgccaatatcgagtcgcagagctcaacgtccaatgcggagtccgcaagtcgcttggatttttgttggaatatatcggtgagatgggaaaggattatatttatgccgtggccccgcgtctgggggaggctcgcaggggtggggatttagtggatagggagacagcttgtgcggctattaagcatatcggtcttggt

SEQ ID NO: 14212 - DNA, 421 bp, Diabrotica virgifera
aaacccacgaatatgattgctgttgcagtaactttttgtttgctggtactatctgcacagggacaaattccggttcagagatgtccagatgttaacggagttgcagatttcgacggacgtgcatatttgggtgacgggtaccaacaaggtacatatccaccatcactggaagatcacggaagatcgtgttgtgaccaatattgcagtaagcaccgatggatgtatgaggagtcgtacgcgatatatcagttcagacacaaatcagacacacgttcgagaacgagaagcacaacaatgttcatcacctggggactgtcgatttctagtacatttctcaactccagacttacctgtacctttccaggttcttggcacagactactaaacttactctgtacgttacgtccgttttgaacgtaat

SEQ ID NO: 14213 - DNA, 188 bp, Diabrotica virgifera
  misc_feature (93)..(112): n is a, c, g, or t
aacatgcatccgattttttagaatactatcaaatagacctttttgatctactctacgacttaactagtatccaacttattttggtacatttcnnnnnnnnnnnnnnnnnnnncgatgatttcaccattatccacgttcaggtgtaccaaaccaattaaccaatcccacatttttacagttattttctc

SEQ ID NO: 14214 - DNA, 267 bp, Diabrotica virgifera
atcacgcatctggtggcctacgtgggtgccaaactgggtagacgacctgctaagtgctagcgttagtgtaaaaacaaacgccatcccagcagtcgtttctgcaatggtgtcccacatccaaacgaccgtagtttcgatatgggtacaatgaaggcttcactgcaaggcgttcctctatgtgtagattaagtttctgacgaatatgcagagccaatttctgcatcattagactcaggacgtagctgttgggacaaatattttgtaaag

SEQ ID NO: 14215 - DNA, 332 bp, Diabrotica virgifera
atgggcccccacaactttaaccaaaaaaaaggaatgcgtcgtttcagcaaaagtttccaatttaaaacgtgaaactaaaacttcggttcggaattttccgcttaggataagccattcgaaagatcgggaaaaatatagctgtaagacgggttccgtcgggagtatttggggtccataaagttatttatggggttattggcatgtagttaaactttgatacgaccgatcctcattgacttttatctgcctcagtcttttttgagctacgcctttttgagatattagtgaactagagacgtcacatgtcgtatccgtcctttctttacccggga

SEQ ID NO: 14216 - DNA, 278 bp, Diabrotica virgifera
  misc_feature (49)..(49): n is a, c, g, or t
aaaagacatccaggtgaataccgtggtggtggagaatacgtggttccanacggtttcggttgggccaatggggaaacgcttacgttaaataacgaattttacgcaaaatcacacaagaaacaccataaacacgggaaatcacatcacagacatgagaaacagggaaataacgatgtatgaatgtttttaattaataatttgttttaatacaatgtaagagaagggtaacgttaattgggtttagatttaatttaatccaataaccgaagtaaataaca

SEQ ID NO: 14217 - DNA, 407 bp, Diabrotica virgifera
  misc_feature (379)..(406): n is a, c, g, or t
agagggtagcgcactaaactgctatgggtgccatgcaaaggttggaaatggatctagctgcgaaaccgggaagaatataagttctactttgagtcatacctgcacaactccacaagacagaaccaagacactcgcttgcataacgcttttaacaaatacaactatctataggtattgcggatacaacaatacatgcaatctgaatgagacaatcaaaacaactggatttaaatggtgtaaaagttgtactaccaacttatgtaacactcagtcttcttctgtctctattattgcaccaactatattaactccaatgattattgttacagtagtactaagttacttttaattatacattttaaaagagagttgtagacgnnnnnnnnnnnnnnnnnnnnnnnnnnnnt

SEQ ID NO: 14218 - DNA, 55 bp, Diabrotica virgifera
aaaattcataaaatatgtcttaaacaatgaaaacaaaaaaaacataaaaaataat

SEQ ID NO: 14219 - DNA, 436 bp, Diabrotica virgifera
ccaacgcgtccgcgattttttataagttgagaaatttttttactaattaagctagtttttatctattctgcgatatttttgctttattcttatttgagaattgttcacattatatttttcattagttctttacgtttattaaaataacttaattaaatgtgatatgatattctacttcatttcagatatatgtatttatattttatattctctttttataaacatgtaataatccttttgtttatttccggttgtgtttgcaagacatccatgtgtattttttgttttttatattcctttagtttatataagtatacctacaagtttaagcttcattcttgttgtattatttgacaaaaaattacttgcctcttgcgtgtttggtaaattataagtttataatttagaaaagttacttaaaagaattagattttgc

SEQ ID NO: 14220 - DNA, 457 bp, Diabrotica virgifera
  misc_feature (4)..(27): n is a, c, g, or t
ccannnnnnnnnnnnnnnnnnnnnnnntgttccacaattgatggtaaaattattaatatctccgattttcagagtatggatgagtttaaaaatggatgtaacgctacagaggaagaaacactacaaaggaagcaaacaattggtgtaggaagtttgtccagagaagagaaaacaaactccagcgaatcgtccgaaacaaactcgacaaaaaatcgaacggtgcgtgttgtacaagaagaaaacgtaatagttattaaagagaatgacagtaaccttatatttggtgtttccttaaccactatcctagtatcagtattaagctttttgtctggcttacttttggggttttttcttaatcattttataaggcgaagacagaacttagaagagtctgaaagtaccacaaaacttattataggaaataaagtgccacattagacttttacaataagaaaaa

SEQ ID NO: 14221 - DNA, 432 bp, Diabrotica virgifera
ccaacgcgtccggctatggtggcgatgaagggagaaaactgtgtagcaattgcagcagataggcggtttggtattcaagcccaaacagtagctacaaatttccaaaaaatctttgaaatgggaccacatttatatgtgggtcttccaggattagccacagatacccaaacagttatggaaaaactccgtttccgaaaaaacttgtacgaacttaaggaaaatcgaaaaatatctccaaaagtatttgcctctatgatatcaaatatgttgtatgaaaaaagatttgggccattttttgtagaacctgtagtagctggacttctacctaatacttatgaaccctttatctgtaatatggatttaattggttgtataaaccaaccttcagactttgttgttggtggaacagcgtcagcacagttgtatggtatg

SEQ ID NO: 14222 - DNA, 418 bp, Diabrotica virgifera
ggcttttggagcaatgtgaaagttagcgcattactcacgaatgttataaatattgttgagccctttgtgtgtatgtggtacgactacgaacgagaatgtctggattgtgttatcagcaaacttgcccagtttgtaataaataaattagtgctgaaagctaatactaacgaagacttcattaaatgcgaatgtttgggggatttatcatttttaacaaagcttcacttgccatccctagttgaatcttgggagacagaagattacggttacataaaatatcatctaataaaaaatcccgacgtgaagaaagtttataataaaatgtataaaattgtttccaaaatagtggtggagacctttgaggaaatgtaatttttttatgaattgtaataactatttcaataaaaccaatcgatat

SEQ ID NO: 14223 - DNA, 388 bp, Diabrotica virgifera
  misc_feature (58)..(87): n is a, c, g, or t
  misc_feature (92)..(209): n is a, c, g, or t
gtctggtagaggacatagtttggattattacgtaaaagtttacgctaagtaataaatnnnnnnnnnnnnnnnnnnnnnnnnnnnnnncatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaaaaggttcaaacttaagttaaccttgaaagcaagttcaaaccccttcaaaagggtcaccaaatttaaattaatgggccttcgtttaaaaattttttaacgggaaaaacccgggggtaaccaaatttaacccccttgaaaaaaaacccctttttgcaattggggttaaaaccaaa

SEQ ID NO: 14224 - DNA, 446 bp, Diabrotica virgifera
gaattttaaactggaacagtgccacctcatgctcaataaaaacaagaattctattaaaacaacacattagtatacgaatcatgattttaaggatacttatcataacatgtttcatctcaatgatttatgcctcaagaattatcacaagagatgatccggtaccagacgagtcagcgtgtatatgccaccacggttacactattcaaaaacatccaaaagataataaattttactgtaaaggtatcctacatgatggaaaaacagcctgtgtaaaccttgagcgaccgcagtgtaagtgcaccttaataaaaggttttgttattcaagacatctatagatactggtgcgtaaaagtgaaacctgggtatgttgaagaaattagatgggattgtgaaaataaaaaagagtgggataggttttttgacatttacccggaggagcgacca

SEQ ID NO: 14225 - DNA, 450 bp, Diabrotica virgifera
caaacgcgtccgggattgtcgctttatttcatgagttttgtaagaaaaccaagtttcgtcttccgctacaatgcgatcaagaaatttgtcccattcgttttgtcttatgagtcttctgtcaaaacctttggtacccacataacgtacattttttataattggtcaaggtgctcaatcactatttcatgtaacaaggatcgagaaatttgtggaaacgagtcatgcaatgtgattaaagtaggtcactgggtttgctgcgtcgtgcacactggttgttccttagttgaacatgatgcactatttcctcactaaaggttagctcacaacattctcaccataagcagcctttatttgcctatatatgatgatttggcgaacattttgcgcattcaaaaacagaatcatactgcgtacttaacattcggcgggattttcaatgtggcgtcccca

SEQ ID NO: 14226 - DNA, 405 bp, Diabrotica virgifera
cgaaatcatcagcaaatatcaagtcccagagctcaacgtccaaaacggagtcctcaaatcgctttcaattttgtttgaagatatccgtgcgatgggaaaggagtatatttatgccgtaaccccgcttctggaggatgcactcatggattgggatttaatccataggcaaacagcttgtacggctattaagcataaggctcttggtgtatacggattcgggtgcgaagatgccctcatccatcttctgaactatgtttggcccaatatttttgaaacttctccacatttggtgcaagccttcatggacgccattaaaggaatgccagttgcgttaggaccgatcaaaattctgcactatacgttacagggtctctttcatccagccagcaaagtacgggatgtata

SEQ ID NO: 14227 - DNA, 180 bp, Diabrotica virgifera
gtctgcccacacgtcggatggatcctcacgatgcatttcgcccatagtccaatgccctgctgatatcgttgccatttcaggatgcagtctttaaatagtaggacaacataattatttgttataaaacaattatgttttacttaagtatctactcaatttgcaattaattgaaattaatat

SEQ ID NO: 14228 - DNA, 397 bp, Diabrotica virgifera
  misc_feature (46)..(65): n is a, c, g, or t
  misc_feature (160)..(178): n is a, c, g, or t
  misc_feature (238)..(265): n is a, c, g, or t
  misc_feature (348)..(394): n is a, c, g, or t
atattcttgattagtattttctactcctatttttatttgtcttccnnnnnnnnnnnnnnnnnnnnctttgatttttattatagttggagtttgattaggttatgagttagctaaatttaaaatttcttataatttattaaggttaaataatatttctagnnnnnnnnnnnnnnnnnnnatatgaaatataccttttttatctactttaggaattaattattatccaatttattttggnnnnnnnnnnnnnnnnnnnnnnnnnnnnggatgatttgaatattatggaagttcaggtgtaataaaacaattaaataatagaatatttttacagttattttctcttaatcnnnnnnnnnnnnnnnnnnnnnnnnnnnnnnnnnnnnnnnnnnnnnnncta

SEQ ID NO: 14229 - DNA, 201 bp, Diabrotica virgifera
gaaaaggttgatttggattgggaccacacatgggtccagagatgccacggatatagaaaaggtgtagatttttacaagaaatactttaatgttatacctataccacagcatcaaaattttaaacttgttaatgaaatctaggtaatgtgatatattagtaattatgtattttaaataaaacaagtatgatacaatcattaa

SEQ ID NO: 14230 - DNA, 439 bp, Diabrotica virgifera
  misc_feature (361)..(382): n is a, c, g, or t
aaactaaaaatgcaagacttcggcgaattcgttaaaaccatggaaaacaacaaaatggatcgtgtgaagaaaaacaccgaaaccatcaaggtaatggctgatatggtgttggaagaaatgactaaaatgtatgaacaactgctagtggatgttgcgaaagggactgcctcagagattgatgttaagacttcggaaaaaatgtgtgaaactgttgagcgtactacgtttgatattattcacaaaatgaaatttatatataatgaaggaaacatcatgttaaatgaatagttatttacagttttcgtctatgaatattatgtttaaaattattgattctaatattgaaatactttttggctgnnnnnnnnnnnnnnnnnnnnnnttattataacattttcatcaaaaatttacataaaataaatggtaatacttagattcg

SEQ ID NO: 14231 - DNA, 451 bp, Diabrotica virgifera
  misc_feature (31)..(48): n is a, c, g, or t
  misc_feature (171)..(217): n is a, c, g, or t
  misc_feature (224)..(243): n is a, c, g, or t
  misc_feature (251)..(269): n is a, c, g, or t
  misc_feature (283)..(305): n is a, c, g, or t
  misc_feature (368)..(385): n is a, c, g, or t
cgaacgcgtgggtccagatttattgaatatnnnnnnnnnnnnnnnnnnggatagtaacgtaattttttaggtaaggacagttcattagtattgagagagaccacgatattggaataaagtatataattagtgtatgtaccttgtgaatcagggagtacgacttaagaaatnnnnnnnnnnnnnnnnnnnnnnnnnnnnnnnnnnnnnnnnnnnnnnnctattgnnnnnnnnnnnnnnnnnnnncgttttgnnnnnnnnnnnnnnnnnnnttttaaaataagannnnnnnnnnnnnnnnnnnnnnngggtggacgatcaacaggatccttacttatataatacttctatgctacgtcatatcaacatcnnnnnnnnnnnnnnnnnncaaatcacagttcatcaaaattcaacttcgagattgggattacgctgacgttatttcatattttcg

SEQ ID NO: 14232 - DNA, 238 bp, Diabrotica virgifera
  misc_feature (7)..(19): n is a, c, g, or t
  misc_feature (21)..(44): n is a, c, g, or t
cgtccannnnnnnnnnnnncnnnnnnnnnnnnnnnnnnnnnnnnattttcttcattcgcaggggggatttctcatttacttgtccataatatataaccacccctgaagacttcatcagcaacattgggcggacacaccaggggcaccaaggctgccgcctcctggacgacaatttggaacacctccaaacgggttggatgcatcagcttgagtagctctacagtgtcacctatcatac

SEQ ID NO: 14233 - DNA, 328 bp, Diabrotica virgifera
  misc_feature (202)..(259): n is a, c, g, or t
  misc_feature (261)..(274): n is a, c, g, or t
aatagtctgtaatttttcttccctttcttgtttttttatagacatgactctgtcagttttttcaatctgcctctagtaagttgtaattccatcgttgtcgtggtcttcccactgatcgtcttcctattggggcaccatctttcgctgttcttactactctttttgttgtcattcggcgtatgtggtcattccactgtaatcnnnnnnnnnnnnnnnnnnnnnnnnnnnnnnnnnnnnnnnnnnnnnnnnnnnnnnnnnngnnnnnnnnnnnnnnactgtaaaataaaaaaaatagtcttttgtattaaatttaaaagtctaaaacaag

SEQ ID NO: 14234 - DNA, 383 bp, Diabrotica virgifera
  misc_feature (148)..(160): n is a, c, g, or t
  misc_feature (162)..(177): n is a, c, g, or t
  misc_feature (203)..(243): n is a, c, g, or t
  misc_feature (287)..(312): n is a, c, g, or t
  misc_feature (339)..(360): n is a, c, g, or t
atcacccaaccgctcgccagctcacagggtagcttgaatgggcgcgggctattgtcccagctacagtagcttaatcactaatgtctgaaatgaaagcgtttttgaaagggtggattgactttatgtacctctgtaaccagggattagnnnnnnnnnnnnncnnnnnnnnnnnnnnnnaatttataaaagctcaaaagttcccnnnnnnnnnnnnnnnnnnnnnnnnnnnnnnnnnnnnnnnnnataaaatgttaatcgattttaggtaaccaaagtttttatgaacnnnnnnnnnnnnnnnnnnnnnnnnnngatttatacttacctatttttagaccnnnnnnnnnnnnnnnnnnnnnngatgaccttacgagaaaaatttt

SEQ ID NO: 14235 - DNA, 228 bp, Diabrotica virgifera
  misc_feature (4)..(39): n is a, c, g, or t
  misc_feature (57)..(89): n is a, c, g, or t
  misc_feature (105)..(125): n is a, c, g, or t
  misc_feature (128)..(160): n is a, c, g, or t
  misc_feature (175)..(187): n is a, c, g, or t
  misc_feature (190)..(226): n is a, c, g, or t
aagnnnnnnnnnnnnnnnnnnnnnnnnnnnnnnnnnnnngaacctggggtaccaggnnnnnnnnnnnnnnnnnnnnnnnnnnnnnnnnnccaatttaaaagaacnnnnnnnnnnnnnnnnnnnnnggnnnnnnnnnnnnnnnnnnnnnnnnnnnnnnnnnaaaagtgtaacccgnnnnnnnnnnnnnccnnnnnnnnnnnnnnnnnnnnnnnnnnnnnnnnnnnnncc

SEQ ID NO: 14236 - DNA, 378 bp, Diabrotica virgifera
  misc_feature (9)..(39): n is a, c, g, or t
cccacgcannnnnnnnnnnnnnnnnnnnnnnnnnnnnnntaacaaataaaaggatagcttttcccttaagtacgaacacttcttctacagccaatcaaaatcaaacgcttccaaacctgccacctcttgcacaacctttaacgaagcctccttcaactttggacagtacttgtgaaagtgtgtgccaattattaaactctgaacaatctagacaaaattttgaaaacatatggaagggtcaattaccagaacaatttcagaaaactgttagcttaatggtaggatgcttaacaggtaataataaggaagcagcaaaacttcataaagaaacgcttctgactgaatataaaacgctttgtgaccgatggatagatgaaa

SEQ ID NO: 14237 - DNA, 103 bp, Diabrotica virgifera
aaggaaaattcctgagcctaaattcgaacctgaacgttgcattcccggtggctgcggacgctgacccactgaaacaggccaaatttcaagtcataaaactgaa

SEQ ID NO: 14238 - DNA, 389 bp, Diabrotica virgifera
  misc_feature (10)..(27): n is a, c, g, or t
acggacgcannnnnnnnnnnnnnnnnnttttttcaatctgatctggattactcccgttttgccttgagactttattacattattagcacaaacctactattttcattgcatttgccacctgatgtcgaacttcatcctgcacgtcgcgtcgccatggctagtgatgtctattctgaactttctatattttcgaaatccactttcagctaatttgtgttgtagttgacttcgtacatgttctttgtcttctcatagatctcctgcccacttattcgtaatataccaagttcttctttttcctactttataaataggctcatgcctgttttacttcgattcttcgtctcaattgacgttgtctgaccatattttcctcggtcgtcccattg

SEQ ID NO: 14239 - DNA, 357 bp, Diabrotica virgifera
  misc_feature (72)..(191): n is a, c, g, or t
atctctttgtagggcttaaagtttgaaacgaacaattttataactagttttaggaaaaaataaactaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaaagggagccaagctaaagtacgggggaagggaaaggcaaagccccccaaagggggcaccaaaatccaattcaaggggcggcggttaaaaaggtcgggacggggaaaacccggggggaacccaactaaaacgcctgggaaaaaaaccccctttcgcaaaggg

SEQ ID NO: 14240 - DNA, 231 bp, Diabrotica virgifera
  misc_feature (2)..(38): n is a, c, g, or t
  misc_feature (41)..(118): n is a, c, g, or t
  misc_feature (120)..(136): n is a, c, g, or t
  misc_feature (138)..(230): n is a, c, g, or t
cnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 14241 - DNA, 404 bp, Diabrotica virgifera
  misc_feature (18)..(156): n is a, c, g, or t
  misc_feature (256)..(274): n is a, c, g, or t
  misc_feature (294)..(322): n is a, c, g, or t
  misc_feature (364)..(389): n is a, c, g, or t
aattaaattgaattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaccctacatctaattttaatttaccaataaactgattaagaacagtattaggtctattaattattccatctagattttgattaatcccctctcgnnnnnnnnnnnnnnnnnnnaagattattataacattacnnnnnnnnnnnnnnnnnnnnnnnnnnnnntataaatcccaaggaagaacattaatttttatctcactattnnnnnnnnnnnnnnnnnnnnnnnnnnttggattattcccgt

SEQ ID NO: 14242 - DNA, 250 bp, Diabrotica virgifera
  misc_feature (78)..(95): n is a, c, g, or t
aaaagctggattgacgggttggatggaaaaaaaactgtcttcaattaagttatgcagaattttatgtttaagttaagnnnnnnnnnnnnnnnnnncagactagaagacccgatagagttttatgaaattattaagaagtttttttagcatgaaattgatttaaatgataaatttacttaatgggggtgagtacaacagaaggttaaggttctttagagtatgagaggaattaacaaatttttgatgcaaa

SEQ ID NO: 14243 - DNA, 412 bp, Diabrotica virgifera
  misc_feature (34)..(51): n is a, c, g, or t
acttttccacgtttgcaaataccggctataatcnnnnnnnnnnnnnnnnnncagtccatttaacagtattagtttatagttaacctgcatttaaataataatggtggacacagcacgattgacacgatatgcatcacctgtaaacccagcaatatttccccacctgacactagttttactaggaataggcatcttcttcacagcatggttcttcgtatatgaagtgactagtacaaagaaatctagaagtctgaagaaagagctgcttgtagctcttgtagcatcaattttttctggatttggaatcctatttctactgctttctgtacgaatatatgtataatattttacgtggtatattttcgtaagattaattttcataagtacatcattgatatttgttaatatttta

SEQ ID NO: 14244 - DNA, 411 bp, Diabrotica virgifera
  misc_feature (251)..(272): n is a, c, g, or t
accacgcgtacgaaaaatcggtatttcttggggacttcaaggcgcaggaggtgtacagtgtgttccatttgaagtgggagggttcattagatttccggaaggacggaaaatatgacaacaatgtgatttgcactataatattggccgcattggaggacccctacctaccaaaaaatataagaatcgtccaagccgttttcgagataattgagtgtttccatacatggaactcactctgcatacataaatgnnnnnnnnnnnnnnnnnnnnnnctattacacgaaccacaaaaaaatgggataggaactcaaaataatctattattgtaacagttataccgtaaggcactgtaaggtaaaaaatacatcatggtcatttaatataattcaatcctttgatttatatgtaggt

SEQ ID NO: 14245 - DNA, 384 bp, Diabrotica virgifera
agtcccttgcgatgattctctcatactctctgttgacttgacggatggtcctcgggtccgacatatcccggttctgtccatggatggcggctaaccttctagctatggagtctacctttccttgggcttcgaagtggattccctcatcgtctatgatctgtggcatcctctgttttcctcacgtcttggatttgatcatcttccataagttgccgtggttttcttctgcttttcggatgaggctgtgccactttgcttcgttgagggtgctgagtcgttgtcatatctccgttgagagttcgtcagcatatgtcgtgtattcttccctcctgcttctttggtatgttcgtcaggctctgtgtctgtccttgatttattaatata

SEQ ID NO: 14246 - DNA, 233 bp, Diabrotica virgifera
  misc_feature (23)..(196): n is a, c, g, or t
  misc_feature (211)..(232): n is a, c, g, or t
acaatttcaattatatatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatttaaaaaggnnnnnnnnnnnnnnnnnnnnnng

SEQ ID NO: 14247 - DNA, 403 bp, Diabrotica virgifera
agaaatcacataagtaatatttttaaatatgagtgtgaggagataggggggactatcactaatgcaacatttttaaatcaagtgttcctaagttgtaagtactcttgtactatattgtattgtactatcttatattatatacagctgaactatcagggcatattattctaaagcaaaattctcaaaaatgaaggctaccttagttttggctgttttggtttgcgtcgtaggtttaaccgttagtgcgccccaaactagtgaccactgtaatgcctgtgtaggtttttcgtccatggtcaagaactacgtactcaatcaacgtccattggaggaagttgaaaaagactcagaggatttatgtcaacgtttctacgatatgaaagtgagaaatttttgcgaaaat

SEQ ID NO: 14248 - DNA, 383 bp, Diabrotica virgifera
aatgaaatgcgacttacttcccttgcaagcgacctttgctggtgatcctctgaatcaagggcaccagtaaagaactaacgttataaaagcgtctatatttgttgttatacaactatagcagctgagattgagagaaatcaaagtgaaaaacctctctttcgtttggaaaaacatttattccctttgtattaaaaacatttactagctctctagccgttataacacaagctataaaatcagtttgtcaaatattagttaacaacctaataataataaagtatctgatggtatcagttaataaagttagcaactatgcagttcacagttcacataagtttcagaacattttagcataagacttattttgattgatatatttaaag

SEQ ID NO: 14249 - DNA, 430 bp, Diabrotica virgifera
  misc_feature (311)..(329): n is a, c, g, or t
ccaacgcgtccgtgcgactccacaaacagggtaaattttcgatattttgcttggcgttagagatatcgaaaaaagttatttgaaaaagttgttccaaatattctatccccacataccaggtttcatgacggaattcttacttttggtttcttcaatattttgtagtcaggaccctaaatgatctgtcccgagatgcaagtccggagatgttgcatctctggacagcccatttagggtcatctcatgactacaaatagtgaagaaactaaaagtgcgaattttgtcatgacatttggtatgtggggttcacnnnnnnnnnnnnnnnnnnngttgactttttatatagcctgattaggcatttatccaaaataatatgtgaatcatactacatttaaattttttctaatgactcacactttacattttttgc

SEQ ID NO: 14250 - DNA, 409 bp, Diabrotica virgifera
atttttgaagaatatttaagtaagaaattatgggaaggagttttactggacacatatattccagatttaatagaagagtctcaagtactaccaaatttcttcaacaactctcatattgagcacttgttattgtttctagaaaagtttccaagtgtagctaaagatttgccattggaagattttgtcgttagagctagaaagaagtattacgatgtctataatgtcgtcaaaaagtctaagaaatacaagaatgttctgaatcatggtgatgtgtggcaaccaaactttttctataagtttgattcaaagcacaagccaagcagtgctatagtttttgattttcaactattgaggtatgcacccccagctttggacttacttatgccgctccatgttaatgctacaaaac

SEQ ID NO: 14251 - DNA, 441 bp, Diabrotica virgifera
  misc_feature (146)..(181): n is a, c, g, or t
  misc_feature (192)..(206): n is a, c, g, or t
aaagaatgaaaataagtcatccaagaactcaacataacaaacaaagattttgggaattatatcaacaatctgttgaaaaaaaagaggctccaggtataattgtaaggattgcagaaaaatttgatattggaccttgtttggtagcnnnnnnnnnnnnnnnnnnnnnnnnnnnnnnnnnnnntgatgaaaatnnnnnnnnnnnnnnnaatatcaatgtttatttaagagatacctcattaatatctgatccagtattggcttatgaaatgtttttgtgtaccttgtatgataatgtttatagtcctataacagacgccatgaaaagctctttaggtcaacaatatgaaattaaattgtatagagaagctacacagcttggtttaggtttccgcgatgaagaacaactgaagaagtatgggtatgacaaaactcctgattgta

SEQ ID NO: 14252 - DNA, 375 bp, Diabrotica virgifera
  misc_feature (30)..(168): n is a, c, g, or t
  misc_feature (268)..(286): n is a, c, g, or t
  misc_feature (306)..(334): n is a, c, g, or t
acccacgcgtccgattaaattgaattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgaccctacatctaattttaatttaccaataaactgattaagaacagtattaggtctattaattattccatctagattttgattaatcccctctcgnnnnnnnnnnnnnnnnnnnaagattattataacattacnnnnnnnnnnnnnnnnnnnnnnnnnnnnntataaatcccaaggaagaacattaatttttatctcactatt

SEQ ID NO: 14253 - DNA, 356 bp, Diabrotica virgifera
  misc_feature (2)..(310): n is a, c, g, or t
  misc_feature (312)..(330): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnncaggaattccggaacaattttttcaa

SEQ ID NO: 14254 - DNA, 445 bp, Diabrotica virgifera
caaacgcgtccgggttttagctgtattgtttcttattttcttttgcgaggttttgtctgtaagtatctccaacagacagaagactccattacctatagcttcccctccaaattatgacccagatctgtccaatataatcaaaagtattcaaaatatggaaggagttgctgaaaattttacgaaaaatattttaaggaaccactaccgtaacttaaatcaaaatttaactgatctagacaggcgtttagctgccactacaaatgaagacatcatcggcagatgtgtttctcgtttccaattctcccagtccattaaaaccattgttaacgaacaaattaaaaattgcgctaccattgttttggctgaataccaaaacgtaatcaccaacagtttaaatatggcgcaaggtgttatgaaattttcaactattgtctggacagacatc

SEQ ID NO: 14255 - DNA, 422 bp, Diabrotica virgifera
gtatctctattgaagataatttcaaaatatcgctgcacaataaatgtaatgtgtgcgctaaacagccgtatgatacaagatggggatacatctcttcacattgtctcacagccttcctcatattctttgcgttatcagtcacaatagcgaaaaattttttaggtccatactcctccagaacttcaaccattaattttgttatatattctgcggtatgcttctctgcttttgttagtactgatttgacaaataacggttcgggtgttgtaacaatgaaattaattacactttcatttcgcaagttggaccaaccatcgcattgcaatgataaattgtcagcttgcttaattttatcattaacttgaacttcaactcgctcgtactcttcggtcaggagacgatttgataacatatatctcgat

SEQ ID NO: 14256 - DNA, 142 bp, Diabrotica virgifera
  misc_feature (16)..(44): n is a, c, g, or t
ttttatgtataataannnnnnnnnnnnnnnnnnnnnnnnnnnnnctggtgggggttgttatagttggagttgaatgaattattgattttttaagataatatttgtttgttattatgatgttttaatttgtatattttttttt

SEQ ID NO: 14257 - DNA, 418 bp, Diabrotica virgifera
  misc_feature (242)..(261): n is a, c, g, or t
aacacgcgtccgatctcagccaacgaacaacatagataaaaaatagcaaaacgtaaaaatggcaataacaaacctgcgaagaaaattctgactaaagaaaaccaaaaataaagcaaagatagatgactgataaaatccttcttctcatggacaatcggagaataatgaaaagaaaaaacggacaaaggtataaacaaatagagaaggaaatcaaaaaagaaatcagaatagcaaaggaagannnnnnnnnnnnnnnnnnnnagaaatagagcaattgcaggcaaaacatgatatttttaatgtacataaaaaagtgaaagaacttgcaggtacacaaaaacgtaagcagccaaatattatgtataatgtcaacggaaacataataacataactagaagaacagtttaagacatggaaa

SEQ ID NO: 14258 - DNA, 418 bp, Diabrotica virgifera
aacacgcgtccgaaatgcttgaagacgatcaatgctaaaaaaactaagactaccaaaatatgcttggaagcatttgctggtctcagtgcaatcaataaataaagttaatggattttatttgtgagatactacaaacataacctaaaaatattgctattggctatactagataagagcatagtttctatggataagagagacctgcgtaataaaatactactggtacaaatgcttgaagacgattaatgctaaaaaacctaagactaccacgcttatttatcaaattttacaaattaagttgtaatatattaatgataggaacttttagcggttattagaagtgaaattattttgcgataacttgtaaatctatgttagaaaacaacgtgtgatctttttgttacacatcaacacaatg

SEQ ID NO: 14259 - DNA, 91 bp, Diabrotica virgifera
  misc_feature (30)..(71): n is a, c, g, or t
aaggggttgggaatgaaagaagctgtcggnnnnnnnnnnnnnnnnnnnnnnnnnnnnnnnnnnnnnnnnnngacttttttatgagacatag

SEQ ID NO: 14260 - DNA, 243 bp, Diabrotica virgifera
gccttccaaagggttccaaccttacatttccctgcaggtaacttcataactcttcagattggtaacataaattcatttcacgggccattctttttcaacctcatcaccggaaaacccctgggtttaccaaacttaaggcccttgcagctcatcccccttatcaaaagtgcactattaatgacaagggcgacaccttttgtccttccaaaaaatttcccagccgtattgtggaaaggcacaccc

SEQ ID NO: 14261 - DNA, 409 bp, Diabrotica virgifera
aattactattagaatcttttaataacaatcgtttgtaagtaacagatttttacaactttctaaaattttgctgccaaaagggagagattgtctcggtttctttttggttggctgtcatctcttgtctgcaaataattacatttcaaatgtcaaatttgtttttcatttttagcgtctctggccattaagatattctcgtctttcactacttacagacatatttgggcttccagagacttgcaccttctttaatttttacactttgcatccctcgtttttttttaatttcaaatacctcattaaaaaatcttttggttattctaagggacatttggccctcagtaataatgtaatctttcattctgcgtttaaatttttcaaaaatacttattaattttctccggatttc

SEQ ID NO: 14262 - DNA, 416 bp, Diabrotica virgifera
acaaaaatttcaactgcagtcaatcgatttctgaattgaaatgaaaattatggcgaatgtacggatacggtgtcgccccctaccaaaaccacttgaaactttagtattttgtttaaggcacaacaaacagaacaataatggtaggaaattagcaatgaatttaatagcaaaaatggcagtttccacattttctaggagttatggatggaaaacgtgaaatttcaacctctcagaagggatgggacgaaattataaaagaactgacagcatcagatgcaggtggtcgatttcaaaggtctgctttgtcagcatctttgacaaatcaaaggattcaattaggtatctctggcaaaagtccccatgacgtttttctaggacgtggtacaatttccttttaaaggaaaatttaatgaaat

SEQ ID NO: 14263 - DNA, 434 bp, Diabrotica virgifera
  misc_feature (4)..(25): n is a, c, g, or t
ccannnnnnnnnnnnnnnnnnnnnnccacgcacaatatggcaaaagagtgaatacagtaactaggccttatacattcatagagtttgacacatatatccagaaagccaaaaaacagtttgcagattcgagatcgagaaggaatttaaatgtgataaataatcagctacacgatgtccaaaggattatggtacaaaatatagatgatgtgctgcagcgaggaactgttctatcagagttggacaccaaaacgcagaatctatccatgttaacggacaaatacaagaaggattcgacatacttgaacacaaaatcgatgtacgtaacggcagctgtaggcggactagtctttctttccttcattttatacttctggattttgtaaagcttcaccaagtaaaaaaactctccatacctattcatattctccggcaat

SEQ ID NO: 14264 - DNA, 435 bp, Diabrotica virgifera
cgataagtaacatgtaggtaactactatagtgtgctgtggaattaatttattattagttagtgttacaaagataaattaagtgaaaagatatattctcaaatatggaaaaggcaataatatttacatcagtctctctaatcctcttttctttgtttagtttaggtagttccgtacttaactgttaccagtgtaattccggtactaatcctgagtgtgcagatcttaaagttaatgattacaaatagtacattttacttgccatgtgatgaagactaccatgggaataaaccgttttgcagaatttacgtcacaaacattcagcacgtaaaagatccaaaggacgcaatcagaatttacagaagctgtggctgggaaaactccaaaggcatcaccaaagacctctgcagacacgacgacagtgactttgtgaagaa

SEQ ID NO: 14265 - DNA, 311 bp, Diabrotica virgifera
aaaaaaagtcaggctttatcaacattaagttcaaatacgttaacgaaaaaaaaatttaagcgttacgaccactatagattaactttggtctcagccttaaatgcaatgcttatttcctgcattactatctatgtctgccggttatagaattcacactttaaataatttccagggaatcccttatataggacgttcattaaaacacttacgattgacctgcctttatccaattacgtgaaatccccctttacctggttgtctttttatctctgaattttacccgaatgattgacttatggaaagttcaccct

SEQ ID NO: 14266 - DNA, 427 bp, Diabrotica virgifera
  misc_feature (338)..(356): n is a, c, g, or t
ataagtaaagtaaataatatagagtcagtgcaaattaagaggcagagtatctgtaagagtcttaataatcctacctaaaactatttccaaaaatagaacaatttatgggctatctacctcaaacatatcttcatatgtggttaaggctacctccgatgaacctcatcagcgatttcttcaatagttttttattcattaataaaacttttcattatcaaaactaagtacaaacattcactaatataatagctgtgcgattggctttttgtttataaaaccacgtgcggggtggtttttgatttttgaacagtaacgtttgttaactttgtacgttttgnnnnnnnnnnnnnnnnnnnctttgtactttatatcttctattcaatcattaaatgtaccatatcagttatctcgagataagccctaaaac

SEQ ID NO: 14267 - DNA, 246 bp, Diabrotica virgifera
  misc_feature (133)..(145): n is a, c, g, or t
  misc_feature (148)..(162): n is a, c, g, or t
aattggaatttatgttttaagaaatatacaccaaacgacgtttgaaaagtacatctggtgggcggctttagttgtttatatacttctaatgataggggcacttattgccacaatactgatgtagtttgagccnnnnnnnnnnnnntgnnnnnnnnnnnnnnncatcattttagtacaaatctttgttttttatcctgtttataaataatgttactgggaaatatgattaaaactaaattatttatt

SEQ ID NO: 14268 - DNA, 308 bp, Diabrotica virgifera
  misc_feature (8)..(27): n is a, c, g, or t
  misc_feature (257)..(274): n is a, c, g, or t
acccacannnnnnnnnnnnnnnnnnnnaatgtacaacaagattacaatggaggtggttcttcaggatatgcaacaagcaatattcaaattaatggtttgcatcttcagagtgtcactggatctttaaaatcaggtaaggctgtctatattctatgcggaaataaggcttgttctaactttaattggtccagtatctcaatatatggaggaaacgagaagaacggctgtaattaccatcccaatggatttagttgttnnnnnnnnnnnnnnnnnngatataatatttatatttatgagctaataaagag

SEQ ID NO: 14269 - DNA, 430 bp, Diabrotica virgifera
  misc_feature (393)..(411): n is a, c, g, or t
gccgattttatcgggaagaatttgtaaccgaacattagagagattaaattaaaactgttttagaataaacgcatatgaatccaaaaattgtagattgcctttctaaaacagttttaatttattctctctgatgttcgattgcaggttctttgtgatgggatcggcatcgccgcgctaaggtctctcatgaggactgcattgcctatgttccttatactataaactataaagtcaaggtgaaacggacattagtaaaaatctattcattgaagtagttttaataggacaccctgtgtgtaacaatcatttcctgtatcaggtcattagtagtttattttcgttgaaaatacttgcatagtttaaaagtatgtagcgttttaagaaatcaattgnnnnnnnnnnnnnnnnnnngaaataaaagactcgaagt

SEQ ID NO: 14270 - DNA, 126 bp, Diabrotica virgifera
  misc_feature (10)..(109): n is a, c, g, or t
cccacgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaaattcccaagg

SEQ ID NO: 14271 - DNA, 399 bp, Diabrotica virgifera
  misc_feature (50)..(109): n is a, c, g, or t
atttttctaaagaacaaaatatggaagattttaaataaagatattttgtnnnnnnnnnnnnnnnnnnnnnnnnnnnnnnnnnnnnnnnnnnnnnnnnnnnnnnnnnnnngagtggaacattttcaaagttaaaaataatgttcttacgtataattaatatcattattatccttacttttttctaaattttttacttcaacggggggtctctccctaggtctatttagtaatgtctccttgtattagtattaaacccttgtctatttagtcccccctatttacgtttaggggcggatttctgcaccattttttgcagatagttccctcccatcatgtctttttgtcttaggtataaactctcccctgcccactgatgcttttcactggccggggtatttt

SEQ ID NO: 14272 - DNA, 350 bp, Diabrotica virgifera
  misc_feature (308)..(326): n is a, c, g, or t
ctgtgtgataattgcattgccttggattacaccaaggagtaaaggataaatcaaccaaatctggcctgtttaagtaacaacttgtattgggatatattcgatatttggctcacaggttttatccttattgaaataccactaaagttgtttagaacaacaataatatgattggtacttattggagtcacagtgtgatctaatttgtctttattttcttggaaacatatcccacgaattcccaatgattctggttttattcctttcaatcatttgtctgggaaaccattgttagaacttagtttttccannnnnnnnnnnnnnnnnnnctatttgtcatttaccggtacttt

SEQ ID NO: 14273 - DNA, 406 bp, Diabrotica virgifera
  misc_feature (69)..(93): n is a, c, g, or t
  misc_feature (129)..(173): n is a, c, g, or t
aaatagaaactgagcggaaaggagtaaattggaaaaaaagaaaggttttggctgaaaagtaaccaaagnnnnnnnnnnnnnnnnnnnnnnnnngcaatattcgttgcagaagaaggtatggaaggtgcnnnnnnnnnnnnnnnnnnnnnnnnnnnnnnnnnnnnnnnnnnnnntgacataggtacttatgtgtttacttttgctgtttttttgttcggtaggcacatgtgaaggaattttcagaacgatctaaacttattatataattattttacatataaaatgaagaaactccttcatgtctgtttacctatgtaaattatatatatattctcggtctctttgtagatttttgtagagctttgtttctttctgcttttacatattaactggaataaataataat

SEQ ID NO: 14274 - DNA, 361 bp, Diabrotica virgifera
  misc_feature (34)..(73): n is a, c, g, or t
  misc_feature (178)..(218): n is a, c, g, or t
  misc_feature (287)..(303): n is a, c, g, or t
acgatgatttgtttacttgtgtttttgaaccttnnnnnnnnnnnnnnnnnnnnnnnnnnnnnnnnnnnnnnnntgttcattactcggaaatgattaactttggaggaaaattacacaagtccttttttgttctcaatgataaaaagaatctaaaataaaatctactcgcgctgaaaannnnnnnnnnnnnnnnnnnnnnnnnnnnnnnnnnnnnnnnngtagcaataatttcgaaattatggcattcaggtatagggaatataatatgaaaagtaatcagtgtttcnnnnnnnnnnnnnnnnncaaaaagtatgcagggtgttccatttaaaataagaaagttcattggatttacagaaaa

SEQ ID NO: 14275 - DNA, 354 bp, Diabrotica virgifera
  misc_feature (154)..(181): n is a, c, g, or t
acggattacgcataatatcgttgtagataagctttttgggatatacaatttcaattttgcaataagtattacctaagtgaaacttctcgaaatttttatagttgaatctttgtgatattgtccttattctcacgcaaaattcaggttttttgtnnnnnnnnnnnnnnnnnnnnnnnnnnnnccaaaaaatcgacttttgaagtcatttttgaaataattattaagcaacaaattaacaaaaatacctttccaaacaaccgttttaaagaattttctgtaccttttcagtaaaattttatcacatttccatataatttaccagtcttcaccttcagtatttaaaatcaaataacg

SEQ ID NO: 14276 - DNA, 335 bp, Diabrotica virgifera
  misc_feature (265)..(284): n is a, c, g, or t
acgaccgtatttcgaaagttctgcgaacctttggcaacaatgcgttggcagtacgtgacactttcaaagacgaaggcacaatattggatattgtgataataatatgttgtaaaatcagtgagttaagttcgatttcttgttatacattatagataatcgattttagtagttccaatgtgacacaatatctaggcatgagataaagtttatttgaagaaagtgtttttttttgttcttcttaatggcggtacagactcgtttttgnnnnnnnnnnnnnnnnnnnngagtatctccacatactaacatatttctcaaaataggctctgtaccgccat

SEQ ID NO: 14277 - DNA, 320 bp, Diabrotica virgifera
  misc_feature (15)..(42): n is a, c, g, or t
  misc_feature (94)..(131): n is a, c, g, or t
acgctcatttcgtcnnnnnnnnnnnnnnnnnnnnnnnnnnnnaaaagtatagaatatttttaattaatggtagttaaatattttagttaagagnnnnnnnnnnnnnnnnnnnnnnnnnnnnnnnnnnnnnnaaccttgagtaacataggattatgtaccttgtagttcaaggataataatttcgaatttataagatcaatattttcaaattttttagtgctaaataattattatatttaatgtatttgaaatgtaatgttaaacgtttttgtatagaactgttattcgaatataaatatatctattatttaacgacatta

SEQ ID NO: 14278 - DNA, 258 bp, Diabrotica virgifera
  misc_feature (4)..(257): n is a, c, g, or t
acgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 14279 - DNA, 351 bp, Diabrotica virgifera
  misc_feature (4)..(61): n is a, c, g, or t
  misc_feature (63)..(106): n is a, c, g, or t
  misc_feature (108)..(135): n is a, c, g, or t
  misc_feature (147)..(175): n is a, c, g, or t
  misc_feature (184)..(210): n is a, c, g, or t
  misc_feature (212)..(248): n is a, c, g, or t
  misc_feature (257)..(293): n is a, c, g, or t
  misc_feature (296)..(339): n is a, c, g, or t
acgnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnngnnnnnnnnnnnnnnnnnnnnnnnnnnnngcagggattacnnnnnnnnnnnnnnnnnnnnnnnnnnnnngaatttagnnnnnnnnnnnnnnnnnnnnnnnnnnngnnnnnnnnnnnnnnnnnnnnnnnnnnnnnnnnnnnnncgttattcnnnnnnnnnnnnnnnnnnnnnnnnnnnnnnnnnnnnntcnnnnnnnnnnnnnnnnnnnnnnnnnnnnnnnnnnnnnnnnnnnnccaatactaacg

SEQ ID NO: 14280 - DNA, 242 bp, Diabrotica virgifera
agctgatagtcggttgagcatcattacctgatttatatttcagagtcacctgaaaaatctacataggtatatattatattttctaaaatgaggcacaagcgaaatattttacagttcaaatatattttgtcacaaaatcaataattctgatttcaattgtaaattttgcacactctgtacaaaaataagttgatttaaaccacaaaatatacaatttgctattgcaaataaagtgaattcac

SEQ ID NO: 14281 - DNA, 262 bp, Diabrotica virgifera
agagttgatgctgcgattactaaagataatgttaaagtaacttttaatggattccttacagtcatgctgctttaaagatgaatctgaaatattggtactatactaatattagtatactaccaatattagtatagtaccaatattggtagtatactaatatgaattataaacggtacacttcaaacgtcacaaatcgagtacatcattatttaattaaaaatactgtgtctatatttttgtaaataaaattgttttttttaat

SEQ ID NO: 14282 - DNA, 74 bp, Diabrotica virgifera
aattcacggctcgacgacgcgtcagctgctaatcagatgatcaccatgacaagagctacatttctattgcacct

SEQ ID NO: 14283 - DNA, 321 bp, Diabrotica virgifera
  misc_feature (9)..(28): n is a, c, g, or t
agcccacannnnnnnnnnnnnnnnnnnntaacccaggtgctgtacagtttggaaattttataaattactatcaattccattctccagatgatcgcatcactttattacccaaatatatttgggaccaacataaaccccttgttgctttggatattggctgtaacactgggaatctaactatagctttaaaggacttcttagaggaacatgtttcaaaagatacttcagtactggctgtagatattgatcctgtattaatagatcgagcaaaggatgttaaaaccaataatataaaatttgaatgtttagatataatggatg

SEQ ID NO: 14284 - DNA, 378 bp, Diabrotica virgifera
aggttttatacttctagtcatattcaaagaccatgttcaatgtttaccgtctgcgctattttccaattgataattagtacttgacgccatctttcaacaagtctattgacaaatttacaaaagtagcatacgttgcacgatggtatcaaaattaaaagagctcactgccatggcgaccgttccgtaacacgttccgcaagtagcaccacatttatagaacgaatttccaaccgttgcggagccgctccgtcactttttcgtctcttgaatgcgacaaatgtaacactacgtagtaagtattttgtcaatgtttcttaaatgttgtggttatagctaaaccatctcaaatgggcaaaaaaattaatccgggaaccaaat

SEQ ID NO: 14285 - DNA, 375 bp, Diabrotica virgifera
aggagaaacttcgtgaaaaatgagtgtgcagaaatacggaacggaatacttgagaagttatcccggcttacttaaagtctgtgaacaggtgttgaacatcagcgtaatcatagcaggatcaatttgtggatttttatttaaaacgatccttctaaacttcaacgctatatatgctttatgtaccaccttattcttccttattgtacattacaaagcgttgtttagaaaatcgacttttccgtgggactggatagaatgcgccaacagtctggcagtcgctgtcgtttatgcactaggtgcatcaattacgctctctgaattgtccaaggaatatatagttgcaggaatcattggatacatccactgcaatggcgt

SEQ ID NO: 14286 - DNA, 339 bp, Diabrotica virgifera
  misc_feature (10)..(30): n is a, c, g, or t
  misc_feature (60)..(78): n is a, c, g, or t
  misc_feature (121)..(147): n is a, c, g, or t
  misc_feature (188)..(208): n is a, c, g, or t
acgatcatannnnnnnnnnnnnnnnnnnnntcagagctacaaaattagcatttttatcgnnnnnnnnnnnnnnnnnnnacattttttgaaatgaaatgtgaatcgtatttaaatacagcgnnnnnnnnnnnnnnnnnnnnnnnnnnncattactaacaatatatctagaattaaatactcttatatcnnnnnnnnnnnnnnnnnnnnnggatgaccttactaataatatttcaggatgatttaaattttaaacatcaattatgagtaacaattttcatactttaaaagatgtcaccacttaattctatagattagcatctgcatcctttacaagttttt

SEQ ID NO: 14287 - DNA, 380 bp, Diabrotica virgifera
  misc_feature (2)..(362): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaacaagtcctttt

SEQ ID NO: 14288 - DNA, 276 bp, Diabrotica virgifera
  misc_feature (96)..(129): n is a, c, g, or t
  misc_feature (171)..(192): n is a, c, g, or t
agggatacgtcaggaataaacttttataagcatcgaatttttatagcctaatcatgaataaaacatttcacctgataaaaggcgagaatattaacnnnnnnnnnnnnnnnnnnnnnnnnnnnnnnnnnntattctaaaaatctaaattcaaataacttaaaattagtatannnnnnnnnnnnnnnnnnnnnncattgaataattaatttaaattcatatgtttaataaaggaaatcggcaacatttaattcaccagcctaaagtggaatagtcccg

SEQ ID NO: 14289 - DNA, 355 bp, Diabrotica virgifera
acgcggacgcgtgggcttttttacaatttgtgctgttatatcctctatttttctcgactcttctctatctttcattctcatttatttcttattaatttctctaaacatcattttcaaatgtgcactgtatcatatcttcggtatagcatttcatcttttttctggtcttgaacgatttattatttattcgtttctttcttaatatgtcacataatctacctattctctatgatttctctacacttttctcctccacttcttgcaatgagagattgaacagatacttacacccttttatagctgtgcttttttctgtcgttgctgagattcatcgcctttactaaccacttcattt

SEQ ID NO: 14290 - DNA, 352 bp, Diabrotica virgifera
  misc_feature (125)..(162): n is a, c, g, or t
agcccacgcgtccggcaagagtatacaattgggatgtcaaaaggcgccaagcattaaaagcaacagcagcaaaataatacagagacgtttttgatagaggccaatataataattgcattttctcnnnnnnnnnnnnnnnnnnnnnnnnnnnnnnnnnnnnnnccatcattgtaatctacatccaagcccttgatttcaaattggctgccacagaagaacgattttgtttcttaagtattaaaaatcaaataataattaatgtgatctgtatttctcaagacatgtgacatcaattgcactatattttaattattttctttgcttatttatagttaatttcatttttattatt

SEQ ID NO: 14291 - DNA, 171 bp, Diabrotica virgifera
gatcgcaggcgataaacgctttttggagtctaccaagtgactccaaaaagatatagcagtcatctactagacctgtacaagctgctacaaggtaccagaatcctagaataggtatcacgaatgaatggaacatgtacaataagcctattgactgcattaaaaaaaaagaaa

SEQ ID NO: 14292 - DNA, 401 bp, Diabrotica virgifera
aggcacgggtacatcctacttgacaaacataatataatgttgctgttttaaacgcctatagtgctacaatctatctaaggaactcgttaatattcagctcagcggggtactattgttcgaggtgttaaatttcataaacaagggatctacctgttttaagctgggatctcacggaacgtggcgcggcactttttaccagtttacagttgacgaagagaaatagataaagataaaactaaagacggtaatcaacgcaacgtgaaataacattctttcactcaaaatttgtggttgcgatccgtaggctaggacagatccctcaatttatggtcagcgcgtgttcttttatcatttgtcggtaaatgaacacggttcaaactaagtcagaagcttatacacag

SEQ ID NO: 14293 - DNA, 369 bp, Diabrotica virgifera
cggacacgtgggttttgcagcaaacagttttaagttatttaaaccaactttagtaacaaaaaaatgtcacatcacggaccccctcaccgtaggagcccatccccacctccacctcaccaccatgggcctggacatgaccatcatgatcatggaccaccacaccatcatgatcaaggacctcatcaccatgaccatggacaccacggtagaccaccgccaccgggaccacctgctcgagaatatcctcctggacaatatcctcctggacatcaccatcctcccagataatagtttattcaggtaaaaggaggctaatcattattacattgtaaatcgcttattttattgcaataaaaacttttacataag

SEQ ID NO: 14294 - DNA, 153 bp, Diabrotica virgifera
  misc_feature (27)..(62): n is a, c, g, or t
  misc_feature (84)..(101): n is a, c, g, or t
atgaaagttaattaataatggtagagnnnnnnnnnnnnnnnnnnnnnnnnnnnnnnnnnnnnggcacctggtttccacgggagnnnnnnnnnnnnnnnnnngatttaaaaattcccaatttaaaagagcccaaagattaaaattttaatgggg

SEQ ID NO: 14295 - DNA, 342 bp, Diabrotica virgifera
gacccatgaagtcttgctttgaattggccattttagtttgcgtcggtcttaccgtcagcgcccaaaagaatgatgacataagtgacgaattgtgctatgcctgcgaagaattggcaaaattaatccaagaaagcaaacaaaggggaattccattggaagaagttgacgaaaaagtgagaaaattgtgccatcttttaccaggatttttggaagtattgtgcgattatcagttgattccagacatcgaccaaatgtacaaccagacggaagacatatctcctagagatcaatgcgtaaagttggaattgtgtaataattaaatttttgttagaatattataat

SEQ ID NO: 14296 - DNA, 102 bp, Diabrotica virgifera
acaattaacatgtaaatatatgtatattagatttgttttaaatgagtatatgaatcatttatatttaaatacaaacgaaaatatgatttaatatatttcaat

SEQ ID NO: 14297 - DNA, 364 bp, Diabrotica virgifera
gaatacgtccgcacattcgaatgatagttagtgaacattataattggtgtgaataaattaacaatggaagagaatagtttattttaatacaggaaagctttactgttaggaatgtgtagtaacttcgatggctatatcatacatcattttatacttcatacgtgatttgtgcaacatcaccccttagaattttgagtgtgaaccaaatagtttcgtaaagtcatctgtagtgggacgtcctccatttttaactccagtattatttttcccagttagattaattgttaattttgcatttgtgtttatactgaactaatttttatattatgtacatgatagtatttttacgcgcagtgcttaaaga

SEQ ID NO: 14298 - DNA, 418 bp, Diabrotica virgifera
aatttatcttaggtagaatagatgtgtcatttctaaacaaagaaagaaagtttcaatacaaagaagactacgaaaaatttaaacttgtttgtcacttcatagctttcgtgttatgtattactttaagccattacaactatagatttttggacaagatattcgctggcttcttagcttggtactattgtacgatttcaattagagaaagcatcctcaaagtgaatggatcaagaatcaaaggttggtggagggttcatcacatcctatcaatagttagttctggtttgttacttacatggcctgacaatgaaccgtgggagttgtttagagtgtacttcatccgttataccatttacagtacttttacacagtacctgcagtttagataccaacgtggagttctccacagactaaaatc

SEQ ID NO: 14299 - DNA, 334 bp, Diabrotica virgifera
  misc_feature (118)..(312): n is a, c, g, or t
acgtaaatttttgtttgcaaaatcagctgttactcatttctacggtgtagcttttgtacgtgccttgtttttctatattattttttgtactgaaattgtgatatgagcattggagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccctcaaaggtttcaaattt

SEQ ID NO: 14300 - DNA, 260 bp, Diabrotica virgifera
  misc_feature (3)..(75): n is a, c, g, or t
aannnnnnnnnnnnnnnnnnnnnnnnnnnnnnnnnnnnnnnnnnnnnnnnnnnnnnnnnnnnnnnnnnnnnnnnntccacaacaaaactaccttcaacgccggccgcccgggcagttcctggcctggctagcccgctgtcgccatcatctctctccacttcggccccctgagttcggttcaccgtgcgtccttttacaattgtcgtcacgcggaacactctggagtcacccaacgtacccgccttgtactgggccccctt

SEQ ID NO: 14301 - DNA, 249 bp, Diabrotica virgifera
  misc_feature (20)..(37): n is a, c, g, or t
  misc_feature (152)..(234): n is a, c, g, or t
cacgcgtcagatatggcccnnnnnnnnnnnnnnnnnntacatttattcagttttgccaaactactaacagatacgtattttcgaatatccttttgattttaacaaagagcattgattattttaagcttctagatgtgaaataaacggtcaannnnnnnnnnnnnnnnnnnnnnnnnnnnnnnnnnnnnnnnnnnnnnnnnnnnnnnnnnnnnnnnnnnnnnnnnnnnnnnnnnnggcccaaggggatcc

SEQ ID NO: 14302 - DNA, 394 bp, Diabrotica virgifera
  misc_feature (45)..(45): n is a, c, g, or t
cctccggatttcgtcacaggtcatccccgcaatgatgttatgcanaacaaaacctttttgaccgtacaaaaaacaaaacagtcacaatcaagataagccaacttggaaaactattgcaacggatgcaagctgggaaactaagtttatttggagtagaccagacccattaacacctaccagtcaagcagaaattcgatgggagattccagatgacacacaacctggatcttaccaaatccaacatttcggcaactataagacgctttttagcggcatctatgcgtatagtggtgtctcgagaatattttctgtgaaagaaaattgtcaatccaagtgattcattatttttagatataatttttgaattttggtttaataaatttgttagtttttt

SEQ ID NO: 14303 - DNA, 236 bp, Diabrotica virgifera
ctccggaaactctggaggccctctagttgtgaatggtgtacagatcggtattgtgtcctttggttcatcgattgtcataattgattgcactctcattcatacggagttcattcttccaggaccggattgcatatcattcggaccttttattttaattcttgctcatctaattctttgttaatcattttatgatccaccatggtggcacgggatgcagttcgctaccatcatttaat

SEQ ID NO: 14304 - DNA, 197 bp, Diabrotica virgifera
  misc_feature (76)..(88): n is a, c, g, or t
  misc_feature (90)..(105): n is a, c, g, or t
  misc_feature (113)..(136): n is a, c, g, or t
  misc_feature (184)..(196): n is a, c, g, or t
aattttattgattttaaaatagtaaaatgtttttttactgaaagtacagacgagttttatttaatgatagtcacgnnnnnnnnnnnnncnnnnnnnnnnnnnnnnacaagacnnnnnnnnnnnnnnnnnnnnnnnngtcagggattatgaatgactaattcgccgtcgattacgtgcgagttgnnnnnnnnnnnnnc

SEQ ID NO: 14305 - DNA, 262 bp, Diabrotica virgifera
  misc_feature (211)..(257): n is a, c, g, or t
cccacacgtccggatgtttattttcgataggagcagaattattatcgattttttattttactggtatgatatgagaacatttattttatttagtgtgaaagagcttagccattttttcatcaaaccagctttattaattatttaagtctcataaaaacgaacatgttgcttttgcaatgcccaatcaaaattgtaccatattatgttaacnnnnnnnnnnnnnnnnnnnnnnnnnnnnnnnnnnnnnnnnnnnnnnncgaaa

SEQ ID NO: 14306 - DNA, 133 bp, Diabrotica virgifera
aaatcatggcatggagacatcggtgtttgtagcacctcgatcgaggtcgagagattgagacggtatggtcttgcggagtggaccgttacggcgaagcaaatcaggtgatgacgctgataatgtagcggtcttt

SEQ ID NO: 14307 - DNA, 403 bp, Diabrotica virgifera
  misc_feature (16)..(47): n is a, c, g, or t
  misc_feature (100)..(117): n is a, c, g, or t
  misc_feature (127)..(149): n is a, c, g, or t
  misc_feature (217)..(234): n is a, c, g, or t
  misc_feature (248)..(267): n is a, c, g, or t
cagttgttctttcatnnnnnnnnnnnnnnnnnnnnnnnnnnnnnnnnacgctgcccttgttgtggccacaagtaccaatctaggtgccttcgaaaagtcnnnnnnnnnnnnnnnnnnccatagaacnnnnnnnnnnnnnnnnnnnnnnncacttcgttgcgctgtgttcgaagacaacctcaaaatgttcgaggaacacaatgcggaatacgaaagnnnnnnnnnnnnnnnnnngttggctgttaatnnnnnnnnnnnnnnnnnnnncgctgaattccacgctatgttagctcgtcagattgctaatactgccaaacagtccttaagtgcactacacgtaaccgatgccaatgtcaacgctgtagaaaaactgtattggagagatagtgcctttttgggattc

SEQ ID NO: 14308 - DNA, 255 bp, Diabrotica virgifera
agttcgtttatagttttttaaatacgaatttagacagcaatgacaggtatacatgtgcaggttccatcaggagcgcaatatccagctctgtgtccttggcctctacatgtatacctgtcattgctgtctaaattcgtttatagttttttaaatacgacaattgttttttatctctaggcctacggtaaagactgtctaatttgtacatagttggtaatatagaataaaatgtaaaatcaatagaaaaaaaaacaa

SEQ ID NO: 14309 - DNA, 396 bp, Diabrotica virgifera
  misc_feature (7)..(51): n is a, c, g, or t
cccacannnnnnnnnnnnnnnnnnnnnnnnnnnnnnnnnnnnnnnnnnnnnccacctgggcaaaactaataaaaatctcttaattgacacgtttctttgacgaaatacctaaacgaagtcttgttttgccacacaaagcacatggatgaaaaattccttatgaccatttaacgttgcaaacgggattgtttggagtcagtatgagctccgcccaattttgtgacatcagacttagccccgtgttcatggtcggtgctcaggtttgagtcgatgcttaaggtcggccttgggcatcgactcaaacttgagtgccgactatgagtacgggccttaggctgtctattgccttgtgaacataccgttagggtatcatcttgataggattcaataattttc

SEQ ID NO: 14310 - DNA, 423 bp, Diabrotica virgifera
  misc_feature (120)..(138): n is a, c, g, or t
ctgaatttagaaatttatcatttgcaaaacctacgaccagccataacgacaccataattcgtattacagcatccaatagttagatgaattaaagaacagcacacgcatttataaattccnnnnnnnnnnnnnnnnnnncatctcattttatccgacactagcgaattggcaactagagccagaaacaaaagtatggatgggatggcttaagagagtactaagcagtccatttttggtataaaattattgttttcgcccaatttacaagattaaaatttgaaaaccttgaattatccatatctgtcggtccgtccgtaaacacaactcatcgattattagaacagatagaacgacaaatcaagtgtcgaatgagagcttttaacccatggattaaagatgagaaatttgtcctcggacttcctg

SEQ ID NO: 14311 - DNA, 324 bp, Diabrotica virgifera
aggtatttcataactggcagtacattctacatatactctttaaatcgtattaaagatgtaatttattactgcactaactgaatgctctcgcaaatgtaggtcaaatgcgagtgagctgtcaacgcagatttatggtcatcctacgcacgtggagttttctttaatttaccatgtggatgagcactaacactaggaggtctagcagtgaggacaactaaatattgattcgtcgccactcgttcaaggtgaatatgctggggtaataatagttccttccgaattgcacgtggtatcatactaggtggtaataactccatgagctca

SEQ ID NO: 14312 - DNA, 135 bp, Diabrotica virgifera
  misc_feature (11)..(99): n is a, c, g, or t
aatgatagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatttagtattttcgaatttagaagagctaaaaa

SEQ ID NO: 14313 - DNA, 86 bp, Diabrotica virgifera
  misc_feature (5)..(23): n is a, c, g, or t
ccaannnnnnnnnnnnnnnnnnnggtatgtatgacactttagaaacaataatcaaaaatcacttcatatcaaaaacaaacgttatt

SEQ ID NO: 14314 - DNA, 386 bp, Diabrotica virgifera
  misc_feature (51)..(72): n is a, c, g, or t
caaacgcgtccgaaacatttcacaaatatttacctattaagacttaattgnnnnnnnnnnnnnnnnnnnnnngaaggaaatacaagtaaagtatatatcgtaaaaatagacaaaaaatctgcactagtgttgtaattattactaatgtttgctcagctcatccataacttaaaccaagtcttatagagtattatacggttgtaatagttaggcagattatgtatttatttcgacgcttagatacctacctcagatacttatctccaaaaacgttcagtataagaagatactaggcatacggttagtaccttaggactcacccggaggaggagcgagcttctcgtggggagctgagcagaaatttacggtacttgagacctaaaagt

SEQ ID NO: 14315 - DNA, 259 bp, Diabrotica virgifera
aacgtatattaagaaaatttaccattttctctctgaaacccagatttttatgatggtaaacatggtgaaacctctctgatgaaaatctgatgaatgttgtgtacatttgccgtactttggtaatgaaatctaatacttttatttagcttacataacatgacgttttttttagatcttagtcaagttcgtttgtaagttgcttgttttttagtcgaatggatatgtacttgttaagttgtattaatgatgtagatttttt

SEQ ID NO: 14316 - DNA, 294 bp, Diabrotica virgifera
  misc_feature (16)..(33): n is a, c, g, or t
  misc_feature (72)..(91): n is a, c, g, or t
  misc_feature (94)..(111): n is a, c, g, or t
aagtaagattttatcnnnnnnnnnnnnnnnnnngaaacttacgattatctgtttacatattttagtatatgnnnnnnnnnnnnnnnnnnnngcnnnnnnnnnnnnnnnnnnggagttttttagaaatgtataaatttaatttaggcaaatttactaatgatgataatattactattaaatctttatatatttactagaaatctttacgtttaatacatgaattctgaaacattattttcaaatgtttagtaatatcttgtctttttgtattacatacattctcactcctgaaaa

SEQ ID NO: 14317 - DNA, 99 bp, Diabrotica virgifera
  misc_feature (4)..(40): n is a, c, g, or t
  misc_feature (71)..(93): n is a, c, g, or t
gcannnnnnnnnnnnnnnnnnnnnnnnnnnnnnnnnnnnngtaagttaggaagaattttagtttgaagtgnnnnnnnnnnnnnnnnnnnnnnngacgag

SEQ ID NO: 14318 - DNA, 293 bp, Diabrotica virgifera
taaaaatcatttagttttggacatttgtatgtataatgaccctgctatgttggattgcatgtacgttgaagcaatgaatacaatgcaaacaaacccagattatgcaaaaatgttcagaggtagaccgggaagatttgtgttgcctctgaactccaattcaaatacagataaaaccaaaaatttagttgggataaaaaatacaagagccaaagcgtattatatgtccgatggaaatatatttgttaagccagaaaaactttgcgatttacgctgtgagactcccagaatacatt

SEQ ID NO: 14319 - DNA, 402 bp, Diabrotica virgifera
  misc_feature (321)..(344): n is a, c, g, or t
gcccccaactatttccctaacagctttaacggtccagtatgtgacaaagtcgctcaacatctcgaaccagcatttactgtttctggagaagcttacagatacgacactggagattctgacaactttagccaggctcgtagatttgtgcagaaggttctaaacagagagcaacaagacagattggtctccaacatagtcggacatctttccggagctctggactttatccaggaaagacaagtcaatcacttcaaacaagtggatcaatcatttggagagagaatcgcagctggacttcaaaacgtcaaacacactaagggnnnnnnnnnnnnnnnnnnnnnnnnttacttttttgttatgtacttgatttttgttgttaatcaacgtgtgtgtcaacgttta

SEQ ID NO: 14320 - DNA, 370 bp, Diabrotica virgifera
  misc_feature (13)..(95): n is a, c, g, or t
  misc_feature (97)..(110): n is a, c, g, or t
  misc_feature (116)..(136): n is a, c, g, or t
  misc_feature (138)..(153): n is a, c, g, or t
  misc_feature (183)..(201): n is a, c, g, or t
  misc_feature (227)..(252): n is a, c, g, or t
  misc_feature (254)..(300): n is a, c, g, or t
  misc_feature (317)..(338): n is a, c, g, or t
aattttatttagnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnngaaggnnnnnnnnnnnnnnnnnnnnngnnnnnnnnnnnnnnnngtaattagatatttattagtttcgaagttnnnnnnnnnnnnnnnnnnncatttttattgtaggataaatagtgnnnnnnnnnnnnnnnnnnnnnnnnnngnnnnnnnnnnnnnnnnnnnnnnnnnnnnnnnnnnnnnnnnnnnnnnntttagtaacaatagagnnnnnnnnnnnnnnnnnnnnnngattaatatgaaggatttttacggatgagctt

SEQ ID NO: 14321 - DNA, 292 bp, Diabrotica virgifera
  misc_feature (2)..(18): n is a, c, g, or t
  misc_feature (21)..(37): n is a, c, g, or t
annnnnnnnnnnnnnnnntcnnnnnnnnnnnnnnnnnagtaaacttttattttacttaaattgaatgattaataattgtcagtgagtttaataattgtattctgcagaggtttatttttaggtttatgatcatcaggtattagtaatatatagttatatactcactagtattaagtttcaatttcaatggaccttttaaattttcattgtcaatgtaacattctgattatattttttattgtcatatggaattaacgtttggtttaatctagttttgactgcattaaattca

SEQ ID NO: 14322 - DNA, 125 bp, Diabrotica virgifera
  misc_feature (12)..(35): n is a, c, g, or t
gacgcgtggggnnnnnnnnnnnnnnnnnnnnnnnngcgagaaaagaaattgcgagctcgatgttggaataaagtttataattggtgtggcatctagagcattgagtctgttggacttttaaaatt

SEQ ID NO: 14323 - DNA, 134 bp, Diabrotica virgifera
ccaacgtcgttattgtgaaaatcgacgttgatgaatgcgatcatcgcgctacggaatagaacatcaagtccatgcccacagtcattttcctgaagaatggtcaataaatcgcgaatttcagcggggctaactac

SEQ ID NO: 14324 - DNA, 74 bp, Diabrotica virgifera
agcggacgcgtgggagatattagaccatgacctttattaggagcttttagagcaatattaacaatattaggaat

SEQ ID NO: 14325 - DNA, 227 bp, Diabrotica virgifera
  misc_feature (6)..(36): n is a, c, g, or t
  misc_feature (49)..(80): n is a, c, g, or t
acggannnnnnnnnnnnnnnnnnnnnnnnnnnnnnncaacacaaagagnnnnnnnnnnnnnnnnnnnnnnnnnnnnnnnntacaaggggattgcaaagtccactcaaagtcactagtggcaattgccctgggcagcccctcaagaggctccactccttacatttccctctattcgcctatcaaacattttttacgcaggctcctagctccacaactgggtgcttcca

SEQ ID NO: 14326 - DNA, 385 bp, Diabrotica virgifera
agggaaggtttaaaatacctttttatcgcatattcctcgtaaaagtgaaatctggcagtacagtgttgcgaaattgagggctttttctggaaaataagattatgctctttttgatttttgtgaacggtgattgtggaagagcaaacatctcgactggttctttgggtataagcgacggtgtttcctcgtcggcaatcgctgggttctaattaacatatatgtcaatagaaagtttttaggcacaaaccgtcaatacatataggcatgctattgtcgaagatgtctaaagatccctagaactgtagaattgtttcatttttcttttatttcttagtaggtaagtttgtgatttatattgatgtgtatgccaattaatataactaat

SEQ ID NO: 14327 - DNA, 406 bp, Diabrotica virgifera
  misc_feature (72)..(90): n is a, c, g, or t
  misc_feature (165)..(180): n is a, c, g, or t
agttaaattgttaattttgtttattgtgaaaagaatctaatcaaaatgcggagaggaataggtgtaggagcnnnnnnnnnnnnnnnnnnngaacaagaacgataccgaggcaaaggaaatgaaattcaagagagtcagtttgggcaaatgaccaaacaaatggannnnnnnnnnnnnnnnctagaagattttgccactaaacacaagaatgaaataagaaaaaatccagaatttaggaagcaatttcaggaaatgtgtgccagtattggtgtagatccattatcatcagggaaaggtttctggtctgtattaggcataggagatttttattatgaattagcagtacaaatcgtagaagtctgtttgtctacaacagcaaagaacggaggcctaataagtttagatg

SEQ ID NO: 14328 - DNA, 144 bp, Diabrotica virgifera
atttacgtgtaagttttgttgattgtgacgtgattccaatcaaattgcggttaggactaggtgtacgaccaattatacctcctctcttagaccttgagtcatacccgggcggaggagatgatcttcccgaccgtcagtttgggc

SEQ ID NO: 14329 - DNA, 309 bp, Diabrotica virgifera
aaccacgcgtccgcccactcgtccgctaatatgtaatttatgactttagttcaggaaaaacgtatatcgcagtatttccattagttcgttatagttattgattgtcatcgggtttgcgatttttgacatttttatgtgtcatgggcgttatgtccgatatttgagattgtcaatagatatccatcagtttttgccatggaactccgttatgagctaggagactcgtccagagtttagggaggcagtttccggatctgtgtgccagtactggtgtacatccattatgcccagggaagggtttctggtctg

SEQ ID NO: 14330 - DNA, 402 bp, Diabrotica virgifera
agaagaacaggtctattaatgctttgctggaggtcggtactgggaagctgttggggaccagtaactgggatgttaatgtggtagcgggaattttatctaaggatggatcagtggaattttctgtggactattttaaggtccacataaacatcagccagaacatggacacttcgatcccaccatcgttagaagacattcagttagaactcggcaacatacaaattacattcgatgggttaggtactgtggattatctcatcgaattcggggtcaatgttattccgaacctcttaaggtatcaaataatggatgccgtggagaaactcatacagtttaaaatccaggaagccttaaatcaaatcacgatcgacaagttgataaaccagaatgcccaacaactgg

SEQ ID NO: 14331 - DNA, 214 bp, Diabrotica virgifera
atccgactccatgtcagattattaatatttcattatttagattaccatcccccgctaatatttcttcattatgaagttctggatcagtataaggaccatgtttatgaattcagcgtatgcgatgcctatctttagctctccgtgattgcgaagattgtttaccagcatttaatagagttgctcatctttgccgagatctatcttatggtctgat

SEQ ID NO: 14332 - DNA, 316 bp, Diabrotica virgifera
  misc_feature (169)..(209): n is a, c, g, or t
  misc_feature (249)..(266): n is a, c, g, or t
agttttatatttattaaagattatttaagattgtgtaccttgtgtttcatggaatatagtattgacgataataatataataattacgatgtaaattgagcaaaaatatgaaggtttataatgtgaattcggcaacatttattacacctgtgtattaaaaagatatccgnnnnnnnnnnnnnnnnnnnnnnnnnnnnnnnnnnnnnnnnnagataggacgcggtaatttgaccgtgaaaaggtatcaaannnnnnnnnnnnnnnnnncaaagcaggagctaaaggttggatgattaataaactgtcattatttaatt

SEQ ID NO: 14333 - DNA, 201 bp, Diabrotica virgifera
aaacggttcgcaactttaaacgtataatggaggctagagtaattgcgcggttcggtcgagattttacatttgcactacaaatgaaggagcaaaagttttgttaacacaaattataagtatataagaaacttagatagcaggggtattcgtctaacccgactgaactattattatacttaacgacaatacttacttctcaaa

SEQ ID NO: 14334 - DNA, 135 bp, Diabrotica virgifera
  misc_feature (2)..(26): n is a, c, g, or t
  misc_feature (68)..(101): n is a, c, g, or t
  misc_feature (115)..(133): n is a, c, g, or t
annnnnnnnnnnnnnnnnnnnnnnnnccctttttttctattctttctttttactttttatctttttgnnnnnnnnnnnnnnnnnnnnnnnnnnnnnnnnnnctttgagagtggannnnnnnnnnnnnnnnnnnaa

SEQ ID NO: 14335 - DNA, 317 bp, Diabrotica virgifera
  misc_feature (7)..(109): n is a, c, g, or t
  misc_feature (119)..(146): n is a, c, g, or t
  misc_feature (148)..(261): n is a, c, g, or t
  misc_feature (293)..(316): n is a, c, g, or t
aaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatggagnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattatttagttttatatagtatcacttttannnnnnnnnnnnnnnnnnnnnnnnt

SEQ ID NO: 14336 - DNA, 349 bp, Diabrotica virgifera
  misc_feature (107)..(129): n is a, c, g, or t
aaaatcttaaatgatacattattacaaaggtctgataattttataacatcgaagctaaaattatttcaaaggtacaataggttagaattatttcgacgctgtattcnnnnnnnnnnnnnnnnnnnnnnnggtacctacatattacaaaggtttgacaaatttataacatcgaagatatagattatttcaaaggttcaatttcgacgctacatttccaaaaaactacaaaaaatcttaaatgatacattattacaaaggtttgataattttataacatcgaagctaaaattatttcaaaggaacaatcaggtagaattatttcttattttttaacccgaaggtatggatt

SEQ ID NO: 14337 - DNA, 68 bp, Diabrotica virgifera
  misc_feature (14)..(36): n is a, c, g, or t
cgcgtcaacccaannnnnnnnnnnnnnnnnnnnnnncgcgtcagcccacgcgtccgctcacgcctccg

SEQ ID NO: 14338 - DNA, 103 bp, Diabrotica virgifera
atccacacgtccgcacaaatatgaagattgttttaagagttttgttcgctgcttgtttgtcacagaccgttatcctatctagatgacatttcgattgggtgca

SEQ ID NO: 14339 - DNA, 312 bp, Diabrotica virgifera
  misc_feature (11)..(109): n is a, c, g, or t
  misc_feature (113)..(140): n is a, c, g, or t
  misc_feature (146)..(269): n is a, c, g, or t
  misc_feature (271)..(286): n is a, c, g, or t
aatttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnngatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnctattatttctatcttctataaattt

SEQ ID NO: 14340 - DNA, 51 bp, Diabrotica virgifera
aaaaaaaataagcaaaaactataacaatcaaatctaaagtcaaactaaaaa

SEQ ID NO: 14341 - DNA, 308 bp, Diabrotica virgifera
  misc_feature (233)..(269): n is a, c, g, or t
accacgagtccggttgaaattgcaccagcattttaataatatatgcacaatagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacannnnnnnnnnnnnnnnnnnnnnnnnnnnnnnnnnnnntataggcgcagcgccccccaaaaccaagacaaaaacaaa

SEQ ID NO: 14342 - DNA, 265 bp, Diabrotica virgifera
  misc_feature (115)..(205): n is a, c, g, or t
  misc_feature (207)..(220): n is a, c, g, or t
agcttaagggaactggttcagaccaaaaaggaatcatgaatgttttgctagttagatatgatatttattgatacatttgtatgtcacacgtttttcagatcttaataaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnngcaaaatcttttaagaaataaaataaacttaaaattaaaaggggg

SEQ ID NO: 14343 - DNA, 312 bp, Diabrotica virgifera
  misc_feature (26)..(72): n is a, c, g, or t
attttaattaaattattagttaaccnnnnnnnnnnnnnnnnnnnnnnnnnnnnnnnnnnnnnnnnnnnnnnngacacacaagggcggggacgcaaatctttcgcgatcttggttgatggaacgctcaacgacatcgtcactactcatgtcagtaccgggactctcttcatcggtcgtcctttctgtttaacctcacgtgttccccagtgacatcgccttccttcaccccgtcctatcgccaccccctttcgtaaccgtggcttgtttcaagatggcccggcccaatcggcccgccctacacatggctttcgt

SEQ ID NO: 14344 - DNA, 148 bp, Diabrotica virgifera
acatgcctttcaattggtcgttaaaagttggatgaacttcgctgtttggcttaaaaactaggccaatattgactcttcgaatatgcaacttttttccgtatatgagtttagggcgatgttttagtgctaaatgatcgaagtagatatc

SEQ ID NO: 14345 - DNA, 147 bp, Diabrotica virgifera
  misc_feature (123)..(145): n is a, c, g, or t
caacaggcaaaaagtgcatccacgatcaagtacccgccttctatgctaacactggaaaacttttgggtgaaattgctacatgtgctgctgcctaaattattagaagatgttatgaccttttgnnnnnnnnnnnnnnnnnnnnnnnat

SEQ ID NO: 14346 - DNA, 58 bp, Diabrotica virgifera
ggtcatttctatggaggtcgtttcgatgggccttcccagggtttgccctggttgaatg

SEQ ID NO: 14347 - DNA, 402 bp, Diabrotica virgifera
  misc_feature (170)..(219): n is a, c, g, or t
taaaagctgccacgaacgcgttggatgaacacaatcagtgccttcatctatgttagctggaattttaggttgaagtaaaaaagctcagtctttttttaaaatgacgagagagactccaatagagttgttaaaaagctaataattaagttattttaagattaaattcaatnnnnnnnnnnnnnnnnnnnnnnnnnnnnnnnnnnnnnnnnnnnnnnnnnnatttaaattataataatatggagtgattttttgatccatttaacttgattaaaagaataatttaccttaaggatatcatggtccatttattgtggagatcagatcgatttaccttattgataccaccatgttggaatagggtagatcattgctgtagcagctatagtaacaactctgttcgac

SEQ ID NO: 14348 - DNA, 438 bp, Diabrotica virgifera
  misc_feature (67)..(87): n is a, c, g, or t
caaattcaaacaaaactttccccattccaaagtgcctagccaatcagaaacatttatctccccaccnnnnnnnnnnnnnnnnnnnnncaaacagtcattctctcaaaaatattcctacccaaacttatgactttccggaaattatgtaaatattcctatcattaaacaatcatatttaaaattccaaactttctttaccttaatttcctaagaactaattaatgtggtttttggaatcgtgcataacaaaacaccgttataatctccaaataccctgaacaataattattgtcttattcatatcactttctttcctaatgtgttttatttttcagggaaaaacttactaacgataaatcacttcttaaaaactacttataataaatagttacaaatcaatatacagggtggatcaaatttatgtgcccgcgttatatt

SEQ ID NO: 14349 - DNA, 380 bp, Diabrotica virgifera
gaggcgtagtaagtacgccacacgtgtagttatgatataatttgatacgcgggtagttagaggttaataaactgtctcaaaataggtactgtttccacctttttctgacatccttttcgtggattagtattttattttcatctcagatacatctaatctgattaaaatcttttgctttctttgttctctgtttggcattttatatatctttgtcttgccctccctggtattaagttgatcccataaatttgtatacgcttctgctttagcatatgctactgctactttggcgacaatatagttttaaagatctgtcagctccattttcttgccattttttatggagtgtttcaaaggtacctaatagttataactttttg

SEQ ID NO: 14350 - DNA, 266 bp, Diabrotica virgifera
ccttgaatgcaacttcaaaccccttcaaaagtgtcaccaaaattcaattcacgggccgtcgtttaaaaacttcttaacgggaaaaaccctggctttaccaaactaaacccccttgaaaaaaatccccctttcccaaactggcttaaaaccaaaaaggcccgaaccaatcccccttccaaaaatttgcccaccccaaatggcaaatggaaccccccctgtaccggcccattaaccccggcgggtttggtggttacccccaactttac

SEQ ID NO: 14351 - DNA, 411 bp, Diabrotica virgifera
  misc_feature (75)..(102): n is a, c, g, or t
  misc_feature (104)..(149): n is a, c, g, or t
  misc_feature (217)..(236): n is a, c, g, or t
  misc_feature (247)..(278): n is a, c, g, or t
  misc_feature (281)..(309): n is a, c, g, or t
  misc_feature (317)..(357): n is a, c, g, or t
  misc_feature (380)..(410): n is a, c, g, or t
gaaataataagtttaatttaaaaccgaagcaattaatggtaaaaataataagtttaaaaattaatggaaatggcnnnnnnnnnnnnnnnnnnnnnnnnnnnngnnnnnnnnnnnnnnnnnnnnnnnnnnnnnnnnnnnnnnnnnnnnnnaaaatttgtgaaaggttcttagggtttagcaatttttaattataaaaagttcgtgtttaagggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggtttacattatttctcnnnnnnnnnnnnnnnnnnnnnnnnnnnnnnnt

SEQ ID NO: 14352 - DNA, 95 bp, Diabrotica virgifera
actcttccggcatttgattgaaataagtataattcatttaagtactaaatttcatggcataatccgtttatctcactcgtgtgatcaaagttttg

SEQ ID NO: 14353 - DNA, 232 bp, Diabrotica virgifera
  misc_feature (59)..(80): n is a, c, g, or t
acgatatggctgaattgaatgttacatatcttttgacagcagcttcttgttcaaacagnnnnnnnnnnnnnnnnnnnnnntgttcctgtctacaaatacatggaagatgttagactttttaatccaaaggaagtagatttacaaaatcattggttcaataaagtttctcttgtcttgtatccattacatactgtttaatatctgtgttaatagataaagaagtataactcat

SEQ ID NO: 14354 - DNA, 430 bp, Diabrotica virgifera
  misc_feature (84)..(101): n is a, c, g, or t
  misc_feature (399)..(424): n is a, c, g, or t
cccacgcgtccgaaaaacgtcaaacatagagataacctatttcctattttatattgaaaattgaaatttttatcaaattgcacnnnnnnnnnnnnnnnnnngaacagaaaggaggcactatcgactttcattcaacaaattcatggtagacctgttgtagtaaaactaaacagtggcgtggattatagaggcgttctagcatgcctagatggatacatgaacattgctttggagcagactgaagaatatgttaatggccagctaaaaaataaattcggtgatgcatttatcagaggaaataatgttttgtatataagcacacagaaaaggcggtactaattttagttttaagttatataaataacatgtaattctgctaagaataaaaagttttgtaannnnnnnnnnnnnnnnnnnnnnnnnnggccgc

SEQ ID NO: 14355 - DNA, 244 bp, Diabrotica virgifera
tcttacatgcaacttcatacctcttctaaattgtccccaaatttcatttcactggccttctttttaaaacttcttgactggaaaaaccctggctttacccaacttaacccccttgcaacaaatccccctttcccaaactgggttattaccaaaaaggcccccaccgttcccccttcccaaaatttccccaccctaaatggcaaatggaaccccccctttaccggcgcattaaccccggcggttt

SEQ ID NO: 14356 - DNA, 322 bp, Diabrotica virgifera
  misc_feature (19)..(46): n is a, c, g, or t
  misc_feature (59)..(76): n is a, c, g, or t
  misc_feature (81)..(102): n is a, c, g, or t
  misc_feature (155)..(207): n is a, c, g, or t
  misc_feature (279)..(297): n is a, c, g, or t
acgagattattaattaggnnnnnnnnnnnnnnnnnnnnnnnnnnnncaacagctaacannnnnnnnnnnnnnnnnncaacnnnnnnnnnnnnnnnnnnnnnntgacattaaaggtgattcgtttttacatatgtctaaatttgtaagaaataatnnnnnnnnnnnnnnnnnnnnnnnnnnnnnnnnnnnnnnnnnnnnnnnnnnnnngataagatatttatatggatgaccttaacactatcattttatgaacgtttactttttaaatagatattaggnnnnnnnnnnnnnnnnnnncaaaatatgttaggaaatagtttca

SEQ ID NO: 14357 - DNA, 269 bp, Diabrotica virgifera
  misc_feature (4)..(72): n is a, c, g, or t
  misc_feature (80)..(121): n is a, c, g, or t
  misc_feature (123)..(186): n is a, c, g, or t
  misc_feature (188)..(237): n is a, c, g, or t
  misc_feature (239)..(268): n is a, c, g, or t
acgnnnnnnnnnnnnnnnnnnnnnnnnnnnnnnnnnnnnnnnnnnnnnnnnnnnnnnnnnnnnnnnnnnnnntttttagnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnngnnnnnnnnnnnnnnnnnnnnnnnnnnnnnnc

SEQ ID NO: 14358 - DNA, 222 bp, Diabrotica virgifera
gtaaaattgaaaaagggggagacaaagggaacggggcaccacaaaggagagacaggcaaggaagacaggagggggatgaccggagaggagtaggtaaagaacaactacaacaggggaacaagacgaaaagaaccaagtacaccaataagcaggagcgtaaagagactgacgtttgaaggaaacgggcagaatgatcaaaggccaagccagggccaaaaaaca

SEQ ID NO: 14359 - DNA, 433 bp, Diabrotica virgifera
  misc_feature (4)..(383): n is a, c, g, or t
  misc_feature (393)..(432): n is a, c, g, or t
agtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatgatannnnnnnnnnnnnnnnnnnnnnnnnnnnnnnnnnnnnnnna

SEQ ID NO: 14360 - DNA, 441 bp, Diabrotica virgifera
gtacaaagatcccgtggtaacagataacagaaaaaatgataagaaattccattagcgtttttaagagtgtgtttctatctattgtgcgacgaaaattaaaataaacaagttcgaaaaatgtaaaaatacaaggtcagacggtaaccttaaaggtaaccacttttataagatttccatggtcaaaatgtgataaaccacatcgtatggaggtattccgcagtttaattcgacgttaatatgaataggtgtgtttacttgaatagggtgttttgataattcgggcatgatccctatggatgtggaataataatggaagtatgtgtgaacgtccttaagcacgaacagccagaaaaactacacatccagttaacacattataagcaaaaatggaattgggactgtggtgtgtcctgtgttttgatggttctgtcgaagaagaag

SEQ ID NO: 14361 - DNA, 310 bp, Diabrotica virgifera
gttatagtcctcgcgcgattttgattgtaacttcttcttcttgcagtaccgtctcctctcggaggttggctaccatcacagcaatcttaactttgttggctgttgattgtaacgaaaacatgtaaattattgaaattagtaatattaatagttatttatgtattaagagcgaaaagtgatagatacattattgcttgagagtaagagttaccgctcgacgcgtagcggagttactctaaagcaataatgtcactttgcgcttgtaatacatacaacattttttctacaatcacttaataaaatcaaacta

SEQ ID NO: 14362 - DNA, 404 bp, Diabrotica virgifera
aaaacagaaagaaaagatatctcaagttaaacaagccaaacagcgaacattacaatcaagggaaatcaaacgaaaaataaaagcttctatcataaaagttcctgataatataaatgatgattttctggataaaactgtagaaaatttagttattacacaaaccagtgataatattgacgaatcaaaacacaaaaaacgcaaattaggaccagaatcactggaaggatttacggttctaggtgcagaaaatgttgcaaataaagttaaagtaaaaagagttcttccatcatggttatcaaatccaacagttatatcagtaaacttacaagacctacaaaccaaattttcggatcaaaaacatttagacaagggaattcgtaaattacccaaagcaaataatatac

SEQ ID NO: 14363 - DNA, 150 bp, Diabrotica virgifera
  misc_feature (56)..(89): n is a, c, g, or t
  misc_feature (98)..(116): n is a, c, g, or t
atttttaaatcttttgagaaatgagtaattccaataaataaagttatctacctcgnnnnnnnnnnnnnnnnnnnnnnnnnnnnnnnnnncacaagacnnnnnnnnnnnnnnnnnnncaacacagtaaatgggccgaaccacaggggggat

SEQ ID NO: 14364 - DNA, 322 bp, Diabrotica virgifera
tcatcagcccacgcgtgcgggagaggatcaatccttatctgctcatgcatacaatatcaaattgcttgaagaatgtcattcagattcagatcacgggccgtcgatatcagcagtctttaacgatttctttactgccaattaatcctgatgtccaccttgcagccacatcggacatttctttcttgggcatatggacattgaggcacacaatcatcacgtgtcgtcctcattacacattatgcatgacaaacgtcacgcgccctgtgcccgcgctgtagacgctgcagttattgagagaccttggacactaaaaggggaaatt

SEQ ID NO: 14365 - DNA, 807 bp, Diabrotica virgifera
  misc_feature (5)..(25): n is a, c, g, or t
  misc_feature (535)..(566): n is a, c, g, or t
  misc_feature (692)..(799): n is a, c, g, or t
attannnnnnnnnnnnnnnnnnnnnggctacaaggatgatcaaacaccagtagatcaaagtaccaaaacaaaacagactaaaccgaaacagaataattctcaggacaatctgttaacaaaggacaaaagaactgtgtcccatgctgtacaaggggcaaaaaagaccgacgcagtaactaaaccagaagagcccaagcctttgttccctgccaatgatccatttaactttaagaaaaatgcagaagaagcccaaaaggcgttcaaagagaagggacttggaggttggattgctacagtgcaaaaaaatgttcaggagaccctaaatgctctaataaaaggaggcgaaggaaaaaaattagtcgaagcaattatcgagtgggttaagaatttaataaaaaccgttcaggaaaaaggactgcctgcagtcacgaagcaagtagaagccaaactgaaagaaatcctagcccgggcaatcgtagaaaacaacaaatggccaatgaaagcacttacgcagaaataaaatatataagcattnnnnnnnnnnnnnnnnnnnnnnnnnnnnnnnncgttaatatcttaattaaacactatgtattttagacatatctacattttctatacagttaagcgtcatagtgcgtactcgcatatgtaataaatagtactcctaatatattttgttcttgagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctaaa

SEQ ID NO: 14366 - DNA, 180 bp, Diabrotica virgifera
  misc_feature (10)..(74): n is a, c, g, or t
  misc_feature (77)..(93): n is a, c, g, or t
  misc_feature (101)..(113): n is a, c, g, or t
  misc_feature (115)..(168): n is a, c, g, or t
gctggaatgnnnnnnnnnnnnnnnnnnnnnnnnnnnnnnnnnnnnnnnnnnnnnnnnnnnnnnnnnnnnnnnnngcnnnnnnnnnnnnnnnnncgagagcnnnnnnnnnnnnnannnnnnnnnnnnnnnnnnnnnnnnnnnnnnnnnnnnnnnnnnnnnnnnnnnnnnggggtgataaaa

SEQ ID NO: 14367 - DNA, 160 bp, Diabrotica virgifera
  misc_feature (2)..(150): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttttt

SEQ ID NO: 14368 - DNA, 333 bp, Diabrotica virgifera; identical to SEQ ID NO: 12194
  misc_feature (6)..(28): n is a, c, g, or t
  misc_feature (219)..(292): n is a, c, g, or t
  misc_feature (297)..(331): n is a, c, g, or t

SEQ ID NO: 14369 - DNA, 897 bp, Diabrotica virgifera
  misc_feature (6)..(27): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(843): n is a, c, g, or t
  misc_feature (852)..(896): n is a, c, g, or t
tcgtannnnnnnnnnnnnnnnnnnnnnggatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatcccnnnnnnnnnnnnnnnnnnnnnnnnnnnnnnnnnnnnnnnnnnnnnt

SEQ ID NO: 14370 - DNA, 943 bp, Diabrotica virgifera
  misc_feature (859)..(859): n is a, c, g, or t
gtatgtagaaaaacggttccaagatgataatgaactaaatgctcaatttttggaacttgttaattatgtctataccgacaaacaattaaaggcaaccgaacttacttctaaactagaaccagcgtttttggctgggttaaggtgtactcagccgcacattagagcaaagttttttaaagttttcgatgaagctatgcccagacgacttcacgataggcttctctacatcatttgttctcaaaattgggacgcaatcggtccacattattggattaagcaatgcattgaactcttgcttgttacagctgcgccaggcgatggtattagaatgtctcacgaaagtagtatattacctgctataacgtctgttataccagaaaaacaaaaacgcgaagaattcagcagacaccagctccaaaatccggacttctatacctccgaaattaaagaggaagtgctggatgtcgacttaagtaacatagattcgaatcctttggtagaagaaaagcctgttataagagaagagacaataaaaatgttgaaaaaggactacgaatccacagaaattgctagaaatattactactgacagattcttattagctacgtcacagttgtgccacatggacacatcattagctgagcatggtgtggttgtcattatttccaaaattatgggccattctcgagccggaacaaagaacgactttggaaaaagacattataccattcattacatctgggacacacataatacagaaagattgtcatcctagtgcaattaatacttttgttgaggcgttatacagatgtaccaaccatatacagatggcgccattcctaatgacttacctaggaanatctcataatctgtggcaccgaatggctcttggtcttgaacaaatggcgtatgaagatgtctgtgcctaaatcatcaaaaccag

SEQ ID NO: 14371 - DNA, 188 bp, Diabrotica virgifera
  misc_feature (13)..(98): n is a, c, g, or t
  misc_feature (101)..(180): n is a, c, g, or t
ggaatggaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnnnnnnnnnnnnnnnnnnnnnnnnnnnnnnnnnnnnnnnnnnnnnnnnnnnnnggtgatta

SEQ ID NO: 14372 - DNA, 849 bp, Diabrotica virgifera
  misc_feature (693)..(694): n is a, c, g, or t
  misc_feature (733)..(733): n is a, c, g, or t
gtgatctctaatgctagaacaaattgcggaattcttaagatcgcaaacaaaatgtttaacaaacaatggcaatgttgttgaaaaaagtttgaaaaacctcaagccagatttagattttattatgacccctttacgtaaatctacaactactcccattagacctgttaaatcaaaatcctgtacgaaagttcctgttttacctgataaaaaatttaatctattaagaacctcttctcaagaaactgaaaattctcagaatacttcatcatcaaacgaatattttaaattacctcctatattagtacctatcataaacaaaatggaagaaaaatcttcagatcaaggaaaaccaggtagccttaccagtgttggccccaatatagacagctctgtcagttcagtggctagtagtagtgaagttgatgctgctgaaacaacatgttcatgtatttctaaagaatctgattcagataatgaatcagaatgtgatgttgatattatggcagaagaactaatgaagaaaattccgcgagatgattctttagtaaaatctactgacgttgaagaatgtagaataaaaaattgtggatccgccgatacttcaagcgttctatctggagtaacaactctctcaaatatttcgaacccgagtaattctagtggagagaatctgagcaagacttttacaagaanntattagaagtgctgtgcacagtaaaacaatacctactanatgtctttctagagcagttactgccaagactaagaaacagagctctcccgctttgccaaagatagagaaacaggtggtgataccttatagagatctgtggagacatttaaatgttt

SEQ ID NO: 14373 - DNA, 453 bp, Diabrotica virgifera
  misc_feature (95)..(116): n is a, c, g, or t
  misc_feature (385)..(413): n is a, c, g, or t
cagaaccaagatttggtgttggggttggtgtagtcgcagacagtgaaacaaatcagtagaatcaatccaactgaacgctcaacgtcttaaagaannnnnnnnnnnnnnnnnnnnnntccccatccacgaaaagaagaagattagagctggtgaagccactgaagaagaacgtagaatagcttcacaattacagggagaagttctccctatcaaacagtcaagtctcagaacaaaggctagagttccaactgaggaggaaaagaaatttgaagcatatgtaacattgaggaaggcccgtgccgatgcaagacttgtaggtatccgtgctaagagaattaaggatgctgcagaaaacccagaggatgtgacaaaagctgctgcaggnnnnnnnnnnnnnnnnnnnnnnnnnnnnnatgtataatttttatataagataataaaggatttgttacc

SEQ ID NO: 14374 - DNA, 102 bp, Diabrotica virgifera
  misc_feature (45)..(63): n is a, c, g, or t
cccttagggataacaaggggaattttttttgggagagtttcaaannnnnnnnnnnnnnnnnnngaccccccatgggtgggattaaaggtttataatttgggg

SEQ ID NO: 14375 - DNA, 1143 bp, Diabrotica virgifera
  misc_feature (95)..(118): n is a, c, g, or t
  misc_feature (739)..(773): n is a, c, g, or t
  misc_feature (981)..(1000): n is a, c, g, or t
  misc_feature (1105)..(1131): n is a, c, g, or t
gttcgctgttcgctatctacagtgcgttctggaattgagtattgcggtcacggtgataatacagcgagcttgaactgtgcgaatcgactattatnnnnnnnnnnnnnnnnnnnnnnnncttttttatgtaaatcgtttgttcatttaaaagtaactagtgttattagatatagtatattctaaaaatagagaaacatggaatactttaagaaaatatctataactggacgacgaaatcatttttaaatttcacaatggcccaatttaatagatggtcggtgttaaaacttttcgaagttattttggtgctagcatgtttagttttcaaacgcgtaacagacgatgaagcttcaagagtgtttctgtatctacaaaaaatatccagagaatggagtctgttaaacaatataacttggagtagagtcggtgctgcagtcgcagatgttacttatggaggttacttaataatcactggtgccttatttttgggtcacatcgttgaggaactgccaaccacgagaagaataactgaatatatattactagggataggaactatattgttcgtagtaatgggtagtctttccttcgctgcattagactccgttcctccaagtctggtagacaacgcagctatagtaggaacgctatctctggtagttgcaggtctcttccttcttgatatgggcggcccaaagaaacgaccgcctagatctcaacaacccaaacaaaagaagannnnnnnnnnnnnnnnnnnnnnnnnnnnnnnnnnngttattgagacagaaagatataaggacgcagcgaagacggaccagaaggaaagtacaaaacctgaggagatacaatttaaaaagatagaaaagggtgtgaaaactgaaaaggacaaaaaatgaaagtaatggaattaactgctatttgaaatgcaaaataccaaatagtttctaataaaggttacccaaaaaattgagggaaggactnnnnnnnnnnnnnnnnnnnntatccgggcaagaacccctttgattgaaggaacccacaaaaactggaaaaaatgggaaaatacccccccccttgggggggtgggcatttcccccagctttgggannnnnnnnnnnnnnnnnnnnnnnnnnntattgggaaaaa

SEQ ID NO: 14376 - DNA, 928 bp, Diabrotica virgifera
  misc_feature (750)..(750): n is a, c, g, or t
  misc_feature (835)..(835): n is a, c, g, or t
cagatgtgtggtatgcacatcgtcgtacacgctgatgagttgcaagatttgattaattattatcaagatagaggatactttgaagaattaatcggcctattggaagcagcattgggcttggaaagggcacacatgggtatgttcaccgaattagcaattttgtattccaaatacaagcccgccaaaatgcgcgaacatctggaactcttctggtctcgagtgaatatccccaaagttcttagggcagctgaacaagcacatttgtgggcagagttagtgtttttgtatgacaaatatgaagaatatgataacgctgtgttagccatgatggctcatcccaccgaagcttggcgcgaaggtcatttcaaggatattattacaaaagttgccaatatcgaactttattatagagctattcaattttacttggattacaaaccgctgttgttaaatgaccttttgttggtgttggcacccaggatggatcatactagggctgtttctttctttacaaaaacaggacacttacagttggttaaatcctatctccggtctgtgcaaaatttgaacaacaaagctatcaacgaggccctcaactctctacttatcgaagaagaagacttccagggtctgagaacgtccatcgacgccttcgataacttcgacaacatcggcttggctcagaaattggagaagcacgaactgacggagttcagacgcatcgccgcctacttgtacaaaggcaacaanccggtggaagcagagcgtagaactgtgcaaaaaggatagactatttagagacgctatggagtacacttctgaatctagaaatcangaaattgccgaaagagtgctggcatgggtcttggataggaaggcctatgattgtttttcggcatgtttgtatccctgctacgacttgttacgg

SEQ ID NO: 14377 - DNA, 408 bp, Diabrotica virgifera
  misc_feature (5)..(78): n is a, c, g, or t
  misc_feature (80)..(162): n is a, c, g, or t
  misc_feature (233)..(254): n is a, c, g, or t
  misc_feature (261)..(278): n is a, c, g, or t
  misc_feature (287)..(304): n is a, c, g, or t
acccnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnttaggggataaaggcaaatttttttgggaaattcaaaacccgaaaaaaagattggggccccccgtgggggnnnnnnnnnnnnnnnnnnnnnnagacggnnnnnnnnnnnnnnnnnngtttgttcnnnnnnnnnnnnnnnnnnaaggatatttgggcagttttatcccccgggggggggaagtcacccacttggtggcttcttcctacttcctcttttctctacttctatcactgattcatcatttt

SEQ ID NO: 14378 - DNA, 832 bp, Diabrotica virgifera
gtctaaatataaaatttaaacacaaaattttaaaatgctcaattttacaaacaaaatagtaacgagaaccttactattctcataccgaccgaatttagtaaagaatggattcaaaaattttacaaccagcacatctagaaacattaaaaggggtactttcagacttggacttacaggtattacagtaggagctctggtgggtaccggctactctattcattatatgaataagcctcgagcacatatattaaatgaagaaatcacaatagctcaagtgaaggagatgccatccatgaaacctactagatttgtaaaaaatgttggagatatgggattagaattaacactgtaccaataccaaacatgtccgttctgctgtaaagtaagggcctttttggattattatggtatttcatacaatttgattgaagttgatcctgtgttaagacaagcaataaaatggtcgccttatagaaaagtccctattttagtggttaaaacagatgatggatatcagccattaattgacagtactatgatagtatcagcattggcatcatacttatttgaagataacaaaaaagacttacctgaaatagtaaagtgttttccaaacgttagttatgtagatgatgatggattaaagaagaatgaaattatgaatagatattttattatgttgaataacaggaaggatttacaagcaattgaacagaaaagcagcgaagaaagaaaaatggcgtaaatgggctgacagtgtacttgttcatacattatcgcctaacgtatatagaaccagcgaagaagctcttcaatcatttcactggttttc

SEQ ID NO: 14379 - DNA, 819 bp, Diabrotica virgifera
  misc_feature (18)..(60): n is a, c, g, or t
  misc_feature (74)..(110): n is a, c, g, or t
  misc_feature (117)..(176): n is a, c, g, or t
  misc_feature (194)..(206): n is a, c, g, or t
  misc_feature (208)..(362): n is a, c, g, or t
  misc_feature (364)..(443): n is a, c, g, or t
  misc_feature (445)..(477): n is a, c, g, or t
  misc_feature (492)..(513): n is a, c, g, or t
  misc_feature (515)..(549): n is a, c, g, or t
  misc_feature (551)..(565): n is a, c, g, or t
  misc_feature (605)..(656): n is a, c, g, or t
  misc_feature (658)..(682): n is a, c, g, or t
  misc_feature (755)..(782): n is a, c, g, or t
gaggtaattagtattggnnnnnnnnnnnnnnnnnnnnnnnnnnnnnnnnnnnnnnnnnnnaccttggggatccnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnaatgagatggtattcgcnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnngattagaaacttggnnnnnnnnnnnnnnnnnnnnnngnnnnnnnnnnnnnnnnnnnnnnnnnnnnnnnnnnngnnnnnnnnnnnnnnnctttttgaattaaatataaagactcgcccgccccctgacnnnnnnnnnnnnnnnnnnnnnnnnnnnnnnnnnnnnnnnnnnnnnnnnnnnncnnnnnnnnnnnnnnnnnnnnnnnnnggttggatggaaaaaacacctggccttattttcattttatcaacaattttcttttttaaagcttaaaaagccnnnnnnnnnnnnnnnnnnnnnnnnnnnnatccccctaaggaagctttactaaactctctttagta

SEQ ID NO: 14380 - DNA, 338 bp, Diabrotica virgifera
  misc_feature (11)..(33): n is a, c, g, or t
  misc_feature (224)..(297): n is a, c, g, or t
  misc_feature (302)..(336): n is a, c, g, or t
ccctttcgtannnnnnnnnnnnnnnnnnnnnnngatagaaaccaacctggctcaccccggtttaaactcaaatcatgtaaaattttaaaagtcgaacagacttaataatatagctgctacaccaattataaactttaatccaacatcgaggtcgcaatctttattatcgatttgaactctccaataaaattacgctgttatccctaaggaaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnct

SEQ ID NO: 14381 - DNA, 212 bp, Diabrotica virgifera
cctttagggataacagcgtaatttttattggaaaactccaatccataataaaaaattgccaccccccatggtggaattaaaggtttataatttgggggaagcaagcttaatttaattaaggctggttcccatcttttaaaaatttttccttggttctcgaggttaaaccccgcggggggacatcccgggtggggtttcttctttcttttctt

SEQ ID NO: 14382 - DNA, 221 bp, Diabrotica virgifera
  misc_feature (34)..(53): n is a, c, g, or t
gtaatggtgataatattaagatataaaaattggnnnnnnnnnnnnnnnnnnnncgcttaataaaggaaatccgccacattttttttccctggtttttaaaaacatggcttttttggaataaatataaaggcccgcctggccccatgattattttgaatgggcggggtaattttggccgggcctagggaaccataatcttttagtcttttttatttcaaacc

SEQ ID NO: 14383 - DNA, 660 bp, Diabrotica virgifera
tttcacgcgcgccgccccgagaccgcggaaacgaaagaccctttgaccgaaggaacgacagcaacacccaaacgacgagaaagcagggacaagacgacagaaacgagaagaggagggcgagcccagagaacgcgagcgatgaccacaggatagacagaaaccacgacagcggcgacaagcaacacaaaaccggcaaacaaaaggcacccgtggaccgccaaagcaaaagagaggggactacaccagacagaaacagcgaggagcgaaagggagcgacaaaagggagagaccaagggagaagagagaacagagaaacgctacgaaaaagaacacaaagaggacagcgagagcgcacagagacaaggaaaccgcctggattactttttaccttatagttgtttcctcatccagattagcgttatatcaattcgaggggggttgccctcgactccacgccactgaaaatctactgtcagtaagatttccagggtggaaaatgcccttgaggcagttcttcctacttttgtgactgtgctttcgttgtactgcgtcaccaagcgttgaaagtcacgtgctgcctaaatggttagatggagaataagtcacgcgtcaaaaaagagtatcgttgtgacgaggattccctgaccataatgttggcct

SEQ ID NO: 14384 - DNA, 813 bp, Diabrotica virgifera
tgaagtgaaagattgctaaggtgaaattgaatcggttacgggggactgtacaattgtcggttttagtgttaaacatttttgagaaaaaatggccagtttttgggccgtttttgtttttggagttgcattcacacttacagagcactgccacggagctcagtacttcggaaaactcataggaaaactttcggaattacaccacggcgtctccggagaagtttacgcagtagatgcgaggactttgtacatcaaggatttcacttatgacggacaaggacccgccgcttatttttacgccagcgtccacaaagcggctgacaaacacggtttccggttgagagatgagacgggaagcggagaagtaatcaggaggtacaggaaggagggaatcactctcacgctgccagaaggaaagaccatacacagcatcaagatattttatctttggtgcgaggaatttgacgttaactttggtgatgttaaagttcctcgtggttttgactatccacgaccacaaaaaattgaatctctcaaaggtgtccacgcaatttcgtcagacaacatcgtcatcgtggatgcccagacgctgttgattccaaacttgtcttatgatggcgaagcaccagatgccaaattctcgggttggtcgtggcagcaaacctactccacaaggtatccgagtccctgacgagaatggcaaagaagtgccccttagaagatatgacagaaagacagtggtacttacacttccaggcgatttgacagtttttgacattggacattttggaatctggtgcgagatgtttactgttg

SEQ ID NO: 14385 - DNA, 952 bp, Diabrotica virgifera
  misc_feature (689)..(709): n is a, c, g, or t
  misc_feature (772)..(794): n is a, c, g, or t
  misc_feature (849)..(849): n is a, c, g, or t
gtaatgtagctctatacttcgttcattctcaagataagctcaggatctcacccagcggtgggtgtgtcgcaggggcggctcgtgatagtagaaggtggtgaggcacactacacctgaggaattttattattatggttagcttatctttaatgaccggaaggtcgattttgtgacatcataacgctaggacgaagctaggacaaataatcccggacaagaaatccccacaaattattcctcgacaaaaaatctccagacaaataatccccggataaataatccccggacaaataatccccggacaggaaatccccacaaaaatccccgtacaaaaataatccccggacaaaaaatcctggacaaataatttccacaaatattttagataaaatatccccacaaaaaattccggacaaaaaatcctcaagaaatatttgctgcccattagttctctaaaagttttcccgtgaatgcgatcgactcaaatgttttcagcctcagtgcatagagttattttgaattccaattccatatcgaaaactttcaaattttacataacaaaacagtggtgagttttttcaaaaatcgtggaagatataaggaatgagctaaggctgtgggaatcatgttgcaatattatttgcttaaatcttttgcttactctgatttgaataactatgttcaaaacnnnnnnnnnnnnnnnnnnnnnccacaacatacaacacattttgaaacacttaaaaactagttttgtatgtagatgtaacaaatnnnnnnnnnnnnnnnnnnnnnnngttatgaattttacaaaaacaaaacacaaacacaaaatacacactgtaggtcggntcagttcggctattaatattccgttccgcggaaccttaagtaataagggaagcaaggtcaagtaacttcgtaactaaaaacacacgtgtttgaggccggcctc

SEQ ID NO: 14386 - DNA, 666 bp, Diabrotica virgifera
  misc_feature (609)..(631): n is a, c, g, or t
agttcgcagtccctacgattcgaagatgatcgaccttgtgcgcgtcctcgggcagctgatatagcaactcggggaatacggagagtagataagttacagcgctccggtgttcgcatcaggcgtggaagagaatatgccacgggaactgcgcatccatgacctcaacatgcttctacgggaatcgggcccattgtccggagactaggatacgtacaaattcctaaacgaaagtctgacatcccaattaccacacaagctagtccctgtggttccaacagaggtacgttacagtaatcgttttcaatctgaggacgaagtccacaaaagatgactagatcccatcgtcccatctctacaacgagacgatgataacaaatcgctcgaactataggtaaagcaaccagagcccgtatcgcatgttagtataccaatacatggtgcatctcatggcaagataacagaagcataacttcgtaagatagatgaaaaataaggcagaacgtggataagaaccgcaccgcacccgaaacagttccaacgaagctcaccatgctcggcgaaactcattataggggataaggcgctctgagtggcttctatcgttatacnnnnnnnnnnnnnnnnnnnnnnnacatatgtaaatgatgagattaatgacagtctcat

SEQ ID NO: 14387 - DNA, 125 bp, Diabrotica virgifera
  misc_feature (2)..(28): n is a, c, g, or t
  misc_feature (52)..(78): n is a, c, g, or t
  misc_feature (82)..(123): n is a, c, g, or t
cnnnnnnnnnnnnnnnnnnnnnnnnnnncagaatcttatttttacgttaacnnnnnnnnnnnnnnnnnnnnnnnnnnngacnnnnnnnnnnnnnnnnnnnnnnnnnnnnnnnnnnnnnnnnnncc

SEQ ID NO: 14388 - DNA, 672 bp, Diabrotica virgifera
  misc_feature (23)..(40): n is a, c, g, or t
catttttctatattattacttcnnnnnnnnnnnnnnnnnnatgttcactccataaaaagcgattgtagatgtggcaacactgtggatgtatataaaattgcatatcttaatccgtgcgtttataataaattttgatctgaattttatagtgaagtattctattttttacagtcgaatctgggggcaatacttaatctgtttcaacaaaatgtttattgcagatacgtgcatttattctctgcacatatttatcccttcttattgctacaatccacttttttcccatcagaatatctttgagaaacctgtgtcctgatgttctcgatgagcacaaatgcacagcacaacattgagggattttattttctcaagtttaattcacacagcgaaacaaatatgcaatatttacttggaaatagattgatttgaagtattgacgtaagttgacatgacctccaactacacgagcgccacctacgttgagctttccagattagctgccattgtaggaaaataccccaatctggcaaccctgactatcactatctatttgtttgtttacgaaagatggcgattatcttccctctttcccctgggtattgctctcctcatccttgtcgcatttaaattctcttcatgccccattgcattcccgtgttgacaagtttatat

SEQ ID NO: 14389 - DNA, 335 bp, Diabrotica virgifera
cattccgcgtccggatggtggtgtggttattgctggttcttttaattgaaaattgctaatgaattgctgaatgactaataccacttgcttacacccacaacagcaccaataatactctaaaaattttaaattctatttaaatgatttagaaaatgaagtttatcattataacattactgctggtattagttttttcgagttgtaatgggttgaatggcacaatccctacaattttgagaggagcatggttctcatgggagttaggcagaaatactttaacagaattagatgctacatcaatgactgatagaggaacctgcatagatgttaaaaat

SEQ ID NO: 14390 - DNA, 231 bp, Diabrotica virgifera
  misc_feature (22)..(94): n is a, c, g, or t
  misc_feature (96)..(158): n is a, c, g, or t
  misc_feature (163)..(199): n is a, c, g, or t
cgagaagaacccttatagaagnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnngaatnnnnnnnnnnnnnnnnnnnnnnnnnnnnnnnnnnnnnccttaagggaaataaacggggaaatttttttt

SEQ ID NO: 14391 - DNA, 185 bp, Diabrotica virgifera
ttttttttttgttagaaagtgttataaaactttattaattagaaataaaaaattagttacaccatggataatcgtcacgtttgtatgacgtcaaaggtagatcatacataaacggaaacaatcgcttattcttgttattgtcagcagtactaatctcaaaatattcttcatcaaagaatggtggt

SEQ ID NO: 14392 - DNA, 790 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (162)..(193): n is a, c, g, or t
  misc_feature (200)..(238): n is a, c, g, or t
  misc_feature (282)..(315): n is a, c, g, or t
  misc_feature (378)..(395): n is a, c, g, or t
  misc_feature (522)..(543): n is a, c, g, or t
  misc_feature (651)..(675): n is a, c, g, or t
  misc_feature (754)..(788): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttacaattttacatgatctgagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnaatttccctatgaactgggacttatcaaaataaagctaccccgnnnnnnnnnnnnnnnnnnnnnnnnnnnnnnnnnngacacgggggcggccgccttaaaaaggatccaacttttaccttccgcggggattggcaccgcnnnnnnnnnnnnnnnnnnggggccccaataattctaattccccgggccccgcctttttaccacctgcggggccgggaaaaaaacccgggggggtccccaaatttatacgccctttgggacacattccccccttttgccccccggnnnnnnnnnnnnnnnnnnnnnncccccgccccaacaccccccccttccccacccttgttgggacccctcccagaaagggtgaaaaggggggagccgggccccctgtttagggggcggctataaaatcgcnnnnnnnnnnnnnnnnnnnnnnnnnataaaattaaacacgaatgacttccctatcacatatttctctcttccccacgcagctcctcatccgacctccctctctnnnnnnnnnnnnnnnnnnnnnnnnnnnnnnnnnnnct

SEQ ID NO: 14393 - DNA, 856 bp, Diabrotica virgifera
  misc_feature (551)..(568): n is a, c, g, or t
catttttaacatcatgtcttaagctcttattgattcctgcctacaggtccacagatttcgaagttcacagaaactggttgtctataacacacagtctaccagtcaagaagtggtactttgaagacacttcgcaatggaccttagactatccaccactttttgcttggttcgaatatattttgtcgtttcctgcttacctgtttgattcaaaaatgctcaatgttaaccatttgaattattcttcagaaaaggctgttctattccaaagactctcagttattattactgatttagtgtactcattaggtgtttatatgtgttgttgctctgtgaaaaaaagttggggcaaagaagtagttttgccaatacttttgatcacaaattgtggtcttttgatggtggaccatatacactttcagtacaatgggataatgtatggaatattattaatttcaattgcttatatgattcaggagaaatatcttcagtctgccttctggttcactattttgctaaatatgaaacacatctacatatatttagcaccagcnnnnnnnnnnnnnnnnnnaagacactactgcctgaaaggaccattggttatccgtaatattttcagtcggaaaaatttgaaaaatgtgggaatgctaggatgtacagtcttggggatatttgtggtaacctttttaccattttatgatcaaatacctcaggttctgtcaagattgtttccattcaaaagaggtctgtgtcatgcctactgggccccaaatttatgggccttgtataacactgttgataaagttggatttgttttagcctcaaagctccacaaaaacctgggccaagaatgacacag

SEQ ID NO: 14394 - DNA, 557 bp, Diabrotica virgifera
  misc_feature (14)..(34): n is a, c, g, or t
  misc_feature (45)..(147): n is a, c, g, or t
  misc_feature (149)..(256): n is a, c, g, or t
  misc_feature (258)..(272): n is a, c, g, or t
  misc_feature (274)..(289): n is a, c, g, or t
  misc_feature (291)..(383): n is a, c, g, or t
  misc_feature (423)..(440): n is a, c, g, or t
  misc_feature (470)..(496): n is a, c, g, or t
  misc_feature (501)..(522): n is a, c, g, or t
ccccttccgccccnnnnnnnnnnnnnnnnnnnnngagtaaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaatcaaattttattcagatttcatcttcaaatacnnnnnnnnnnnnnnnnnnctcctattttaaaatatgcctattccttcnnnnnnnnnnnnnnnnnnnnnnnnnnncccannnnnnnnnnnnnnnnnnnnnnctatatcatcagcatttcccacggatgatcatccc

SEQ ID NO: 14395 - DNA, 64 bp, Diabrotica virgifera
  misc_feature (12)..(32): n is a, c, g, or t
catttttttacnnnnnnnnnnnnnnnnnnnnncgtttatacattattactacgtttttttagta

SEQ ID NO: 14396 - DNA, 663 bp, Diabrotica virgifera
  misc_feature (2)..(47): n is a, c, g, or t
  misc_feature (54)..(109): n is a, c, g, or t
  misc_feature (125)..(354): n is a, c, g, or t
  misc_feature (356)..(374): n is a, c, g, or t
  misc_feature (393)..(409): n is a, c, g, or t
  misc_feature (411)..(423): n is a, c, g, or t
  misc_feature (425)..(453): n is a, c, g, or t
  misc_feature (455)..(481): n is a, c, g, or t
  misc_feature (491)..(510): n is a, c, g, or t
  misc_feature (512)..(586): n is a, c, g, or t
  misc_feature (590)..(617): n is a, c, g, or t
  misc_feature (632)..(661): n is a, c, g, or t
cnnnnnnnnnnnnnnnnnnnnnnnnnnnnnnnnnnnnnnnnnnnnnncaaaacnnnnnnnnnnnnnnnnnnnnnnnnnnnnnnnnnnnnnnnnnnnnnnnnnnnnnnnnctgcaatgctattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnncaattatttacatttagcnnnnnnnnnnnnnnnnncnnnnnnnnnnnnncnnnnnnnnnnnnnnnnnnnnnnnnnnnnncnnnnnnnnnnnnnnnnnnnnnnnnnnncgctattacnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnncagnnnnnnnnnnnnnnnnnnnnnnnnnnnnctggaaaaacaaagnnnnnnnnnnnnnnnnnnnnnnnnnnnnnnta

SEQ ID NO: 14397 - DNA, 888 bp, Diabrotica virgifera
  misc_feature (426)..(443): n is a, c, g, or t
  misc_feature (841)..(841): n is a, c, g, or t
  misc_feature (857)..(857): n is a, c, g, or t
gaagagagtggttggtagaaaaagttggtagaaatgaaaatagcaattattggaggaggagctgcgggcttagctgctctaaaacacagtctagacgagcattatgagtgcgaactttttgaacaaactggcttgataggtggtacctggaattataatgaaaaaattggaattgatgaaaatggactacccattcactcttccatgtatgatggacttagaaccaatttgcccaaagagctgatgcaattagaagactttccattttcaaaaccagactattcttacttatcgcaacctcaggttctacaatatattaaagattatgcaagtcattttaacttactatctcatgttcagctttttaaacatgtaatcaaagtcactcccctcgaaagggggaagtggtcagtggaaatcaaggannnnnnnnnnnnnnnnnncgaaacaaagacatttgacgccatttttgtctgtattggaaattattctactcctttcataccaaaatttccaggcactgaaaactttcaaggaacgatcattcatagccatgattataggaaaccggatcggtacaaaaatcgaaaagtactcattgttggtaagggtccttcaggaattgatattgctagaattattagtaaagtatcagataatgtaacaatttgccatagaagtccacctaacacagcgttgcaaatacctgaagggattaagaaacaatttcctatccaagagtttcgtcagcattccattttattcagtgacgggtcagaacaaaacatagacgatgtgatattgtgcacaggttatttacacaactacccctttctgtcancagaatgcgaaattanagtagagaataagtgggtaaaatatttatac

SEQ ID NO: 14398 - DNA, 565 bp, Diabrotica virgifera
  misc_feature (493)..(528): n is a, c, g, or t
ttctcatgttcgaagtatatttgaaatccacctcaatccttgggaggtatggggagtgttgtgagattcattatggttttttgatcaaaataaatgtataaatgccggaatcgagcatagtaagagagagaatagatagaatgagtagataccccgtcataggtacatactagagctaaatcaataaaaatactaatagtagagcgaaagtgtgaaatagattgattagtaagaaggagtgtcatggtcttccattaaaaccactctatctcaatggaaagcgaaaattgattatagagatgactactactcatgtgtaaagtataattatcaatagatatataaaatacgaatagcagagcgacgaggatgaaaaattcgaccggtgtctgactattaagtacaggcaatgaaggtcctaagagacatttacatattgtcaaatctgctgagaccaatggagtgatcgttttcacgataccttgtattacannnnnnnnnnnnnnnnnnnnnnnnnnnnnnnnnnnngacatttcgattagctccgacgatgagaagagaagag

SEQ ID NO: 14399 - DNA, 874 bp, Diabrotica virgifera
  misc_feature (111)..(125): n is a, c, g, or t
  misc_feature (127)..(139): n is a, c, g, or t
  misc_feature (344)..(369): n is a, c, g, or t
  misc_feature (480)..(498): n is a, c, g, or t
  misc_feature (541)..(558): n is a, c, g, or t
  misc_feature (560)..(596): n is a, c, g, or t
  misc_feature (647)..(666): n is a, c, g, or t
cggacgcgtgggttttaaagaattcaaaatacctcatttattttcgtcgctttttacagctttctaaaatttagtacaatgtgtcatacatcttaagatgattaaccaacnnnnnnnnnnnnnnncnnnnnnnnnnnnngggtttatctagttcaagattaaaaattattacattattacagataaaaaatcttatcaatgctaggagactgagtataaataacatccgataaattttactgccagattgttgaaattaaattagttacaaaattagtataaactaaatacgaaattttatttacagaaaccaaagactaatattaaattaatcaaaatgtagnnnnnnnnnnnnnnnnnnnnnnnnnngcggaagtaaatgttaaatggcttgtttacgaaaataaattctttgtttgacatttcgacctccaaatctaaagctattcagcgttaaataaggggaagaaaatttcaacnnnnnnnnnnnnnnnnnnnccaacagaatattaaaaaatcatccaacattcaaatatatgtnnnnnnnnnnnnnnnnnncnnnnnnnnnnnnnnnnnnnnnnnnnnnnnnnnnnnnncaaaataggatgagtatatattttttgcactttctacttaaaaatgattannnnnnnnnnnnnnnnnnnnacgtaaacaagttaaataatataacctaatcttaacatatcctaacttttatcaaataaactgtttcagagcagctatctctaaaatccagattgctgatctgtcacagagatggcacttgaagaggatagctccttattaccaaggacagttaaatattgtttatatgggattagtcccagttgattgtgctgatgaattacattgt

SEQ ID NO: 14400 - DNA, 830 bp, Diabrotica virgifera
  misc_feature (458)..(482): n is a, c, g, or t
cccacgcgtccgagcctaccttccgcgcttcctgacgacaagatctcatggactggtttgctgcatctctttctaacacattgtatcgaaaatctatgatgacattcagtgtgaatataggcacggaagaggaggacaactgtagcagctttactatgcgtaagagtgaaacagcactaatccaaataaaaaagatggtgtcgtcacttcgctctgaaagatactctctctatgctaatatataactctatggttttaaatactgaatttacgttttttaatgttccgtaatatgtaattataaattaatattagcgccatctacacgatatatgtgaaagtggccgaagtaagaaattaatatttcatcaatagaacgtcaaaatgattagcaaaatctttaaaaaatctattacaatttaattactttttagcgttgtaaatattaagcgataacnnnnnnnnnnnnnnnnnnnnnnnnnccggtgaaagttgaatagtaatccactaggatcgacaccagcgaagctcagagcgtatactcagttttttaataataaagagatacctttataaatgaaccatctctgatttaagtgtcttgatattagcttgcaaacttaccaatgttattgttatattttgttgtgtgatttagttttattccgaattcaggagacgtttttatgacacaactataacaatacctaattaataattgtactacattaatcatatacgtgctgtgtacatagttttaatataattactcaaaatgatgctctaagctgaattaatgttatataatatttaatacatttttcattatt

SEQ ID NO: 14401 - DNA, 550 bp, Diabrotica virgifera
  misc_feature (267)..(288): n is a, c, g, or t
  misc_feature (451)..(480): n is a, c, g, or t
gggccacggtggaaacgtttctgcttcctcttacgatacataacaacattcaacaacaaccccccggcgttaaatacacctgaggcatgcggaggaggatgttataaagttaacattgaggtttagtacgtggaggatgaggattaggtattaaaaagttataaatatataatatgggattagcgattaggagatacgtaaatgttaatagtgtaaaagagatgtaggaaatgatgattttgtagtggtaaggtattggtatttggnnnnnnnnnnnnnnnnnnnnnngagtaataaattatgtataatgagtataattataggaatacagtgatatttttttaacatgaatattaaaaagggttgaggttgtgataaaaaattgatttctattgattattgattaaaaagtaaggatgaggaattatgatagtgctaatatagaaaaagnnnnnnnnnnnnnnnnnnnnnnnnnnnnnnatagtgtggatgaatataaaaatgagattaagatttgatttatttagttttgaggatgatgataatatta

SEQ ID NO: 14402 - DNA, 959 bp, Diabrotica virgifera
  misc_feature (17)..(41): n is a, c, g, or t
  misc_feature (104)..(123): n is a, c, g, or t
  misc_feature (152)..(174): n is a, c, g, or t
  misc_feature (279)..(318): n is a, c, g, or t
  misc_feature (419)..(442): n is a, c, g, or t
  misc_feature (611)..(634): n is a, c, g, or t
  misc_feature (647)..(664): n is a, c, g, or t
  misc_feature (698)..(720): n is a, c, g, or t
taaagatattaggaacnnnnnnnnnnnnnnnnnnnnnnnnngcaggaatggtaggaacttcattaagaattttagtacgagcagaattaggaaggcccggatcnnnnnnnnnnnnnnnnnnnntttataatgttattgttacagctcatgcnnnnnnnnnnnnnnnnnnnnnnnttatacctattataattggtggttttggaaattgacttgtacccttaataattggtgctcccgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaataacctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctggtcccactgggattaaagtatttagatgattagctacttatcatgggactactattacatataagccagtaacactctgaagctttagggtttatttttt

SEQ ID NO: 14403 - DNA, 799 bp, Diabrotica virgifera
gtacgttacatgaatatttactgtttgtattacttgatgtaattgaaagtttctgcaatatccctgcgccatataccttctatgttaattaaaccaaaaccgattctatggctcccgcgtataacagtaatgtatgagtctataaccctatctgcctatacttctctcaaccaaatacggtccacctctcaagaatctttgtgcctttaaacccttcgaaccaaattatccggcctgcaatgaaattcatactatatatacatatacattaactattcactgacaatagattgtatttattaggaatataattacaattacctctatctatcttatacatagtacctgttataaattcatcgaattacgaatcaagattttactcaaactatttatgtagaaccaaatcaagatgataaatcttctcattttaatccctccatatatcaatctctaataaatctatcatatatctcctgattatgatgcattgttaattgactgctactttgtaggatattatgagatattgaaactgctgttactattaatataagcacattgaatcattcaacaaaatattgttcggtattcagctccactcgtactcatactatctctcgactagcagattcagtacacatagcttaccgagactaaataatgctaactctcctggctcactgtactgatcgatatgctaccggtatagagacagagaattttaaacaatttgagtcacccactactggattatacgttctgtcggaatgtataaaccttgaccatgatcctatta

SEQ ID NO: 14404 - DNA, 225 bp, Diabrotica virgifera
  misc_feature (4)..(25): n is a, c, g, or t
  misc_feature (29)..(65): n is a, c, g, or t
  misc_feature (72)..(93): n is a, c, g, or t
  misc_feature (95)..(134): n is a, c, g, or t
  misc_feature (137)..(176): n is a, c, g, or t
  misc_feature (183)..(224): n is a, c, g, or t
cacnnnnnnnnnnnnnnnnnnnnnncacnnnnnnnnnnnnnnnnnnnnnnnnnnnnnnnnnnnnnctaacgnnnnnnnnnnnnnnnnnnnnnncnnnnnnnnnnnnnnnnnnnnnnnnnnnnnnnnnnnnnnnncgnnnnnnnnnnnnnnnnnnnnnnnnnnnnnnnnnnnnnnnncttgccnnnnnnnnnnnnnnnnnnnnnnnnnnnnnnnnnnnnnnnnnnc

SEQ ID NO: 14405 - DNA, 916 bp, Diabrotica virgifera
  misc_feature (53)..(76): n is a, c, g, or t
  misc_feature (292)..(315): n is a, c, g, or t
  misc_feature (328)..(345): n is a, c, g, or t
  misc_feature (379)..(401): n is a, c, g, or t
  misc_feature (627)..(647): n is a, c, g, or t
  misc_feature (726)..(745): n is a, c, g, or t
  misc_feature (810)..(856): n is a, c, g, or t
caaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnncggtgtaaatttaaccttcttcccctcacattttttaggattaataggaatacctcgacg

SEQ ID NO: 14406 - DNA, 123 bp, Diabrotica virgifera
atagattggcaagatgtctcaataacaatatatttgctttttgtacttgatttccctcttctttgtccaggtctccatagcttaacaaagaagagggaaaccatgtagaaaaaattgacaaaa

SEQ ID NO: 14407 - DNA, 463 bp, Diabrotica virgifera
  misc_feature (182)..(199): n is a, c, g, or t
  misc_feature (314)..(327): n is a, c, g, or t
  misc_feature (330)..(347): n is a, c, g, or t
tgacaatcaccaacgcctagcatcttcctcacttgcagttcggtgcgcggtctgttaacaggcgattacaagaactctaccatattctttttagaaaggatgtaagaatatatacgacgtagctcgcgttgatccgattaccagtaggcagatatatctctgttatttgcgaatataaaatnnnnnnnnnnnnnnnnnngttcttggagaacatatatctataaataatgatgatgtattgaaatgttgttcgagattacagatttccaagccgtcgagtagtcaatatagtctgtacgactaacggtatattnnnnnnnnnnnnnnggnnnnnnnnnnnnnnnnnncattgttagggataagattgaaaaattaatgtgtatgtaagatttagtattgaagtgaaaggtagggagtggaatcccctcctgttctaaaatgtgcccttatgaatatttatcta

SEQ ID NO: 14408 - DNA, 619 bp, Diabrotica virgifera
  misc_feature (321)..(374): n is a, c, g, or t
cccacgcgacccattattgctagctgaagtttaattgaggtgtgcatagagtaagattgattatagaactttgctagaatggaaataattatttcatgttcaaactcttaaaggccctaataaagttggatttgtgggtttaatcatccctcttcatacacaattccaggatttaccaccgaaccaactgcatcctcttatatctaaggctatgataaagtatttttctccaaatttaaatttgataatagcttgatatccctacttaatgtatagacttttctcactatttatgttaccaaaacccttatgattcctcannnnnnnnnnnnnnnnnnnnnnnnnnnnnnnnnnnnnnnnnnnnnnnnnnnnnnacaaacagagcagatgtatccctgattaccctaacatagatacagcatgtacctccactggtgtcagcctctaatcaatgttaatataaagatgattttcgttaacattaataattcaagagatacaatactcgcctcataataatagaaaaaaagtcgctaatataatcacttttctcattatgagacaacaacctccaaccaaagcgacttccaagcacactactcacaacatctctgaaatc

SEQ ID NO: 14409 - DNA, 842 bp, Diabrotica virgifera
cttgaatgtaaacagtaattccggaacagtgttgaaataaatatgtgtttgaaagtagctggtggattattgtttttctcttttatttcaaatgctctatgccaatttacgttaccaaacaacccagtgaaggatgctctcttcttacacaacttcgtcagcagcaatctcaccttgcaggattgcgtctaccgtccggccaattctcagtgtccagataaggacgtttcgtacattttgtacaccaaaggacagaaagctgtagtggactacacgcaaacggactggttgaggcaaagcatttgggatcctcttaaagaagacatcatgctgatccacggatacgctggtggagataatgagctaccaatggtggttcttagagatgcatatatcagaaacggcagttacaacgtctggatagtagattggggaagactcggccctcctccttgttacagagccggtgtaaacaacatgaagactgtggcgaagtgtactggagaactgctgacgtctttgagaaccgctggtcttccaacagatcgattgacttgcgtggggcattctttaggttctcacgtctgtggattgatttctcgctacgtcaatttccgtattcatagaatcgtagctctggatccagccaaaccattcatccctccaggctccagactatccagtggaaacgctctggcagttcatgttcttcacaccaacgctggacattacggaggtggaggaaagggtggacatgtggatttttgtattaacggtgggagagtacaaccgtattgcgaaaatgctgatattgacattcaattgtgcagtcacgtctgggc

SEQ ID NO: 14410 - DNA, 429 bp, Diabrotica virgifera
  misc_feature (11)..(28): n is a, c, g, or t
  misc_feature (75)..(97): n is a, c, g, or t
  misc_feature (119)..(155): n is a, c, g, or t
  misc_feature (160)..(180): n is a, c, g, or t
agttttttccnnnnnnnnnnnnnnnnnnccggccctcccccgggggtcacaacccttaaaaaacgccgtttgggnnnnnnnnnnnnnnnnnnnnnnngtggggggggggagccgggccnnnnnnnnnnnnnnnnnnnnnnnnnnnnnnnnnnnnnatggnnnnnnnnnnnnnnnnnnnnngtttttgggaaagggtctgacccccctttgcccgctctcaggggggtgtgtcctctagggtcgggggccttgagtgggcgccgccccaaaattcacaacccggcgcccctggcgcccaaagagaacgggggcggcggggggaaaacaaagaaccggggaactttgggagccggaggcgcggttttatctatccccactttttgcacaaaaagggggagtgggctgcccgcaccccccgccgcccccgga

SEQ ID NO: 14411 - DNA, 851 bp, Diabrotica virgifera
  misc_feature (300)..(339): n is a, c, g, or t
  misc_feature (448)..(462): n is a, c, g, or t
tgcattttttagcttgctaatatcttgtaactttgacttctttgaatccttttgtttgtaacattcatactcttttatagtatttttaacaattaatcttattaaaagtgctacgataatatcaatactacaaaagagaattttaccgaagctatgatggagtgtgacatttggaattaagagtatagctactaacgggctgtaacgataagtgtgcctattatagggtgagttaccttctaaataatgcctcgaggcatcagtgaaaaccttatagtcaatatctgtatattttaattnnnnnnnnnnnnnnnnnnnnnnnnnnnnnnnnnnnnnnnntattctaagaattatagatattaacaaatgttttttataatgaatatttacaaacgtactccacaacgacaccattctgctaattaaattctagtttttaaactggtcnnnnnnnnnnnnnnncaagttttaaaatctacaaactcctttttacaatcattcatagcaacactgtctcttttcaaaacacatgtggcataactcgtagcttcttttctacactttgctaataggagtggatactgtcgataacgttctttggctcgttttacagattccatacttaatttttactaaatctagatttgtggtttcttttgatttcttcccaatcgtactccactgggctgaagaaactatcgtatatgggtttcgagaataatactaagagtgaaagggttgttgtggttataacaaacgttctgggatatctataaatcaatccacggtctttggctctgagtcggttattcatacgactattgttcattattagctgtttctcgtttttt

SEQ ID NO: 14412 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14413 - DNA, 170 bp, Diabrotica virgifera
  misc_feature (4)..(121): n is a, c, g, or t
  misc_feature (123)..(168): n is a, c, g, or t
gggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnngg

SEQ ID NO: 14414 - DNA, 928 bp, Diabrotica virgifera
  misc_feature (170)..(192): n is a, c, g, or t
  misc_feature (234)..(258): n is a, c, g, or t
  misc_feature (345)..(363): n is a, c, g, or t
  misc_feature (528)..(556): n is a, c, g, or t
  misc_feature (848)..(849): n is a, c, g, or t
  misc_feature (900)..(900): n is a, c, g, or t
actagttctagacaatattgaccatttattgaaaaaatacgcaatatacacggataaggataaaaaactcaaaaaatgttaatatttatcaacaaataattttctagggaataattattaaaggtgaaagagaacggaacataagaaatatatttaagatactcgattcnnnnnnnnnnnnnnnnnnnnnnngataagaaagatctttttatttcaacaggctgcgcttttacnnnnnnnnnnnnnnnnnnnnnnnnnataattcaaaaagtaaaagggctctcttcgagaattgtgagttattatattctatacttgttttaagtgttagaatactcaaaatgnnnnnnnnnnnnnnnnnnngtacgcccatggctaggtactaaaatttagacacaaaaaaatttcttcgctggagtatatgtatgcaacgtattaaatgattttgttgggtaataaagatctcttgaaaaacatgataattttgaaatttgctgaaatgattttacagttatttaaaatcatccnnnnnnnnnnnnnnnnnnnnnnnnnnnnncctaaaacatgttctagtaggcttgattgatttaaacaaacaattactgacttttagatatatctcaaatactcattttttttgtcttttaaaatcaataatttacaccaaagatttaacacatgtataccacctataataagcttttattttattttagtgtataatatatcaaaccacttcaagtacaaatactaaccaaaccacaaaaactataagtatctgatatgagacacattgtaaatcgtatttttacctgctaattttattataacaaaaattagttaataanngttgatcatttcactgtacacaagaaacgtatttatatttagttttgaaanttgtaatacaaaaatatcgctcaacctt

SEQ ID NO: 14415 - DNA, 865 bp, Diabrotica virgifera
attttattgaggacccatttataagactgagttttaatcatggccgcgccaaggagagccgcacagaccgtaaatcaagaaaacgtaaattcccgtcttgctgtgaaatcaaacgtaactgcgccattagaaccgctaaaaagaccagcacttggcgaactcggcaatacactacaagacacccaaaaagcacaaaacggtcttgctccaacaaaagatggttttaaaaaacctgaaggtactttgcaacccaaaaaagagacaatcaaaactttgactaacaaggaaaaggcaattccgataaaacctagaactatcctaaaaagacaggaaagtttagtaaaaccgttacaaggaaaatgtacacagcctaaagaagtaccacgcacatcgacactagtaaacaaaaaactgtctatcgttgacccagacgaaagtagcaaaaatgatcctcagatggtaaccgagtatgtaatggatatcttcaaatatcttagagacatggaattgaaattagctatcaaagataacttcctcaaagaccacgaaactacttccaggatgcgtgcaatactcgttaattggttagtcgacgtacacgcaaactttaaagccacgcttgatactttgcatatatgcattggaatcgtggatagatatttacaggcgaacaaaaaagtaggaagaaatacgcttcagttagtaggggcctcagcaatgttgatagcatgtaagtatgaagaaatatatgttccagaattagacgactttgaatatgtatgtgatcacacatttacaaaacgacaaattcttcaaatggaaaagggaatactgaaggggttagattttagtttaggtcgaccga

SEQ ID NO: 14416 - DNA, 874 bp, Diabrotica virgifera
  misc_feature (339)..(356): n is a, c, g, or t
  misc_feature (447)..(462): n is a, c, g, or t
  misc_feature (838)..(838): n is a, c, g, or t
gtacggttcttgtggcgtttcttgtgttgttagaacacacatgtagtggacggtatttgcaaacgtgcgggccgaatgataatgaaaaaactatttttaatcaaactgattacagtgttatcggcccgccccttctatatcatgatgtggaatctgtccttgaacttttaaggaaacctgagtacaaaaccaacatctatgtgcaacagttacttgaacaataccatcaggctaaagatcgagaccaacaaatagaagctccaggaaattcaaaaaagtatccattgattgtcatcgagggaatgtctggaacaggtaaaaccactgtttcaactgcgnnnnnnnnnnnnnnnnnnggtaaacaaatccattctccacctaaagaagtaaaagcattgcgggcggcattgcgcaatactacggaattagatatggcttaccaagctnnnnnnnnnnnnnnnngaggactagaagtacaacgcatgcttagagactcaccagttgtaatggacaggtactggcattcatatgctgctctggctatttccactgcagttaacaattatccagatcagtaccagtttccaccaaaaggagataaagtgtacgattggccagaggacttacttaaaccagatattgttttactactaagtgtagatgaagatatccgacagcagagattaaacaaacgaaggaaagcacatggagtgatcgagaaaccagaaagttttaccaaatttttgaaaaaatgtcctctcttcctctcacacatgcttactgcctacaaaaggatgcataatccagggagttgttgtgatagacggaaacccaacgnttgaagaagtttttaacagtatttattcaaaagtta

SEQ ID NO: 14417 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14418 - DNA, 914 bp, Diabrotica virgifera
  misc_feature (224)..(811): n is a, c, g, or t
  misc_feature (851)..(851): n is a, c, g, or t
gttgaatcgaattatttaaacttcattctgcacatagattagattctgcagtctgccttcttgtcgaagttggaccatgttgggtgctgtggcaagagcaacttccagccttttggctggaaaatccatcgaaaaagttggttccgaatcccttaaaattgtctcttcatacaatgttcaaaaaagagacttcgctgccaaggctgctgccggtaaggcacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttaaaagataagacctccaaagtagccttggtctacngacaaatgaacgaacccccagccgctcgtgctcgtgtagctttgactggattaactgttgctg

SEQ ID NO: 14419 - DNA, 809 bp, Diabrotica virgifera
  misc_feature (566)..(595): n is a, c, g, or t
  misc_feature (727)..(748): n is a, c, g, or t
gggaaagtttgtcctactatccgttttatgcttgggctgtgttttggttttcggtcaaaatggtacgactacaaatgcaccgtatataatatgtggtccaggccaacattacgacaattgttcaaacccttgtacaccagttccaacttgtcaaaatccaaatccaactcttcagaattgttcaggtttttgccttcctcaatgtgtttgcaatgcaaaccagggactaattttagatgcaagtactcaaaaatgcgtggagaaaggaaaatgcccatcagatacgactactaatgcaccgtatacaaaatgtggtccaggccaacagtacaacgattgtacaaatccttgtagaccagttccaacttgtcaaaatccatatccaactccccagaattgttcaggtttttgccttcctcaatgtgtttgcgatgcaaaccagggactaattttagatgcaagtactcaaacatgcgtggataaaagaaaatgcccaccaggtttttaatacaattggggaccttgctgcaagaagggggcagctccatttataataacttttgtgnnnnnnnnnnnnnnnnnnnnnnnnnnnnnnctcatgtactaattacaataaagcagtttagttaacagattggtacacctgccaactttttcctttatttatataagcttctttttgcagaaaaaatgcaaaaaaatttggagctgcccctctcttgcatcnnnnnnnnnnnnnnnnnnnnnnccattttagttattattggaaaataaaaaaaagttattgcaaaatctgtttattattatta

SEQ ID NO: 14420 - DNA, 892 bp, Diabrotica virgifera
  misc_feature (54)..(72): n is a, c, g, or t
  misc_feature (818)..(818): n is a, c, g, or t
  misc_feature (831)..(831): n is a, c, g, or t
gtttcgaataagatgaatcaccttctgcaaagcaacactgcatccatagttgcnnnnnnnnnnnnnnnnnnnggaaaagcaacaaagtggaactaggaaaagcctgattatttgacttggcaaaatggcgtccaattcttcaaataactctacagcgattgtcgtactggtgatacaatggctcttcaacgatgtaacgaaggaaaaaagattgtcgttactggaacgagtttattggaagatattttattagattacatacatctttaactggataatacctgagagaaaaatattatatcatatcatttgtcctatacacgttaagcgccagacacaatgtttaaaaaatgccgcctaggccaaggcatttcgtctccaagtgaaaactacaaccaattatggcagtaaaattctctcagttccattgcaaatcatcaggaaaaaccaagaacaaactcaggatactacccccatggtatgctatggtctaattcggcacgtcaataagaaacctccagtgaagatcataacgaaatccgacccaaatctgaatttctataatgttagaaaatactggaagaagcaaaacccctgttaaaggttcatagactatgaaatgtgtagtatgtgtaagactatgtgtgctgtatgtgtaagatatattcgtggaatacaccatacattaaaacttgtcaaatcttttgtaactccgtatatcattatttttaaacttgtttaaatattttaacaatgtttcaaatgttgttctgaaactatttccttgtggcatttttgtaatcaactcttctaagcgngaaattaatattntgtattttgacaacgacatccgatttggacgtcgaaaacgtaataaaatcatttttttttt

SEQ ID NO: 14421 - DNA, 962 bp, Diabrotica virgifera
  misc_feature (52)..(70): n is a, c, g, or t
  misc_feature (125)..(144): n is a, c, g, or t
  misc_feature (836)..(836): n is a, c, g, or t
  misc_feature (900)..(900): n is a, c, g, or t
  misc_feature (929)..(929): n is a, c, g, or t
  misc_feature (933)..(933): n is a, c, g, or t
tgtctttttagtttacttctcttggtttaaaaacaaagcttagctatttatnnnnnnnnnnnnnnnnnnntgtgtattagaaactttagtttttaaccacgatatttaaatattgtggactttgnnnnnnnnnnnnnnnnnnnncttggtcactttctgttggcgaaaaaaattagaaatttgacttggtcaatataagcgacaccgtattaggaaattatatttattaactacggtctgtacatagaaaaaaattaaaatctaatcagtttctgtgtcgtcgctttcagaagaagctggttacggtatgaaaactttttttgactactggaatcgatttataccactcatggaactcttgcggaataattttatttctacgcaaggaggctgtttttattttgctctggtatagacaaaagttttttgtataacattggaatgttcttaggaataacagctggtctgaccttgccacatactcaagagtaacgcatttaattttaaccacgatattttgtttccattttaatcttagtctctgttttttaagaacatctgtgcttaagatcgaaaaagtctgaccgtaattcttcaactctgtaggcaccgctcttttcgttgcgtcttgtagaacggactagcttgaaaatattaacagatcgttcattgtaaaaaatggcaacattttcattaacagactatatggcactgtgcattgagtttaccgtttacctccatgtacgaatgtcctttctccataaaattatgctgcaaaatcttagtgtgtgcgttacaacaacatacaaattaatgcggcaatgaacgaatataanaatctctgataagtcagaatataaactgatctctgtgatgccttttgatcatgtgattgcagangttttatccgctttgatcatgctattccnattncagagcttcccacgtgaccattaatctct

SEQ ID NO: 14422 - DNA, 407 bp, Diabrotica virgifera
  misc_feature (9)..(29): n is a, c, g, or t
  misc_feature (338)..(364): n is a, c, g, or t
ggcgggccnnnnnnnnnnnnnnnnnnnnngttttctattccggaacccccttcttttttccgctcaaaagccgggccctcgcaagagaggtagggggggtaaggaaagaggatgtggagatttcccccagagatccgggaagagatttattttaagtgtaaaggaaagaggtaggtggaaggagtttagtagggagagatgggttggaatgggtgaagaaggtgggtgctagggtggtagaatagtgaaagtggaagagggtagaatatgtgagggagtagagaaagtaaatagtaagaattataaataagtggagggagtatactgtggagaggaannnnnnnnnnnnnnnnnnnnnnnnnnngagatcaatgtatttttggggggagaaaaaaaccctttttttt

SEQ ID NO: 14423 - DNA, 105 bp, Diabrotica virgifera
  misc_feature (2)..(34): n is a, c, g, or t
  misc_feature (36)..(99): n is a, c, g, or t
gnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnntttttt

SEQ ID NO: 14424 - DNA, 161 bp, Diabrotica virgifera
  misc_feature (2)..(23): n is a, c, g, or t
  misc_feature (27)..(44): n is a, c, g, or t
  misc_feature (46)..(96): n is a, c, g, or t
  misc_feature (105)..(122): n is a, c, g, or t
cnnnnnnnnnnnnnnnnnnnnnnagannnnnnnnnnnnnnnnnnannnnnnnnnnnnnnnnnnnnnnnnnnnnnnnnnnnnnnnnnnnnnnnnnnncttgcgcgnnnnnnnnnnnnnnnnnnctccttttatattattatatcactcaataattttttgat

SEQ ID NO: 14425 - DNA, 85 bp, Diabrotica virgifera
  misc_feature (3)..(19): n is a, c, g, or t
  misc_feature (58)..(75): n is a, c, g, or t
aannnnnnnnnnnnnnnnncgatactttattaaaactctattatgaaataaagaatcnnnnnnnnnnnnnnnnnnttaatatatt

SEQ ID NO: 14426 - DNA, 215 bp, Diabrotica virgifera
  misc_feature (2)..(35): n is a, c, g, or t
  misc_feature (37)..(55): n is a, c, g, or t
  misc_feature (58)..(174): n is a, c, g, or t
  misc_feature (188)..(209): n is a, c, g, or t
annnnnnnnnnnnnnnnnnnnnnnnnnnnnnnnnnannnnnnnnnnnnnnnnnnntannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaacctatannnnnnnnnnnnnnnnnnnnnnggtgtt

SEQ ID NO: 14427 - DNA, 146 bp, Diabrotica virgifera
  misc_feature (8)..(69): n is a, c, g, or t
  misc_feature (77)..(131): n is a, c, g, or t
gtttatannnnnnnnnnnnnnnnnnnnnnnnnnnnnnnnnnnnnnnnnnnnnnnnnnnnnnnnnnnnnngtgataannnnnnnnnnnnnnnnnnnnnnnnnnnnnnnnnnnnnnnnnnnnnnnnnnnnnnngtccattttttttga

SEQ ID NO: 14428 - DNA, 388 bp, Diabrotica virgifera
  misc_feature (2)..(275): n is a, c, g, or t
  misc_feature (300)..(329): n is a, c, g, or t
  misc_feature (341)..(341): n is a, c, g, or t
  misc_feature (362)..(386): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaaaaagcttacatttttttacnnnnnnnnnnnnnnnnnnnnnnnnnnnnnncattattaatangtttttttagtatttaattcnnnnnnnnnnnnnnnnnnnnnnnnngg

SEQ ID NO: 14429 - DNA, 568 bp, Diabrotica virgifera
  misc_feature (95)..(111): n is a, c, g, or t
gatgatctgagagagtattttgtataggttggcaaagtaactgatgcctttataccgaaaccttttcgagcttttaaatttgaaacatttttgannnnnnnnnnnnnnnnntcactctgcgaagaagacatattataaaaggtgcctcttggcatagacatgaatggtgctcctaaatccgatacccgaagagttaactatcacgttaataaaaacaatgttgtacacaatctagggggcggcgatgcccctggaggacctgaaagaccatggaatgtacaatcaacgatataaaggagcatgaccctatcaaggcaattgctgaaatcaatgcggtcctcgtggctatatatgactatgccgaacttacaaactgtgaaaagaactgggtgaaggctgcaaggtaataatcaacgaaactggaaatcactggacatggatttaaatgctctggaagcactgacgattgatcctgctattggtgatgctcctctcaatcttgctgaatggtgttagattggaaatctacatgaccaaccggagacgaacttcgatcaaggatttaact

SEQ ID NO: 14430 - DNA, 848 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(837): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnacgctcatccc

SEQ ID NO: 14431 - DNA, 97 bp, Diabrotica virgifera
  misc_feature (2)..(53): n is a, c, g, or t
  misc_feature (68)..(93): n is a, c, g, or t
annnnnnnnnnnnnnnnnnnnnnnnnnnnnnnnnnnnnnnnnnnnnnnnnnnncattattaataagannnnnnnnnnnnnnnnnnnnnnnnnncata

SEQ ID NO: 14432 - DNA, 123 bp, Diabrotica virgifera
gacagaaataaaatcaaatttataattatagtgacttttcaaatagttttgaaaagccacaggtacgtaattctaaatgtttcagttgtattccaataaaaaattatcttcatacctatttgg

SEQ ID NO: 14433 - DNA, 507 bp, Diabrotica virgifera
  misc_feature (93)..(121): n is a, c, g, or t
  misc_feature (238)..(266): n is a, c, g, or t
  misc_feature (271)..(295): n is a, c, g, or t
  misc_feature (318)..(342): n is a, c, g, or t
  misc_feature (390)..(420): n is a, c, g, or t
  misc_feature (426)..(461): n is a, c, g, or t
ataattgattgatagtgagtgtggaggtgaaagtatatattattatgatatcccttttgttatttgtgggtcgtggatgtagcgggtattacnnnnnnnnnnnnnnnnnnnnnnnnnnnnngagataaaaagtgataaataataatgattattattgtatttgtatccttattattgtctgtgaggtgattcgcgttataatataacgaatatctcaattagtaaaataaataacctnnnnnnnnnnnnnnnnnnnnnnnnnnnnncttcnnnnnnnnnnnnnnnnnnnnnnnnnatatgtgagggtatgaagataannnnnnnnnnnnnnnnnnnnnnnnncaaaaataggaattagaaatttcaattttcaaattttggcattggctnnnnnnnnnnnnnnnnnnnnnnnnnnnnnnnccctcnnnnnnnnnnnnnnnnnnnnnnnnnnnnnnnnnnnnagaaatgatgtgatgataatactggtatgatagtattgtatattaa

SEQ ID NO: 14434 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14435 - DNA, 91 bp, Diabrotica virgifera
  misc_feature (2)..(83): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 14436 - DNA, 809 bp, Diabrotica virgifera
  misc_feature (45)..(62): n is a, c, g, or t
  misc_feature (715)..(734): n is a, c, g, or t
gcgtttaacgtagtcaaaaggtttatgaacggttacacgctgagnnnnnnnnnnnnnnnnnngaatgatcccagaaaatggcaacctgttttgttagaggctattgatcttgataatctaccagcccattttggtggaaatcttaaggatccggatggaaatccaaggtacacgacagtgatcaaacagggcggaaaagttcctcagtcgtactacaagaaaaacatagaagttaagaattacgaacaagaatttactaaggctgtgataaagaaaggacataaatgcatattagattttattgtagtggaagaaggctgtcatttaaaatgggatttcaaaactgacgaacacgacataaaattcgggatcactctaaaggacgaaaacggggttgagagccctgtggtgcgccacagaagagtcgcgtcgcaccaaattgacgaaagcggtgtaatcgcgtgccaagctccagcaacatatattgtgaccttcgacaacaaatacagcatgttcagaagcaaaaccatatattaccgaatatacgtcaccccgccattagaaaaactaaacatagtaccccatgataacgacctaaatatactccaattgaacttagatgaaaacttagagagtccaaagaaagaacaactgaacaataatgcagtagttgaacctacaacagcgtgaaatatcttaccacaatatagcgtgnnnnnnnnnnnnnnnnnnnngggaaggttacgcgtaagagaaatgatgctcgacaatatgctatcttagaaaaagggaaaagcttaaaaataaaa

SEQ ID NO: 14437 - DNA, 851 bp, Diabrotica virgifera
  misc_feature (10)..(850): n is a, c, g, or t
cccccacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 14438 - DNA, 920 bp, Diabrotica virgifera
  misc_feature (408)..(425): n is a, c, g, or t
cttcttgatttcttgataaaaaactataaaaaaatcataacttaacctaaaagtggtgcattttgtaaccatcgtttttgtgtattgtttaaagttttcagttgcaaagtgtagatctcataaatataacactctattttgaaaatggcaaacacaaacacagacttaacggaagaagacgcagcagacctacagtttccaaaagacgatgacctctcaacatttagtagctgtaatatttttgacagcaacgattcaacctattgtacaaattgtttaaacgaaatacaaagtaagtacattctatgtgagaagtgtaaagtgaatatctgcctcagttgtttttccaatggagctgagttttcagaccacaaaaatgaccacgattatcgtgttttgtctacagannnnnnnnnnnnnnnnnnttctgactggactgctgaagaagagcttaaacttctggatgggatcagcaactatgggaattggtaccatttagcacaagaacttccaaatagatctgtgaacgaaattatagagcattatgattattactatctccaaagaaatggctgtgagaggtttccaaaagcaaaagtaccagatgccgcgttatttccacagttagtagttccttacagattccagcttaatcattccgatgaacctccaagatatttatcaaacactattggcaataagtcactcgcaggatataatccagctcgatctgattttgaaattgaatacgacaaaaacgcagaggatattctttcaaatctagaaataatagacgaggatgatccaatgtatgaccttcttacgaaattacaatgtcttttggtgaagcttataatcgcaggttgagaacgaggtatcgatggcatagtttaatcagagaccatggactttctgtgatc

SEQ ID NO: 14439 - DNA, 905 bp, Diabrotica virgifera
  misc_feature (554)..(643): n is a, c, g, or t
tagtcatatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggtaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaaacaattagagtgcttaaagcaggccaaaacttcgcctgaatactgtgtgcatggaataatggaataggaccctcggtctattttgttggtttttcggacccccgaggtaatg

SEQ ID NO: 14440 - DNA, 863 bp, Diabrotica virgifera
  misc_feature (628)..(677): n is a, c, g, or t
gataatcctctgttgcaagatgaataagttagcagtgtttgttctattgtttgctattgctctccagcaaacatcagccattttttggcccagacagaggagagatgttcaagatatacagaatttagttccagtagaagagatgccaccgtccagaaatcttaggattattgccccacctgaaagaaaatatggctcatattcattggatgttggcaacgcagaaatgactgcagaagatgctgccgatccagagttaactgaacaaataagtattctagaacaatttctagctgacaaagctgtcgaaatccaaaaactttgggctgaaactcaagttgatttggccgagttttccaagaagtttgaacagctcattgaagaggaagttgcaaacaaaattttgctagatcaagaagcagcacaggctccaaaaagaatgatgatggagtatagaccaagacaaacaagaatggtcaagaaaaattgatgatgtcttcgccccaaagacaaagattgatgtaatttttgaaatttactattatctataactgattccaattataatataaagttaattctttttaccacaattgtctcatattattaaaataaacacagtttatcnnnnnnnnnnnnnnnnnnnnnnnnnnnnnnnnnnnnnnnnnnnnnnnnnnggataaactgggtttattttaataatatgagacaattgtggtaaaaagaattaactttatattataattggaatcagttatagataatagtaaatttcaaaaattacatcaatctttgtctttggggcgaagacatcatcaatttttcctgaccattcctgtttgtcttggtcatactccatcatc

SEQ ID NO: 14441 - DNA, 899 bp, Diabrotica virgifera
  misc_feature (223)..(245): n is a, c, g, or t
  misc_feature (408)..(420): n is a, c, g, or t
  misc_feature (423)..(435): n is a, c, g, or t
  misc_feature (847)..(849): n is a, c, g, or t
  misc_feature (864)..(864): n is a, c, g, or t
aaaagcaagtgacaaaaaatgtgaggggacggcaaataattgtatcaagcagaagttgataattaaacactgaagggctagcataacaggtctgttaagctaataaaaataaaatatggattgtgagataactactgacagtatatcacaatctgatgaacttcctggtcctccaaaacgaaagaaaaaatgtgagactactgtttctgaaaatgataataannnnnnnnnnnnnnnnnnnnnnnttccgcgtaaaaaacgttattgtaaaatgactgttaaagaaggagaaacatattgtggtgaacataaaaagattagttcagatgtacctgaaactgaagtcaccaaagactctcctatacgaattatttgcccattagatggaaagcatacatgttatgcacnnnnnnnnnnnnngcnnnnnnnnnnnnncaatgctaggccaaaaccaacagcaccctacattttgaagggtattaataattgtagtagtgatgaaacagatatggataattcatataatttattgtccacattttctgaagctgatatagttaaaactattgctaaagtgaatgaaatttatcagaaattaataaaagagaaaatcactgaaaaacaattaaagaacaacctgctagaagaagaaatggccaaacctgactatggccctaaaaccaaaaaacacttacaacaagtatcatcaattcttggtttgatcaaagaatatggaatgatgaaaccagcaacctgctatattgaatttggggctggcaggggacagttgagcttttggcttgctaagatgatagaagatgataacacttcaaaaaattttgcttgnnntgaagagcttcgccnaaacataaaaaggataataaattagcacaaacatc

SEQ ID NO: 14442 - DNA, 866 bp, Diabrotica virgifera
  misc_feature (32)..(53): n is a, c, g, or t
  misc_feature (800)..(800): n is a, c, g, or t
aacaattttccgatttttccatttttaaacgnnnnnnnnnnnnnnnnnnnnnngacctttacatgagttttgatcatgttacgaatacttgacaataaactaataattcgatgcaaacaccttaataaactgcaaataagaagctatgttattaacaaccagaaaaacctggaattggaccaggcatatgtaccccacaaagtggagaacgtgacaaaaccgaattatttcaagcctcaacaaaaacaatccaggccctttattttagttttaccaccccctaatattacaggtactttacacattggacatgccttgactgctaccattcaggatgtcttggttagatggaagcaaatgcagggttttgaaacgctttggattcctggcacagatcatgctggtatagcaactcaagttgttgttgaaaagcttttgtggagcgaaaataaacagactagacatgatattggcagagaattatttatcgagaaagttcatgaatggagaagggagaaaagtcctattataagagaacaacttcagagactaggagttcttctagattgggatagggaggtctttactttagatgaacaaaggaccaaagcagtacaagaagcatttataaaactatttgaagagggcctaatatatagatcgaaatctttggtgaactggtcatgtgcccttaagtctgcaatctctgatattgaagtcgaacaactttctttaactggagctaccaatatttcagttcccggttatgaagaacctattgaatttggcattcttactanatttgcctatttaatcgatggaacagaagaggaaattgtggtggccactactcgaccagaaacatg

SEQ ID NO: 14443 - DNA, 869 bp, Diabrotica virgifera
ggcaactggtattctatcgcataacttttttgtctttaacttttaagcatttttgatactggattattgaattgtgaggtgttctagtactaaaaggtgctcttgcgttaaggctgtaggatgcaatgttttctagtaaaatcgatttgaaaatttttcgtttattgaatatagaacgtttggtaaataccgtttgtgccaatttttacttcctctcattctaatgcataactggtatctatacggtgcatggcttaatgttttaattccgacgtttttaacagttaattgttttaagagaataataacaaaccaattcatctacaacctgattcatgcatcggtgatgattcacagtttttattacaacgagagaaatataataaggaagtgaaattttatattcgttggatcagattgaattatgcaattaaatcgcattaaacatggattgtctacaattttcattgataaatcgtataatgcgaattgtgactaataaattttttagtacgaccgcacagtgtaaatatttatgttatcagtcagccatccacctcctcgattgaagatcttccaaataaatttgtatggaaaaaatcggcttgactatacatccaaataagaattatttcttacagagctgttttctaaaaagccaacagcctttttagcaagaccatttctgcgaggatattgtgggctggaacttattaattgaaaattcgaatttaatgtaaaatttttaaactctattgaactagaagacatattatcagtatatacagggtgtcgagaaactctcccgacaaacgaagacaggagattcttcagatcattttaagacaatttaactcaattcaccgcgc

SEQ ID NO: 14444 - DNA, 869 bp, Diabrotica virgifera
  misc_feature (2)..(27): n is a, c, g, or t
  misc_feature (41)..(67): n is a, c, g, or t
  misc_feature (754)..(754): n is a, c, g, or t
  misc_feature (809)..(809): n is a, c, g, or t
  misc_feature (851)..(851): n is a, c, g, or t
gnnnnnnnnnnnnnnnnnnnnnnnnnntggtgattaatagnnnnnnnnnnnnnnnnnnnnnnnnnnnacatacatttatttaagttggttttcaagcagtaattttattgcaagtgttcgaagggtaggtctacaagacctacaaaaatgacggatctattcaccaaagttaactgtacatactgtcaggaagaaataaacagtgttagagtaaaatgttgtgtttgtgctgatttcgacatatgccttccatgtttttcagttggtgcagaaataggaccacacaaaaatgatcactcatacaaattcgttgaccactgtgctgccagtgtgtttggtggaagaggaggatggactggtaaagaacatttgcaattgttggaggcagtagaattgtatggatttggtaattgggagttgattagtcaacatgttgaatcaagaactcccgaagaagtaaaagaagaatacatagctcgttatttagatggaaatataggaagagccactctagccagtgttattgccaataagccagttttaactgatcatgtttcagaagatgatggacctctatcacctaaagttgtagctaggctaccaccattagatgttactcttgaagaggctcgactgttaggctacagaccacatagagatgattatgaaagggagtacaacatggaggctgaacagctagtgtctaagcttgtcttagatcccgatcaagatactgaaatggagatagcattanagttatcaatagtagatatgtatgctaggagattaagggaaagggctcgtagaanaagattagttagggagtaccagttagtggcaaatactttaantatgaaaaagatcctagt

SEQ ID NO: 14445 - DNA, 129 bp, Diabrotica virgifera
  misc_feature (57)..(57): n is a, c, g, or t
  misc_feature (79)..(101): n is a, c, g, or t
  misc_feature (103)..(103): n is a, c, g, or t
taacagcgtaattttattgggagagttcaatcgataataaagattgcgacctcgatngtggatttaagttataattggnnnnnnnnnnnnnnnnnnnnnnntngtcgactttttaaatttacatgatct

SEQ ID NO: 14446 - DNA, 873 bp, Diabrotica virgifera
  misc_feature (721)..(721): n is a, c, g, or t
attgaagatgcggaaaaattgggcacccttaaacctggtatgacgatcattgaaactacttctggtaataccggcattgcattggcttgggtatgtgctattaaagattacaaatgcattctcgtattaccagataaggcgtccaaggagaaggaagatatcatgaaagcatttggtgcaacagtcgtaagagtcccaatggatgaaccagatattagtgagcatggaaagtacggaaaaacccactatattcataaacaaacaccaaattccattattctagatcaattttctaacccatctaatgcggtagcccattatgacaatacagctgaagagatatattaccagtgtgatggacaagttgatatgatcgtttttgcagctggtacaggaggaactatgactggtataggcagaaagtttaaagaaatttctcccaatacaataataataggtgccgatcctcatagctcattttttgctgaaccaccagaaattaataaaacagatgtgaagttttctgaagttgaaggtataggagatcatattgttcctgtaacatgtgatcgacataatatagataaatggtacaaattatatgataaagaatcactggtcatggctagaagattaataaaggaagaaggattattagttggactaagcagtggcgtaataatggcaggtgctttaaaagcagttaaagattttaacttgngaaagggaaagaaagtggtagttgtatttccagacggtaccagaaactatttaaccaaatttattgttgatcaatggatggaacaaagaaatttattacctgttacaaaccctaatggtcattggtggtgggatattaacattatgcagttg

SEQ ID NO: 14447 - DNA, 949 bp, Diabrotica virgifera
  misc_feature (52)..(70): n is a, c, g, or t
  misc_feature (343)..(360): n is a, c, g, or t
  misc_feature (472)..(489): n is a, c, g, or t
  misc_feature (859)..(859): n is a, c, g, or t
  misc_feature (900)..(919): n is a, c, g, or t
ataataaacattttttgcttataattaatatttttaccagcatttgcggtcnnnnnnnnnnnnnnnnnnnccaccctcgaaatgaggtggcaaccaccccatggtaaaagcgtattgtatttgcgcttttcctgtctttccttgaacctaagatatatacgcccaaaaaatatgctattttgtatctacccagccctttagctggcttaagggtagtcagaagtcaaaaattagaccggttctgaatcggccctcacaccttcttgaaacacagaagaaaacattcagatcggtgtaacttttccacacacatacatacatacatatccacaaacattttccnnnnnnnnnnnnnnnnnngagtcatatttctgagctcgatatcttttgaatggtataaccgattttcaaaatttaacatgcgttggaaaggtaattatctgtgctatcaggaaccgcaaaggtcgggctnnnnnnnnnnnnnnnnnngggagttttggggacgagaacgaaaaacaggctttaaatgggaagggccgtaaaatccacacccttggaccaaaattgatggttgacatatgaatggacgagtcttttcctaaactttaagatggaatttgtcccaattttcaattcagtcaggtttagaaaatcgaaaatttcgtgtatatatagtgtcgcatgtaggggtgttgtgcgccactggtgagaactgccgttctctgtggattactacgttatttatttcgtgtaaaaccatcaaataggtatgcaatacagtttaatattttcaaatataaataatgaaaatttaataacgaaaataaatttcatttgatgagtcgcgaataagagtggnagtaaacactaacgcaatttatcggccgcaaaaaggatcgnnnnnnnnnnnnnnnnnnnntaataacataaaacatatcaatacaaaatt

SEQ ID NO: 14448 - DNA, 677 bp, Diabrotica virgifera
cgacagccgaggggtcaaccataaatgatgtacttgatgaatcattttctatcgaaatagaaatatttgaaaaagaccttacctactgcaatgtgattcactatctatatatattctaatactattatgaaataatctacatatatttattaaatgtatatttatactgaaatatttttatagtactaagagtaaatgtcattgactcatcagcttaactctctgattatattaacttccaattactatctaaaaaatattccccactcttataaaacttaaaaaaatgatattattgtattgatatacattcatacattgttattacttatccccattccattcttagataaccatctttcatcaaaatcaacaacagctgatacttattcaaaaattatagttacataaccaaaacttgcccctacaatatattaaacggattactatctccattatcttcacatggttaccaaccacatctcaaacctcatctactaacaacaactcacccttccactgagcaaaccaaaaccactagacctataccaccgacgattgataccacccaaaccttaaacctcatctacaaacaacaacttaaacaatgtagtgattacccactagaccattactagtttatacagaaacatattaatgaacaacaaagactcacc

SEQ ID NO: 14449 - DNA, 677 bp, Diabrotica virgifera
gctggaaatctgtttgtttttgtaagctcaaaagatatattactatgaccttattgccccttcactactatcaaccccttaactgttcttcatctgtgcttcctatgtattaatgctctactgataaatacttggacatttttcatgttatctcttaattctatactccataaaaaaactatacgtaactcattcagaattcgatgtcgcaaaattcaattattatcaattattttgagaacttacaatgcttcttagcatctgagattaacacatatgtttattactgattggacaaaaataattttccaaatgtaaataagaatgattcaaaatcatctactttttatcttacatgtctaaaggctatgtattttcttgcagatgaaaataatagaactacctatgacacttgtcgagctactcctgatcttatgaaaggaatgattggcgaaccatgacattcatcaatccctcaaggattcttgcagaatgttcattatcaatcaacaaatgatccaaaatatgtgtctaataaaattttgcttagatgcttatactcgtatgtcttctcattatgaagattttgcataatcaaactatgcattggtttaccctcaagagattctcctaacaataactttctctcaaacacttacaagaaccaccttcgatgt

SEQ ID NO: 14450 - DNA, 575 bp, Diabrotica virgifera
  misc_feature (520)..(537): n is a, c, g, or t
ggggcgggccgggattttcggggcgccccccgcgcgcgcgagtgtattaattattatgaatgttattatctagtttcattagaatttggatgatatatgcatataacggttaaatattgataccagaagatgagttacaataaaggtgagaaaggtattacacgtaccggcctgtgtgtagtcgcaatgttcttactccaaagatgaagtatatttttcttggcggattatgtacagaggagtggaacccgtttgtataccattcatgtatagtattcactgatcaattacttggactcgtgaaaccttaccccgttttaaggtctgtccaccttccctataccgttggaagtatttattacactatacagatgatcgtagtacttaaaatattcatagtactataagttttgtccctttaaattgtggtagctgatcaccgttctggtaaaagaggcataaacatacccaaagtaggtgtatgaacaagctgattatcatggaaaatgatactatcccnnnnnnnnnnnnnnnnnngttgtttagcatgatggtactgccgaaagattatcgaa

SEQ ID NO: 14451 - DNA, 175 bp, Diabrotica virgifera
  misc_feature (6)..(94): n is a, c, g, or t
  misc_feature (96)..(96): n is a, c, g, or t
  misc_feature (107)..(170): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnantttattaattnnnnnnnnnnnnnnnnnnnnnnnnnnnnnnnnnnnnnnnnnnnnnnnnnnnnnnnnnnnnnnnnttttt

SEQ ID NO: 14452 - DNA, 349 bp, Diabrotica virgifera
aacaactgatcgtcggtataatatgtagatcagttactatagaatattatgttgttatgcaccgccgaggaggaagatcttttgaaaaagaattgttaagtatttagtatcatgtttagaagagcttagatacatatggctttcttggaaatcttataacattgaatcattcatcttgtcctcgtcgattattcctgatactaaatgctaatactttccaagatatacaaaagtaattttctgcctctactaaagatattaaacgaattactatataatacctgttattgatgcttatcactgatgtatgattacataatcataaagcactaattgttaactaaaaatt

SEQ ID NO: 14453 - DNA, 860 bp, Diabrotica virgifera
  misc_feature (272)..(289): n is a, c, g, or t
  misc_feature (413)..(430): n is a, c, g, or t
gcggtaagtaaattttgggtttgtaaaagaaatgtaaagaaatgtatctaggaaacgaagcattttcgaacatgcgtttatggaaaatgtcattattttttcatgcagaattacagcttatagtttgtcatacttatttaaaaacaccctgttttaattatttccagttttgcacatttacaataaatattaattgcaaaagtaaaacaccacaagaacatagtccagaaccatattaatgttttcctatgtaggtattgtcaattttttgnnnnnnnnnnnnnnnnnncatttcaatgtcatattccagtcactgacgtgattgtacctactattattccgccctagctaaactatttgccttatgagataaaaagctctgtttatatcagtgcatccatattgaaatgagnnnnnnnnnnnnnnnnnngtaaactacagagtaattatgttatttaactgttaaaatgatcaatgtgtgatgttttagagaggaaagtatttttcttgaatcaagtcgtcaagtgaattaattgttccggggtttgagaacaaagattcccaaggtgctctcaagtagccaagtaatgttaattttttgattaaaatgattcaagtgaaacaataaatagtttcatcgaaaagtgaatatttttgaaagtagctctttataaaaattctcaaatgcacaaatgtacggagtgatgtcaaaacggtgcatttatactaattatgtaaagatatttattctacacatgactgaatatgaatgcatgattacactaatattagaaatatggactatattaaaaattcacaaaagttttacttttatacttaatggtgctttcttcattgct

SEQ ID NO: 14454 - DNA, 83 bp, Diabrotica virgifera
  misc_feature (4)..(69): n is a, c, g, or t
  misc_feature (73)..(73): n is a, c, g, or t
attnnnnnnnnnnnnnnnnnnnnnnnnnnnnnnnnnnnnnnnnnnnnnnnnnnnnnnnnnnnnnnnnnntttnattatatata

SEQ ID NO: 14455 - DNA, 854 bp, Diabrotica virgifera
agcggctgtgtgtttaacccgggccaggcgcgaatgtgtttcagacaggataactgtcgtcgtctaccaggtctccttttttcttcaattttaccctttataatcaggggcaaaaatttattgatgtgtcattttcgttggtaagaatgtgccccaagtatgctgtttttcccctattaattgctgtcaggagttctctgtctcttcccattctgttcaacataattttgttcggaatatgatcagtcatcatcatcagtcggggttacagctctttatgagccaaagccttcttcagaacaatcctccattcgcctctgtctctggcaactcttctccgtgctctaattccaatagattttaaatgagtgtctatgttgacttggtacctaagtatcggtcttcctcttgctcgttgtgctatcggccctcttcgatcaaaaacttttctgactatggcatcttcctctcgcctgattacatgacctatccatctaaggcgtgctaccttaatgaattaaacgtcaggttctccaaaatttctatacaactcaaagttgtaacgcctgcgccacaaaccttgttcttgtatgccaccatatattcgtcttatgatttttcgctgacaacgtatgaatagctcttggtcattctgagtaggtggacacgtttctgagtcatatgttagcactggacttattagtgtttgtagacagtcgatttaatgtttctaggtatgtttgaggccatctggcttcttaaggcatagtagcacttattggcgagcactatgtctgttataatttcgtcactgacatggttatctttagttagcagcgaggctatgcatatga

SEQ ID NO: 14456 - DNA, 389 bp, Diabrotica virgifera
  misc_feature (2)..(258): n is a, c, g, or t
  misc_feature (265)..(302): n is a, c, g, or t
  misc_feature (337)..(359): n is a, c, g, or t
  misc_feature (367)..(388): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataattggnnnnnnnnnnnnnnnnnnnnnnntggtcgannnnnnnnnnnnnnnnnnnnnna

SEQ ID NO: 14457 - DNA, 154 bp, Diabrotica virgifera
  misc_feature (2)..(47): n is a, c, g, or t
  misc_feature (52)..(144): n is a, c, g, or t
gnnnnnnnnnnnnnnnnnnnnnnnnnnnnnnnnnnnnnnnnnnnnnngctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattggggt

SEQ ID NO: 14458 - DNA, 218 bp, Diabrotica virgifera; identical to SEQ ID NO: 7300
  misc_feature (6)..(28): n is a, c, g, or t

SEQ ID NO: 14459 - DNA, 362 bp, Diabrotica virgifera
  misc_feature (338)..(358): n is a, c, g, or t
tttttagggaaaagaactagatattttaattgactgacacataattacatagtgcgagagaataatgtaattttctcaatacaaacaattattttatgtaccgcgtgtatcaaagagtaaaaagtattaaatatatattgattattttccaatttaaaagagctaaaacattagaaccgtcattggaaaataaatattccaaataatttttcagcgaagacgtgtgactcgattttatatatatctagttttagaaaaactaagttcagtacatccattagctctatagaaagaattaaatacctttatattataactattagatattttaaagaagnnnnnnnnnnnnnnnnnnnnnttaa

SEQ ID NO: 14460 - DNA, 639 bp, Diabrotica virgifera
  misc_feature (18)..(67): n is a, c, g, or t
  misc_feature (75)..(123): n is a, c, g, or t
  misc_feature (553)..(572): n is a, c, g, or t
gccgccctttattaaacnnnnnnnnnnnnnnnnnnnnnnnnnnnnnnnnnnnnnnnnnnnnnnnnnnttactacnnnnnnnnnnnnnnnnnnnnnnnnnnnnnnnnnnnnnnnnnnnnnnnnnatttaactgaaaaatataagtgtactaaagaattatcacatcctcactttcttcagatctataaagaacgtgctacctatctattaaataaggatacccgaaagtcacgacagtattattacttaaggtagtgatatttttatcgtctatctcgagaacctattagtgatactccaagagtgatactccttatgaagaattatacgatgataaagctatctttaaatgattaaaagtaattattaactaaacaactacagattgaaatgattatcaattgataatctatatgttatatcctttgtgtaaaaaataacaatgtttctgcatgccgattaacttgtgatatcttataagattattattattacaatattacagcaatataatatacaataccttatttatgtaataataatggcgactctcnnnnnnnnnnnnnnnnnnnncctagaagaagcagatatattataaagactgatcgacttttaaaattatacatgatctcaaaattaa

SEQ ID NO: 14461 - DNA, 436 bp, Diabrotica virgifera
  misc_feature (16)..(39): n is a, c, g, or t
  misc_feature (51)..(131): n is a, c, g, or t
  misc_feature (146)..(161): n is a, c, g, or t
  misc_feature (164)..(178): n is a, c, g, or t
  misc_feature (181)..(204): n is a, c, g, or t
  misc_feature (248)..(268): n is a, c, g, or t
  misc_feature (306)..(323): n is a, c, g, or t
  misc_feature (410)..(430): n is a, c, g, or t
gggaaaaccccccccnnnnnnnnnnnnnnnnnnnnnnnngttccccccccnnnnnnnnnnnnnnnnnnnnnnnnnnnnnnnnnnnnnnnnnnnnnnnnnnnnnnnnnnnnnnnnnnnnnnnnnnnnnnnnnggggggaaaaggccnnnnnnnnnnnnnnnnccnnnnnnnnnnnnnnnccnnnnnnnnnnnnnnnnnnnnnnnnaaaaaccccccttgaaaaaattttttagggacttttttccgtgnnnnnnnnnnnnnnnnnnnnngtttgtttcccccccccccggggggacgcccccccggnnnnnnnnnnnnnnnnnngagggttttttttaaggagaaaaaaatgagaacgcccggttggggggccccccgcgctcctcctaatattaaaaaagtttggagcgnnnnnnnnnnnnnnnnnnnnntttttt

SEQ ID NO: 14462 - DNA, 917 bp, Diabrotica virgifera
  misc_feature (695)..(716): n is a, c, g, or t
ctcaaactcaagacagatcttcacgctacaggatcatagatgtttaaagtatggacagcgaaccagcatcagcatgggacctggatcttggcatattgataaatatggttaaacaatttccatatctctacaattctcgtcatgaaaactttaaaaatacagcattaagagagaggacatggtgtaatattgcagagagacttaaagttcctgttggtgattgtcaacgaatttggaaaaacttaagggacaaatggagtaaagagaaacgaataactatgcagaatcctgcgatttcatcagagtgggaattttatgaagtacttaagtttttgcaacctttcgttcgaagacggcgaagggccagattgaaacctaatagaaccaatcttcagaatgcatcattaaaaaacgaaatagaggaaacttttgaggaaagtattaatcctgacgatatagttaaaaaaatgtggaacagaaaccttggagtccaagtttgtcctgaaaatgttacatttttagaaagtgaaatggaagaggctgcagaatctgaagaaataactcttgattttgtagatgatcccccacctaaagaagaaactgttattcggtatcaaacttcagaagaagcttttggggcgtatgtagcctgtcgacttatggacttcagtgtagaagaaagacaaacaaaacgnnnnnnnnnnnnnnnnnnnnnngaagatttggaataatatctgtgataaacaatataaatatggttgtgaagctatttttttgtcgtgtgttttgcgatatatgtatataatctatcgacagtcttagatcgctccagtctggtagtcgttctcaaatgcaaatattctagtgataaatatagtttctgctgtgaagttagtggtaaataaaataatttgaca

SEQ ID NO: 14463 - DNA, 673 bp, Diabrotica virgifera
  misc_feature (554)..(575): n is a, c, g, or t
gattgaacatttatgtacgagagtagatgaagaggttccgcttatggggctatagtgtgagagaagaatggctgatgatgatacagaggattcagtttcgggccgctggcgttgccggaccagcgaaccgctatgatgatatgtgctcttcacggatgtgcaatgacgagaggcagagagagccttgctgttggcgatgaaacagaaatctcctatctcgtcttgtataagaataggtgaagtggcgcagacgatataatcactagtagagttgtgtcttcacattgaggaaaagactgaatgatcacagatatggcaacatatggctgcagaatattctataagcatactgaatatggccgacccgaaagcagcgatgattacttgaggacttcttgatacatactcttatgcctagggcaatctgtcgccatattcaaagtatggtagctctagatgtaggtaaatatctatagttacctcttagaaggtgccatactgaagcacactacatatcactgtcgtcgaatattcttagaggtggtgtatctatnnnnnnnnnnnnnnnnnnnnnngcgacaagtagaccaacctcaacatgcacacggagcagcccttggctcgtaccacttctctagtgttttactatgagataatgattgtccggacaacg

SEQ ID NO: 14464 - DNA, 180 bp, Diabrotica virgifera
  misc_feature (2)..(31): n is a, c, g, or t
  misc_feature (38)..(73): n is a, c, g, or t
  misc_feature (119)..(170): n is a, c, g, or t
  misc_feature (174)..(174): n is a, c, g, or t
gnnnnnnnnnnnnnnnnnnnnnnnnnnnnnncactggnnnnnnnnnnnnnnnnnnnnnnnnnnnnnnnnnnnngctcgccctgccactgattaattttgatgggccgcgtatttttgannnnnnnnnnnnnnnnnnnnnnnnnnnnnnnnnnnnnnnnnnnnnnnnnnnnggtntggatg

SEQ ID NO: 14465 - DNA, 781 bp, Diabrotica virgifera
  misc_feature (80)..(105): n is a, c, g, or t
  misc_feature (216)..(228): n is a, c, g, or t
  misc_feature (231)..(243): n is a, c, g, or t
ggactgttttccaaaaagaagtcttctgacaaagaacaggacggtaaacctagtaaggaagaaataaacaaatcaaaagnnnnnnnnnnnnnnnnnnnnnnnnnngacctgacagctaaacctgaaagcaaagatttctctaagatagaaaccgaccgcttgcaggatagtaaaaaatcaaaagaagagagtggtagtttctttggtctgttttcnnnnnnnnnnnnnccnnnnnnnnnnnnnaaaagcattgaagaagaaattccgcacaagctgtctaccgaagtccttcaaaacatgaaacaaagttctgacttcctagatacagaagtgaaggtttatcatgatgtacgaccagaactagacaaaagttttacagatgataatttcaaaccagtcacactgtcacccatcgatacttcgtttacattaactacagaaactactaaacatgaagaccacattaaacatgaaagacacatcaaaacagaagaaacccaaaaatcaagtcagtacaccacagatgaagcatttgcagaaactttagcagatgaaagtccaaaaagaacgatcactactacagttaccaaacaagaaataccacacggagaaagaacaacgaaagtaaagacggaagtgctaacaggcacaattcagttatctcccgacgtattgaacgatattgaaaaattagaaaaagaaattaacatgaagttggaagaactaagaaaacaaacagattctaccgatgacctcaggaagcaacctcctcattactcct

SEQ ID NO: 14466 - DNA, 105 bp, Diabrotica virgifera
  misc_feature (12)..(41): n is a, c, g, or t
  misc_feature (43)..(68): n is a, c, g, or t
  misc_feature (70)..(84): n is a, c, g, or t
  misc_feature (86)..(98): n is a, c, g, or t
catttttttacnnnnnnnnnnnnnnnnnnnnnnnnnnnnnncnnnnnnnnnnnnnnnnnnnnnnnnnncnnnnnnnnnnnnnnncnnnnnnnnnnnnncggtgat

SEQ ID NO: 14467 - DNA, 375 bp, Diabrotica virgifera
  misc_feature (10)..(51): n is a, c, g, or t
  misc_feature (55)..(101): n is a, c, g, or t
  misc_feature (106)..(172): n is a, c, g, or t
  misc_feature (176)..(208): n is a, c, g, or t
  misc_feature (221)..(238): n is a, c, g, or t
  misc_feature (250)..(267): n is a, c, g, or t
  misc_feature (282)..(307): n is a, c, g, or t
cctgattaannnnnnnnnnnnnnnnnnnnnnnnnnnnnnnnnnnnnnnnnnaccnnnnnnnnnnnnnnnnnnnnnnnnnnnnnnnnnnnnnnnnnnnnnnnctggnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnnnnnncccattaaattcnnnnnnnnnnnnnnnnnncatggggggggnnnnnnnnnnnnnnnnnntcttttttatatccnnnnnnnnnnnnnnnnnnnnnnnnnncccaatatttttcgctatccagaaaaaatttttcccctcccgcgaaacaccccccccatttttttttc

SEQ ID NO: 14468 - DNA, 73 bp, Diabrotica virgifera
  misc_feature (5)..(61): n is a, c, g, or t
actgnnnnnnnnnnnnnnnnnnnnnnnnnnnnnnnnnnnnnnnnnnnnnnnnnnnnnnnnncagaaaacctat

SEQ ID NO: 14469 - DNA, 898 bp, Diabrotica virgifera
  misc_feature (844)..(844): n is a, c, g, or t
aagtcaagtatactatacagattacacaagattattaaagatttacagatatattattacagattatttggattttacaaaggactagtaactcgtgaagctcatttttcacttaacatacttaacatacaatggtgcttggacgtcaatcaagatatatacgggttacgcaattgaactgttacgaacttcacatcgatacatctggcaaatcgataatgacagctacgtcaaagttggcctgataacacttgcatctaagttttatacatataacaaaagttattcgcaatggaatttaaacgtaatagtgtgattgcgttatatttggctggaatgtcacaaccagctattattgtttatcagctcaaacacctcaaagtgaatgtatcgcaccataactcgttataatgatactggtagcattaccaaacgctatggtggtggacgaaaaaaatcagcaacatcacctgaaatggttcggaaagtgaaggctcgacttcagcgaaatccacgtcgtagtggtaatcaaatggccaaagaactgaaaatatcccagccaagcatgcaacggatattgaaaaaggagctcaatgtcaagccttacaagatccaaaaagcacacaatcttaaaccaaagcaaaaaaaaaagttcggcttgaaagagcaaaggaattgttacgcctgcacggacgtggcgaattttcaaacatagtgttctctgatgagaaaaatttccctattgagcggttcaaaaactctcaaaatgatcgtgtttacttgaccgaacgcacctacgaaagtttgagcctacgaacggccacctggagtaatttcccatgtncagtaatggtatgggcagctgtaaccgccgatggacgctatccaatcattttta

SEQ ID NO: 14470 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14471 - DNA, 905 bp, Diabrotica virgifera
  misc_feature (83)..(98): n is a, c, g, or t
  misc_feature (100)..(113): n is a, c, g, or t
  misc_feature (294)..(312): n is a, c, g, or t
  misc_feature (314)..(727): n is a, c, g, or t
  misc_feature (729)..(890): n is a, c, g, or t
ttgccaaggaaggaaaaatcacagacgatactgatgcccaactcaagaaagtcgttcaagatttcttggccagcttctctggnnnnnnnnnnnnnnnncnnnnnnnnnnnnnncctaaatcgtcacttttgttgatgtgatctgtaaacgtttaagaacttcatgagctgtaatcctttcaaattagaataattaggcaggactcctatgttatccaataaggcacgtgaaagaattttcttttctccattttacaatatttatcgatcattgttttttaaggatatcttattnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttaattaagggat

SEQ ID NO: 14472 - DNA, 258 bp, Diabrotica virgifera
  misc_feature (9)..(72): n is a, c, g, or t
  misc_feature (76)..(128): n is a, c, g, or t
  misc_feature (147)..(177): n is a, c, g, or t
  misc_feature (209)..(209): n is a, c, g, or t
  misc_feature (219)..(237): n is a, c, g, or t
  misc_feature (244)..(257): n is a, c, g, or t
atggccgcnnnnnnnnnnnnnnnnnnnnnnnnnnnnnnnnnnnnnnnnnnnnnnnnnnnnnnnnnnnnnnnnggcnnnnnnnnnnnnnnnnnnnnnnnnnnnnnnnnnnnnnnnnnnnnnnnnnnnnncacgcttacatttttttcnnnnnnnnnnnnnnnnnnnnnnnnnnnnnnncattattcataagtttttttagtatcaaattnatttatatcnnnnnnnnnnnnnnnnnnncgtgatnnnnnnnnnnnnnnc

SEQ ID NO: 14473 - DNA, 498 bp, Diabrotica virgifera
  misc_feature (370)..(390): n is a, c, g, or t
  misc_feature (428)..(449): n is a, c, g, or t
tttttgaagttaatacaatgtctaaaacaattgttgttttagctttagtttgctgtattgtagtacatgtccaatgtgaatcaattatctattgtccagatcctgcaaatccaggatacctgcagtttgaggaacaaataacatcatcttttcctaccactattcctgtacactttccttcgagtggtactgaattagaaatttcgtgtttattgatagattgcgatgataatgtcacagcgaagataactgcaggaattggatttcaggttacagtagatgaattggtttttgaatcatgggaaccatcaacctgtaaaattcaaatttatacttcacatgcagatcttacatctgcttaaattacacnnnnnnnnnnnnnnnnnnnnncaaattatcacatttcatttaccattttcaaatttatnnnnnnnnnnnnnnnnnnnnnngaaatgtaggcaccaatgggcttatttgtcgagctactttgtgtacatg

SEQ ID NO: 14474 - DNA, 94 bp, Diabrotica virgifera
ggtgtttgtggcttcttctcttgtttcttttcttccttcttcttacctttacctggtgttgcagctgcagcaccaggtaaaggtaagaagaagg

SEQ ID NO: 14475 - DNA, 886 bp, Diabrotica virgifera
  misc_feature (839)..(839): n is a, c, g, or t
gcggatttatatgcgatcaattttgatgaaatatgcgcatatatatgcagtaaaaaattacgaaatatgcgcaagatatgcacaaaaattccaaaaatgcgcatttcgagaaaccacaaattttctgttctattctattctaacgggttcttttataggggggcaatcgtatattatctttgaaataaaaacattattttttacatatgcaatttattcacaatgagaagacacacagtgaggattcaggaagggcagaagcacgcaagacttataatattcataataagacatgtgagtgtgaaggtaatcaataagaattgagagatacatacatgcttcatcgatatggaaaaggcgtttgacagaatccgaagaaaggacgtatggaagaaactaaaagacgggggagtcgacaggcacaacatgggagtaattaaggatacgtacaaaaataatacaaatacagtaacaaccaataacgacgaatccagaaaatttactacaagtcaatgcgtcaaattatagggatgcgtgttgagtccactgctattctcagtgataatgggattcctgttctgaagagtacagacaaaatacaaaacgaaacaatcagacaaaaacctaaaactagaaccaatcaatgaaaaaatagtagatagacaacttagatggttggggaacgtgtgtagaatgtcgaacgtgaggcttgcctaacaaaacgagtgttcgaaacgagagtaaaggggataaacaaaagtttcctggaagaccaagagttatgtgggtagatgaaatcaggaaagaaagtcagaagaaaggattgacattgaaactgncagaaacccccacacagatcggaaaacatggagactgtaatgccaaa

SEQ ID NO: 14476 - DNA, 242 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (162)..(193): n is a, c, g, or t
  misc_feature (200)..(232): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttacaattttacatgatctgagtttaaaccggtgtgagccaggttggttnnnnnnnnnnnnnnnnnnnnnnnnnnnnnnnngaaaggnnnnnnnnnnnnnnnnnnnnnnnnnnnnnnnnntaatattaac

SEQ ID NO: 14477 - DNA, 120 bp, Diabrotica virgifera
  misc_feature (9)..(31): n is a, c, g, or t
  misc_feature (44)..(117): n is a, c, g, or t
gtaaaaagnnnnnnnnnnnnnnnnnnnnnnnaaagaacctatannnnnnnnnnnnnnnnnnnnnnnnnnnnnnnnnnnnnnnnnnnnnnnnnnnnnnnnnnnnnnnnnnnnnnnnnnggg

SEQ ID NO: 14478 - DNA, 888 bp, Diabrotica virgifera
  misc_feature (13)..(27): n is a, c, g, or t
  misc_feature (450)..(467): n is a, c, g, or t
  misc_feature (771)..(771): n is a, c, g, or t
cttattttatggnnnnnnnnnnnnnnnaaattttaaaaattcttgtaattgtttagacatttcgcaacaattgtgaacaattttggaaaatattgcttgaaagctataattctagatgtaagagcaaagttttgtagtcaaaatggctggagtattcgatttagaactgcatgatgttgaaactgtagaagtagatgattcagacgatgcaatcgaaattgaagaggatgaatatgatcaaaatcctaatattaatgcaattgtagaatccgatgatacagaaacggttcatctgactgaacaaattgtgaatccgggccaggaaaaaaccggaccccatgactttgaattacgcaaagtcctgggcaaaggaggttatggcaaagtatttcaagttagaaaaattacggggaaagatgccaatactgtctttgccatgaaggttctccnnnnnnnnnnnnnnnnnngaaatcaaaaagatactgcccatacgaaagcagaacgaaatattttagaagaagttaagcatccttttatagtggatttgatatatgccttccaaacgggtggaaaattgtacttaattttagaatacctcagcgggggcgaactttttatgcatttagaaagagaaggaatatttttagaggataccgcttgcttttatttatccgaaatcattctcgccctagaacatttacatggacaaggaattatttatagagatctaaagcctgaaaatattttacttgacgcccacggtcacgttanattgacagatttcggtctgtgtaaaaacacattaacgaaggcatattgacccacaccgttttgtggaactattgaatatatggcacctgaaatttaactagacatggccatggaaaa

SEQ ID NO: 14479 - DNA, 107 bp, Diabrotica virgifera
  misc_feature (12)..(33): n is a, c, g, or t
  misc_feature (40)..(69): n is a, c, g, or t
  misc_feature (81)..(81): n is a, c, g, or t
catttttttacnnnnnnnnnnnnnnnnnnnnnngtttatnnnnnnnnnnnnnnnnnnnnnnnnnnnnnncattatttatcnatataatttatttactcgcggtgatc

SEQ ID NO: 14480 - DNA, 773 bp, Diabrotica virgifera
  misc_feature (421)..(439): n is a, c, g, or t
  misc_feature (683)..(683): n is a, c, g, or t
  misc_feature (726)..(726): n is a, c, g, or t
gggcaagacattttacttccatataaaagacatggcgtttcgggcctattgagccccacttgcccggataagggttaaaacagtaaaagaaaacgcagcagcataaggtactgttagttgggagcactctgaagaccaccatgtgttcgttgttctctgataataccatcaatacagatataattatttctacgagtatggctatgtcaaacgaaataaggattgagagaccttttagatgctctcagtgaaacaaatgcaattttagagccacaaccaaatactaggaacactaaggaagaaattcctcttattaaaaaaagaatggagggacaattcttgttaacaaattctgcttaacaatggaggaggaagatatatgaaaggttgtgttacaatacatttagtttttatctaagcnnnnnnnnnnnnnnnnnnnccacatttgtactacatttattttcaaacaaaccagttttttattgattcacaaaaaatttttattgattacgatttacaattaacccattcgcagatacgactatatatgcatgtacttacaaagggaaattactgtctgcatatgaaaatgtgtccacaaatgtgttaatacaatatttacaataaaattatattatagaatatttacaataaaattaaactcaatatacacattgatattncagatttagtatttccaattttttgtaattctatattatttgngtgaaaatcttatgtccagagctcttttggcaacccaacgtatcccc

SEQ ID NO: 14481 - DNA, 633 bp, Diabrotica virgifera
  misc_feature (390)..(415): n is a, c, g, or t
caacactatgttctctaaaattttgtcagtgttagccttcacagctttagcacaagctggcgttttagactacagtcacggccatgctacctcatatgcttcctcaaacctaggtggttcagaacatggacatggatattcagctccagttttaagtcacgcatatgctgcacctgttgctcacggatattctgctcctgttctcgcccacggacattccgcacatcacgatgtagattacaacgcttatcccaaatacgaattcaactacggagttcaagatggccacactggagaccacaaaactcaacacgaagtccgtgatggtgacgtagtcaaaggttcctacacagtagctgaacctgacggtactcttcgtactgtccactnnnnnnnnnnnnnnnnnnnnnnnnnnaatgctgttgttgaaaaatctggacacccagttcacccagctccagctcatggacacggaaaagtactcctagctgctcccgctgtccaccacgctccattgtaccatcattaaaacctgaaagatgcatgttgattattgttactgtatttattgactttgttgattgaattactatgtaattaatttttgtacataaaataaatttaattgaatat

SEQ ID NO: 14482 - DNA, 859 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(457): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(845): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnncaacccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnctcatcccctaaaa

SEQ ID NO: 14483 - DNA, 363 bp, Diabrotica virgifera
  misc_feature (80)..(105): n is a, c, g, or t
tgtgtgtatacctacattttacctgcaaccgtcgaaatgactacctcttggaactatcctgatgctgcactcaaagctgnnnnnnnnnnnnnnnnnnnnnnnnnnaccgctcctgcaaaaggtatgtgggctgacaacgaatctcccgctaccgaaagtgaacggaccgctgacatcggagtgcaaaaaaaccaaaacataatttgtaactgcagacagcgtaataaggccaccgattcagaaaggggaaaataaatgaaggaaaatatggtagaggaccgacaagaatacctcaacctcgaatgtggaacacacagcacgatacttgacaagctgcaactaaaaatagcagatgttaataga

SEQ ID NO: 14484 - DNA, 904 bp, Diabrotica virgifera
  misc_feature (766)..(787): n is a, c, g, or t
  misc_feature (860)..(860): n is a, c, g, or t
  misc_feature (885)..(885): n is a, c, g, or t
gtcagggaatgcgcaatagctacctcttaaaacctactaagtttcatttgcgtgtctcaaccggttttggagcaataaatgagtcgtcggtttgtgggagaaagttcaacatctcgtaactcggatcacgtgtttataaaataaacgtcggggtttgtcctggttgggtcagagggagcagcatatgtgcctcctgatgagagactaataagtttcgaaaccggtagaggtgcttgctgcactctctgattgaactggaataatgatgcggctgtagttttgtattgcaacgaaattgaaaatggttattcatttttagttaaacagaataattcaatttggacgttgcgagttgcccgttacgaatttgtatggttacgaactgtcgccgttacgaattgtcgccgttacgaactgtcgctgttacgaattgtcgctgttgcgagttgtccgttgccagttgtccggttgcgaactgtcacgttacgagatgtcatcgaaccaggcaaaacactgcctcccttgtccccaaagcgttcctaaaaccaaattgtgactcgttgatttccgcttcacacttgttgtagattctgttatatatgattgtggtgaaaactttggtgataggatccatatggatccagtctatgattttcaattccgcaaggttgctaaaaactttttatcactgatggtaaaggggctatagtattgccgaaccaaaattattgttttgttgtttgctatccaaatatatcaaaagggnnnnnnnnnnnnnnnnnnnnnngaattttcacattgcgttcatttcattagatgcaggacgtcctgtaggtctttagtccgttaagcacttctcntcctaccgtgctactctgcatatgngcaaatacattttttattc

SEQ ID NO: 14485 - DNA, 426 bp, Diabrotica virgifera
  misc_feature (27)..(49): n is a, c, g, or t
actgcttcagatctggcgacagatgannnnnnnnnnnnnnnnnnnnnnngaagggcatggtggtagcgttgacattgtgtgataatagtgatctatgtgatatgttgcagagtgaaaagtattggaatttagttgatatgatagatgtttattccttgattaagaaatttataatgagactgactgaacaatgttccgttttgcattgtacgtatagtgaaaaagatatatagtacattaaaaatgttctgacagtatgttactacaattatgctggataccgaactaaaattgaatagagtctcctccaacatttccgtattagactattttcaacaccaacgtagatatttgagtaattctagttagttacatcaactgattgtatagtatctaaaggtgtatttactacacatttgccctggt

SEQ ID NO: 14486 - DNA, 67 bp, Diabrotica virgifera
  misc_feature (10)..(66): n is a, c, g, or t
gtaaaaagcnnnnnnnnnnnnnnnnnnnnnnnnnnnnnnnnnnnnnnnnnnnnnnnnnnnnnnnnng

SEQ ID NO: 14487 - DNA, 396 bp, Diabrotica virgifera
  misc_feature (58)..(58): n is a, c, g, or t
  misc_feature (61)..(61): n is a, c, g, or t
  misc_feature (76)..(76): n is a, c, g, or t
  misc_feature (163)..(163): n is a, c, g, or t
ccctaacaggcccccgcgcatatcccacccaaaaggaaactccttttcaaggcagcgngcngcgcacgccgacggnaggcgaacgccgaagacaagacaacggccacagacactatatcagcagagacccaaaccaaggaaaaacgcggacgggcgcaggganacgggggcggcggacacgactacgggggcggcggagacaccggaggaggggacgacgggggacatgaagaaggaggcggagacgaccaaggaggacaccaagaacaccatgagaaaacagacacgggggccaagaaagcagcaggaacagacccgggcaccaaggaaggaccagagcctggagaaaaagaagcccaggaccccggcaaggggcacggacgcaagccataccca

SEQ ID NO: 14488 - DNA, 53 bp, Diabrotica virgifera
  misc_feature (16)..(16): n is a, c, g, or t
  misc_feature (19)..(48): n is a, c, g, or t
aagctggatgaagggntgnnnnnnnnnnnnnnnnnnnnnnnnnnnnnnataag

SEQ ID NO: 14489 - DNA, 129 bp, Diabrotica virgifera
  misc_feature (7)..(44): n is a, c, g, or t
  misc_feature (78)..(100): n is a, c, g, or t
  misc_feature (114)..(114): n is a, c, g, or t
taacagnnnnnnnnnnnnnnnnnnnnnnnnnnnnnnnnnnnnnntgcgacctcgatgttggatttaagttatattggnnnnnnnnnnnnnnnnnnnnnnntgttcgacttttanaattttacatgatct

SEQ ID NO: 14490 - DNA, 182 bp, Diabrotica virgifera
  misc_feature (10)..(93): n is a, c, g, or t
  misc_feature (104)..(104): n is a, c, g, or t
  misc_feature (107)..(171): n is a, c, g, or t
gtaaaaagcnnnnnnnnnnnnnnnnnnnnnnnnnnnnnnnnnnnnnnnnnnnnnnnnnnnnnnnnnnnnnnnnnnnnnnnnnnnnnnnnnnnntataaattatntannnnnnnnnnnnnnnnnnnnnnnnnnnnnnnnnnnnnnnnnnnnnnnnnnnnnnnnnnnnnnnnngatccattttt

SEQ ID NO: 14491 - DNA, 898 bp, Diabrotica virgifera
  misc_feature (5)..(767): n is a, c, g, or t
  misc_feature (774)..(811): n is a, c, g, or t
  misc_feature (824)..(824): n is a, c, g, or t
  misc_feature (833)..(833): n is a, c, g, or t
  misc_feature (847)..(864): n is a, c, g, or t
  misc_feature (867)..(867): n is a, c, g, or t
  misc_feature (883)..(883): n is a, c, g, or t
  misc_feature (887)..(887): n is a, c, g, or t
atgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatngtggattanagtttataattggnnnnnnnnnnnnnnnnnnaangtctgtcgacttttanattntacatgatctg

SEQ ID NO: 14492 - DNA, 837 bp, Diabrotica virgifera
caatttcttcgatatctcttctcctagttaaagaagactgtcgagttcaagactgagagaagacggcattactatcaacggcacaaactttttaattatcactttttttcatttcatcttcaggtacatcaaatctccccgaagaagtggattcggatattatttggataaaatatgtgttttagcatgacgaagttgacgttctacataatggtgaaactgagtggttctgcttagagatttgttgctgtgatatttgtgattattaaacattaaattttataaagttttgtgatataaaataagtcatgagtgcgatagcggctccactgtatggactaggagctgaagccgtttccagcttagcagtttttctacctaccctatgagcagctttagcttactttcagtacgaacagctcgatcctgaaagcagacccatcgatgtaccgacagaggaattgctagatacgcatgatttcataatggttggagcaggatctgcaggtgcagaggtagccaacagactgagcgagatagacagatggaaagtgctactattggaagctggtggagatgaaaccgagatatcatacgtaccactagtggctggatacttgcagctgtctgcattggactggaagtactaaagtgaacctcaaggacaagcttgtttacctatgaataatggacggtgtaactggcctcgaggagaagatattaggggatcttcagtactaaactacatgttgtatctacgaggaacatgaaagactacgacatctaggaatctatgggtaatcccggttggagccactccgacgttttgtactattt

SEQ ID NO: 14493 - DNA, 942 bp, Diabrotica virgifera
  misc_feature (170)..(197): n is a, c, g, or t
gaacattataaacttcttcaggaaaaaaattattgctcagctttagctctagcagttaaagtaattagtgtgtcaatatcttccgctattaacgatatcagtgtctcccgtactgctgcttgcaattggttgatacattgtactgtcatttatgttttaagattcagaannnnnnnnnnnnnnnnnnnnnnnnnnnngtaaaacttctatttatataatatctaatatttgcctctaacaagtgtttctaaagtgacattataagaaggagaaacaatttaacagagctaacaaaaacgtgtgactgccatttgatatttagccatgtggttagtcaaagattttccagatgtgtattactctcactattaatgttatgtataatacgaaaacgtaatgtttaatgattttcattactgtagattttaattaattacaacatatttataactattacacagtgataagccacaagctaaacaaatcaaaatgaaagcctattttttctttttaatatacagggatggatattcaagcagtaaacttttagtttaggttgcaatcattagagcgatttttacttttgagaccgcggctctaaataatttcttgttactacatccaaaccattacctgagcttcttcatccatgagttaagactcattcatatggatctttttccctggatttttccttgcctaatgacctggagtgttagatatttatctcctctcatcacatgtcccatatatctcattgttcttttctcattacctctacgttagtttatgctatctaccgatgagatgttcagcactcttctgtacatccacatctcgaatgtttccagtctcctcacgttaattttctttagtgtccacggttccatcccgtagtataataccgatagcacatagctccctcacagtcgtatttttaac

SEQ ID NO: 14494 - DNA, 496 bp, Diabrotica virgifera
gtaggcttttctttattttcttttccttctacgtcgtccatttcgtcctcactcgctttgcgttttttgccttttgaaggctttcccttcttttctttttctccttgtttttcagaataattatctggataaacaatttcatcttcatgaccaccttcttcccatggtgctggattggggtcatccctcctcaacaaatatctgtataccaaaaatccagactctcccttctctggataatatttaactactttgtaaataccatcgtaccgcaatccatctttggggctgaattttgagttaattttaggattacccttccgtacaactcgtaccggcaaaccagctctccaatcagttgcttctgccccatttttgtcaagtggagcattgcaattaagtgctaaagccatattgcctcgtttaaattcttgatccatgctctgcacatttactcgtttatttccacttaaatctctgcctccacttcccgtgt

SEQ ID NO: 14495 - DNA, 977 bp, Diabrotica virgifera
  misc_feature (97)..(136): n is a, c, g, or t
  misc_feature (237)..(260): n is a, c, g, or t
  misc_feature (476)..(499): n is a, c, g, or t
  misc_feature (512)..(529): n is a, c, g, or t
  misc_feature (563)..(585): n is a, c, g, or t
  misc_feature (809)..(830): n is a, c, g, or t
  misc_feature (908)..(927): n is a, c, g, or t
  misc_feature (956)..(956): n is a, c, g, or t
attataattggtggttttggaaattgacttgtacccttaataattggtgctcccgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgtttacccgagcttattttacctcagcaactataattattgctgtaccaactggaattaaagtatttagatgattagctacttatcatggaactactattacatatagtccagtaacactctgagctttannnnnnnnnnnnnnnnnnnnnngtggaggattaacaggggtagttttagcaaactcctcaattgatattgtacttcatgatacctattatgttgttgcannnnnnnnnnnnnnnnnnnntataggagctgtatttgctattatagcgngatttatccaatgatttcctt

SEQ ID NO: 14496 - DNA, 585 bp, Diabrotica virgifera
  misc_feature (544)..(544): n is a, c, g, or t
gttgatgtaaggcaagagttggatttaaggacaggtgccgcttttaccagattacagactttaagacttcaaaaagtatttccacagaagctggctgataaactgatcagttatggatcatgtcagtttccgacactaggatttgttgttgaaaggtatcaagcaattgaagattttattgctgaaccattttggaggataaaaatgtctcgtactgttggtgatattaccagtgatttcaactggaaaagagatcgtttatttgataaaaatgcttgcgaagctatattagatatttgcaaagaaaatcctgtggccactgtagagaatgttgaaggtaaagagaaaagtaaatggagaccactacctttggacactgttgaaatggagaaaaacgtttcaagaaagctaaaaatcaatgccaaagataccatgcaaatagcagaacgactgtacactcaaggttttataagctatccacgtacagaaactaacattttcccgaaagaattgaatctcggcagtttggtacagcagcaattanatgataatagatggggtacctttgctcagaggatcattgac

SEQ ID NO: 14497 - DNA, 906 bp, Diabrotica virgifera
  misc_feature (819)..(820): n is a, c, g, or t
aaaatatttaccaaataaatatgataccagaattatggctagtcggcaatatcgttactgtaagacttacgaggatacatctagataaatacaaacatttattacaatggaagaaaagtgagtcgatcttggaattcggatgcggagatggacaagtttcggaaaaacttttgctgcccgttcttccaaaagattacaaagagtacgtggcgatggataattccaaagaaatgcttgaccactacaaacagcatgttaatattcctaggttacaagcggtgcatcgggacatctctaccaaacctttagagacctgctggcgaagcagatttgaccatgtttttgagttgtttgtgatgcacatggtgcaaaatcccaggtcagccatcgaaaatatccaaagtatgctgaaaccaggtggacaagcgtttttgacgttttttgagcgcatgccggtacataaaacgttcgaagcgcttgaaaaacatccaaaatggggaaaatatggcacgttcttatcgaattataataccaattcaaatccaaaacttgagtacgaaagtgatcttaaggcagcaggttttaagaattatgttattcacgcagaagagccggtcggatgtacattcgacgatgaagaatcatataaaagtaagtgtgtattgtaacgaaaattaacgcacgattaaatttatttttctgcgaccgtttaataatatgctcattatttagtatttttcgatagataataagactcattactttaccgtgagtacaattcatttacccacggctgaagtactcacggcatactccggnntgagtagatcagtggtgatgcactttatatactcaatatcagcataatactaactcgtattataatatcatgtatattcacatact

SEQ ID NO: 14498 - DNA, 202 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagggac

SEQ ID NO: 14499 - DNA, 551 bp, Diabrotica virgifera
  misc_feature (6)..(59): n is a, c, g, or t
  misc_feature (61)..(85): n is a, c, g, or t
  misc_feature (87)..(112): n is a, c, g, or t
  misc_feature (115)..(129): n is a, c, g, or t
  misc_feature (163)..(185): n is a, c, g, or t
  misc_feature (193)..(216): n is a, c, g, or t
  misc_feature (252)..(283): n is a, c, g, or t
  misc_feature (285)..(303): n is a, c, g, or t
  misc_feature (305)..(338): n is a, c, g, or t
  misc_feature (340)..(370): n is a, c, g, or t
  misc_feature (386)..(445): n is a, c, g, or t
  misc_feature (470)..(504): n is a, c, g, or t
gaatannnnnnnnnnnnnnnnnnnnnnnnnnnnnnnnnnnnnnnnnnnnnnnnnnnnnngnnnnnnnnnnnnnnnnnnnnnnnnngnnnnnnnnnnnnnnnnnnnnnnnnnngannnnnnnnnnnnnnnctgaacatttttttcacctgatgattaaaaactnnnnnnnnnnnnnnnnnnnnnnngtctctannnnnnnnnnnnnnnnnnnnnnnnacggggtattttgaccgagctatggcattataatcnnnnnnnnnnnnnnnnnnnnnnnnnnnnnnnntnnnnnnnnnnnnnnnnnnnannnnnnnnnnnnnnnnnnnnnnnnnnnnnnnnnnannnnnnnnnnnnnnnnnnnnnnnnnnnnnnnagaccctataaagtgnnnnnnnnnnnnnnnnnnnnnnnnnnnnnnnnnnnnnnnnnnnnnnnnnnnnnnnnnnnngatgcggtgattatgaaataaatannnnnnnnnnnnnnnnnnnnnnnnnnnnnnnnnnngtttgatccaattcttttgattataatagataatcaccttagggata

SEQ ID NO: 14500 - DNA, 823 bp, Diabrotica virgifera
  misc_feature (490)..(516): n is a, c, g, or t
  misc_feature (797)..(814): n is a, c, g, or t
tgctcttgacaccatcgtaaattgctatttcttacataatcagtggttatcttcctactgaaataggtacagtagttagttacattaccattacagaccttaaagtacttacattacgttaaaaaaattgcaatcttgatctagagatgcctacctacaaagtccgatattttgacatagctggaagaggagaacctattcgaatgatgttgagttatggacagatccctttcattgatgaacgtatttctaatgaagattggtccaaaattaaaccaactacgcctttgggccaggttccagttctggaaattgatggaaagcaaattccgcattgcattccgatttgtagatatttagcttcaatcgtaaacttatcaggaagtgacgcgacagaaaatcttgcaattgatgttgctgtagaaacacttgttgatttgggcaaccttgcctatgaagctaaacgagaaaccgatgtagcaaaaaagcnnnnnnnnnnnnnnnnnnnnnnnnnnnccctgtcccttttccttggaaaacttgaagagtatgcacaaaaacatggtggatacattgcattgcctaggttatcctgggcagatattgtatttacctgtagttatgaagcacttatgaatagaacaggtgtagatagctttaactcctatcccagtttacaaaaagtaaaaaacaatgttttggctcagccgggtattaaagaatgagtgaaaaagaggccagtgaaccctatgtacactctatatagcttaaaagaacatcttttgtaatacaaatgnnnnnnnnnnnnnnnnnngcttgtttg

SEQ ID NO: 14501 - DNA, 940 bp, Diabrotica virgifera
  misc_feature (87)..(110): n is a, c, g, or t
  misc_feature (123)..(140): n is a, c, g, or t
  misc_feature (174)..(196): n is a, c, g, or t
  misc_feature (422)..(442): n is a, c, g, or t
  misc_feature (605)..(653): n is a, c, g, or t
  misc_feature (786)..(786): n is a, c, g, or t
  misc_feature (793)..(813): n is a, c, g, or t
  misc_feature (870)..(870): n is a, c, g, or t
agctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcatattttcattatgtattatctataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattgnggtattnnnnnnnnnnnnnnnnnnnnnagaagctttttctttttcacgaaaaagattaagacctttaagaataaatttcttcanttgatgactacaatttaacccctcagctgaacacagatattctgaatttgccatattatcatcaaataaa

SEQ ID NO: 14502 - DNA, 272 bp, Diabrotica virgifera
  misc_feature (41)..(58): n is a, c, g, or t
cccacgcgtccgcctgctcaactattttttacgggagctcnnnnnnnnnnnnnnnnnncataatagaaacaagttaatacaacatgaattttctctttttttaaccgtccagactaccgtatttcagactctacagaacaatggaatcagatcagcccctgaaactttagaaaaaaaacaagccaggggctatgcagctacgaaaggaaccaaagatcgtacgaggaagggtaaagtaaaagtagagaaccaaaaagttgggttaataccac

SEQ ID NO: 14503 - DNA, 494 bp, Diabrotica virgifera
  misc_feature (3)..(84): n is a, c, g, or t
  misc_feature (91)..(115): n is a, c, g, or t
  misc_feature (117)..(143): n is a, c, g, or t
  misc_feature (145)..(203): n is a, c, g, or t
  misc_feature (212)..(235): n is a, c, g, or t
  misc_feature (247)..(270): n is a, c, g, or t
  misc_feature (279)..(312): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnntttttgnnnnnnnnnnnnnnnnnnnnnnnnngnnnnnnnnnnnnnnnnnnnnnnnnnnngnnnnnnnnnnnnnnnnnnnnnnnnnnnnnnnnnnnnnnnnnnnnnnnnnnnnnnnnnnngaagtttgnnnnnnnnnnnnnnnnnnnnnnnnatgaggattggnnnnnnnnnnnnnnnnnnnnnnnngattattgnnnnnnnnnnnnnnnnnnnnnnnnnnnnnnnnnngtttgtattaaaatatgaatttaaattgtttaaatgtagtaatgatgagaatattagaattaagaaattgtgtatttagtaagaagatataggggtaataaaggaagtcggccacatttttttccccggtttattgagaacatggtgttttggcatttaagtataaagaactcgcctgcccc

SEQ ID NO: 14504 - DNA, 132 bp, Diabrotica virgifera
  misc_feature (13)..(61): n is a, c, g, or t
  misc_feature (66)..(85): n is a, c, g, or t
  misc_feature (94)..(94): n is a, c, g, or t
gttaaaaagcttnnnnnnnnnnnnnnnnnnnnnnnnnnnnnnnnnnnnnnnnnnnnnnnnncaatnnnnnnnnnnnnnnnnnnnncatttatantcataatttatttactcgccgtgattacaaaataattc

SEQ ID NO: 14505 - DNA, 424 bp, Diabrotica virgifera
atttggtattaccctgtgtaataacccctgctatctgttgcatctccagttgatgctcctatataatttttcggtgtaactggcatattcaacaatatctctgccacctcccatctgctgcgtgacttgtctactgcatgaactatcccctgacgctctagaagcatatcattcatatttgatccacaggaaacttctccccatggtgctatctaagatgacaggatctacgttagaaattttatgctccatgatgcctgcactccacatccctatgacctccacatgagaatgcagtccctaaacccctgctacatggagccaatgtgcaattcgtatgtagttctggcacaaaatgaaactttgttggtttgcaaataaatcttctattacaccccaatctccacgtatgcagatatggcgg

SEQ ID NO: 14506 - DNA, 621 bp, Diabrotica virgifera
  misc_feature (17)..(20): n is a, c, g, or t
  misc_feature (25)..(25): n is a, c, g, or t
  misc_feature (27)..(27): n is a, c, g, or t
  misc_feature (53)..(53): n is a, c, g, or t
  misc_feature (70)..(70): n is a, c, g, or t
  misc_feature (85)..(85): n is a, c, g, or t
  misc_feature (94)..(528): n is a, c, g, or t
  misc_feature (542)..(577): n is a, c, g, or t
cctttcacgcgcccgannnncatcnancccaaaagaacaaacctttttatagnaaaaggaaagaaaaagnagaataaaggatagngaattaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcaaatttaannnnnnnnnnnnnnnnnnnnnnnnnnnnnnnnnnnnctagtagaaatatatagggttaactaaggcattcggcaacattt

SEQ ID NO: 14507 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (174)..(191): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttggtttctatctttatttnnnnnnnnnnnnnnnnnngaaaggac

SEQ ID NO: 14508 - DNA, 737 bp, Diabrotica virgifera
  misc_feature (288)..(305): n is a, c, g, or t
  misc_feature (480)..(497): n is a, c, g, or t
  misc_feature (602)..(710): n is a, c, g, or t
ttttacgccgccgccgaactcgtgccgtggagaggaaaattccttttttaaaagttattaaaaatagaatgtcgcagggcagccaaccgtttcgttatctgctcaaattatggtatatctcatgatgggctcgtagaaagttaaagctcgaacatcctgaatatggggttatagaacttaccaaagaattgagtagaaggagggctgaaggagaataacagaccaaagggaaatatgatgatttgctcgaggaggacaaagccagatatgaaaatgaaatgactgcannnnnnnnnnnnnnnnnncccgccttataacaagtgagacaaccagtacctgttgaatacatacatgaagaaaatgagggggtagatgactgtgaacaatagttatcctgtaagataacatctctcggtcgaaatcgccttctcattcctctatgggaaatatacatgatagcaagtgtatcaatcaagatcnnnnnnnnnnnnnnnnnnactaaacgaagaagtgtgtacttagaaaactgacagtgtgcgtagtgaccgactaaaatccccctttcattcatatttttttattctttttaatgtgacatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactgaactccaaacccgtcaatttt

SEQ ID NO: 14509 - DNA, 915 bp, Diabrotica virgifera
  misc_feature (366)..(380): n is a, c, g, or t
  misc_feature (610)..(630): n is a, c, g, or t
  misc_feature (834)..(834): n is a, c, g, or t
  misc_feature (885)..(885): n is a, c, g, or t
aactatttgaagacttttggaatatcggtgacctcaccaaacagcgctactacattaaaacttgcatgggagtggttaagccgaaatattcattgcacaatgcgaatagtactcgatcattgaatgtgtcatatcattttacaatacatgcagagaaaattcgagtatgtaaacgattctacacagcaacgttggatataggacattcgtttttatctacagttaataagttatctaattcgagtgggataataccggaggaccgtagaggacatcacggcaatactggtaggtgtctatcagacgatgttaaagatattgtccgagaacacataaattcttaccctagaaaagagtcacattatnnnnnnnnnnnnnnnagtaaggaatatctagatggtgatttgaatttggctttgatgtaccgccaatataaggaatggtgtcatcaaagtgtaccaaagtaaacgaccgagaggaagaccacagctgagatgggttgatgatattaaaagagtagccgaaacgaattggaaatatgttgctcaggatagagaccgatggaaggagttgggagaggcctatgtccaaacgtggacgatagaaggcnnnnnnnnnnnnnnnnnnnnntcatcaaaataacaaatttaaagtcaaacaaggaacttacggacacatttttcgaaatgaatttaacattgcgtttcataagccaaagaaagaccaatgctctttgtgtttgtcctatcaaaatgctacaggtgatgagaagttacagttgatgtgtgcctatgaacagcatttgaaggaaagagatttgtgccgagaagaaanaagagctgacatagcatcatgcaaaaatgatgaaagtaaaataatatgctngtatgacatgcaagctgtccctgcaacacc

SEQ ID NO: 14510 - DNA, 90 bp, Diabrotica virgifera
tcagtcattgtcaaaatatttgtgaagtttggaacaatagtaaatgaattctaccctgtctataaagatataacctttggtgtggccctc

SEQ ID NO: 14511 - DNA, 194 bp, Diabrotica virgifera
  misc_feature (7)..(102): n is a, c, g, or t
  misc_feature (104)..(105): n is a, c, g, or t
  misc_feature (108)..(144): n is a, c, g, or t
  misc_feature (146)..(159): n is a, c, g, or t
aagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnggnnnnnnnnnnnnnnnnnnnnnnnnnnnnnnnnnnnnnannnnnnnnnnnnnntccattttttttgatatagaaataataccttaggg

SEQ ID NO: 14512 - DNA, 135 bp, Diabrotica virgifera
  misc_feature (2)..(21): n is a, c, g, or t
  misc_feature (29)..(55): n is a, c, g, or t
  misc_feature (57)..(111): n is a, c, g, or t
  misc_feature (124)..(124): n is a, c, g, or t
cnnnnnnnnnnnnnnnnnnnncatatacnnnnnnnnnnnnnnnnnnnnnnnnnnncnnnnnnnnnnnnnnnnnnnnnnnnnnnnnnnnnnnnnnnnnnnnnnnnnnnnnnncaagctggaatgnaagggtggatg

SEQ ID NO: 14513 - DNA, 907 bp, Diabrotica virgifera
  misc_feature (205)..(222): n is a, c, g, or t
ttgcaacactataagtaagtcagaaaattatgaggttacagtaatacttcggacagtttactaaaaaagaacatttacactattaacctaatttaaaaaaaatgacaaaaaagtaattttaaacagtctaaaattattttgcaaaaagatgtcgattttttgcttacttataaacaattagaataactttttaaccgttacccannnnnnnnnnnnnnnnnntgtttagaaagactgaatttgtatacacatttagaaagaaaaacaattgtcctaggacaattagggacgaatttagcgcccccctttttttaattcatattgcaaaataattttgcaatatttttaaattaaattaatagtgtaaatcttcttctttcacaaactacccaaagcattactgcaacgtcatcattttctgacttgtagtgttgcaaaaaaagttaattttggataaacaaattacaacctttaaactatttgaccaattgctttgaaatttagggtatcatttaagcaccagaagtctcaacattccgtgtaataagaaggttctaagccaattcctacataagtcatgaatacctatataaacccaaaacccatgaattatccgcaattctccaagcaaccaataaggatatacatagtcagcgaacgccatattgaagttctttatacgatctatgagcttcctactctcaaatttgtttaaaatgctcaactttttggtaatagacgaaaaaagcgaaaatttaccgttatttgatcttttttttttcttgggtttgcccgaaccgactaactgggggtttgaaacttataagtaacgggttttttttaaaacctccaaaaaaaggctggcaaaacttaaatattttctaactttgttctgaaaaagtaaaaa

SEQ ID NO: 14514 - DNA, 596 bp, Diabrotica virgifera
  misc_feature (13)..(74): n is a, c, g, or t
cccacccccccgnnnnnnnnnnnnnnnnnnnnnnnnnnnnnnnnnnnnnnnnnnnnnnnnnnnnnnnnnnnnnnttattttgcctattattttaacttctaaattacaccggattcacactggcttcccttttgaccttcattgtgacaagagaagtggtccccggggggggccccctagggagggcccctccgtttacgcctccctttcttggttttcgtcatggggagggaaatcccgaccacaccttcctaccctcttgggttgcaggacttcccaaaatgccccccgatttggtgacaggttccgccctgggatccgccccgtcccccaaaatttccccccctactttcccccccactttctccaaaacttggcgcatacattcccccaaagggcccgcgagtggggcattaacttgcgccttaacctgggctttaaccccggttacaacccccggattctctaacccacccggttcccctccggcttctcccaggagttcccccgcgaccccctgggtgtccaattgcccggaaagttggccggccctgtgcctggcccccgccttgacaccccctttggccaaacctttt

SEQ ID NO: 14515 - DNA, 899 bp, Diabrotica virgifera
  misc_feature (10)..(802): n is a, c, g, or t
  misc_feature (820)..(820): n is a, c, g, or t
  misc_feature (828)..(884): n is a, c, g, or t
  misc_feature (889)..(889): n is a, c, g, or t
gactagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaccaagcttcaattnttttaccnnnnnnnnnnnnnnnnnnnnnnnnnnnnnnnnnnnnnnnnnnnnnnnnnnnnnnnnnatttnatttatatat

SEQ ID NO: 14516 - DNA, 983 bp, Diabrotica virgifera
  misc_feature (30)..(51): n is a, c, g, or t
  misc_feature (871)..(871): n is a, c, g, or t
  misc_feature (883)..(883): n is a, c, g, or t
  misc_feature (931)..(931): n is a, c, g, or t
gtagtcgtctgtttttgcatgaaagttcgnnnnnnnnnnnnnnnnnnnnnnaacatggcaaatttaagacaaactcctttaacttgtagtggacatacgagacccgtggttcatctagattttagtgaagttacagacagcggatattatttaatttcggcgtgtaaagatggcaaacctatgttacgtcaaggcgataccggtgactggattggtacatttgagggtcataaaggagctgtttggggagtagccttaaacagtgaagctacaagggctgctagtggtgctgcagatttcacgggaaaagtttgggacgcaatttctggggaggagctacactctttccagcacaatcatattgtgaagagtgtagatttttctagggattcaagctgtatggttacaggaagtaatgaaaaacttgtgcgaatttttgatctcaataaaccagaagctagtcccgaagttttcagtggtcacacagcaggtataaggcatgtgcagttttttagaaatgatactcatcttatttcttgtgctgatgataaaacgttgagagtatggaatcgaggaacgggaacggaagttcaaaaagttgattttagttctactcctaatagtcttgaagtgtcaaaagatggaagtgttttaacagtatcttattcaaaccgtgtgattttcctagacgctgaaactttaacaaaaattagagaattttcgataccatccactgtaaattctgcttcccttcatcccgacaaaagcatttttgttgccggaggtgatgatttgaaagtatacaaatttgactacactactggaactgaaatagaatctttcaaaggtcattttggacccgttcactgtngtaaattctctncccgatggcgagtatatgcatctggatcagaagacggtacattgaggntgtggcagactactggtggcaaaacttacggcttatgggaaatgcgtgatgg

SEQ ID NO: 14517 - DNA, 768 bp, Diabrotica virgifera
  misc_feature (645)..(645): n is a, c, g, or t
  misc_feature (658)..(658): n is a, c, g, or t
  misc_feature (696)..(696): n is a, c, g, or t
  misc_feature (725)..(725): n is a, c, g, or t
  misc_feature (727)..(728): n is a, c, g, or t
  misc_feature (740)..(741): n is a, c, g, or t
  misc_feature (744)..(762): n is a, c, g, or t
agtttgtgtattttgtctgtcagctacactcctccatattttaacatttccgctgctatagaatcccttcctggatatttgttgttttttttagattcttaataacaattacaacttcatttagggatggccctagatcttccgtacagtagtttcgcctattcatttttaagtctgtgtattattcattatcgtggcctaagtcttttctaccatcagtgccttattcattgttattatttgcatattccccatttaaaaattcatcaatatgttattttcatcgtcttaatatttcttggtcatcaaatatcattttttattctttatctttgtaataattaggctgcggtttatattcccttttttgatttttttagcaaaccaaaaaatccagaattttttttaatccgctaacagtaatattaattttcacttttatacaaattgctctgcaacaacattaatttcaaccaaattgtcaaaaagacggacaagcaaagtaaaatgaacaattaatgacagattatataaaacttctgcgttatatttggtaattattcagactacgagatggccgaaagttatcattttttacaaattactcattaacgtataacagattccataaggcatttttaccanacccctgaataanagatgccaaagtggtaatgagacaataattatgtaganttgtatgggcacgcgagaatccccgcatntnnctaatattaccnnatnnnnnnnnnnnnnnnnnnnctaaaa

SEQ ID NO: 14518 - DNA, 874 bp, Diabrotica virgifera
  misc_feature (686)..(705): n is a, c, g, or t
  misc_feature (809)..(833): n is a, c, g, or t
cagttggtgcctgtggcgccaaaaatggatatcaagatcaaaaaaggattgtcgggggacacaacgctgaggtcaatgaatggccgtggattgcagcactttttaatggaggaaaacagttctgtgggggatcactgattgataacaatcatatactatcagctgcgcattgtgtagcacatatgagttcctgggatgtcgctaggctaacagtaaggctcggggatcacaatatcaaatccaactctgaaacaagacatattgaaaaacgagttaagagagtcgtcagacatagaggatttgattctaggaccttatacaatgatattgcaatcttgaccttggatagtccagtggattttaaccagcaaattagatcagtttgtcttcccaccagcagtaccgatcccacagggaaaactgggacagttataggatggggaagtttaagagaaagtggaccacagccagccgttttgcaagaagtcaatattccaatttggaacaatctaaactgcaagtccaagtatggtcctgctgctcctggaggtattgttgagcatatgctgtgtgctggtgaagctaacagagactcctgtagtggtgacagtggcggcccccttatgatcaacgatggcaaatgggttcaagttggtatcgtctcatggggcataggatgcggtaannnnnnnnnnnnnnnnnnnnataccagagttgagaaatttttaccttggattcaaaagaaccttaaataagtagtgatataagggagtaaatattttctatgaaaaaaaagaagtaaataaagnnnnnnnnnnnnnnnnnnnnnnnnncttagtacataattaataaaatatgtaaggaatattcatct

SEQ ID NO: 14519 - DNA, 659 bp, Diabrotica virgifera
  misc_feature (132)..(223): n is a, c, g, or t
cttggacgtgaattttcgttttatggatctttcctttaaatgggggctgagcatatggaacaaagctgataggtctgtggtatactcttgaattgtggtcatagttcctgtctcccccatgacattcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttactcttgtttttgacaacacgatatatagaatattcatttctcaagacagtttagtttgctttagatgcaagaaaccaggtcacattgcatcacagtgctccgaaacactagctcaactaaaccccaaccaagtcaatgaagcatcggtatccagcgcaacaaatatatctttgcaagcacccaatgatacaaacccttctcagtgtgaacaaatgtctatttctaatgttctggccacaaagtacatgcatcaaataaggacagtcccataattaaatcaccaaaaccaactttgatgaaattatttcgccctgaatagatccatctttagaataatgtgacatttttccacccccattagtccaagcaaaatcaagaaaagccaaaattagtatcagcaaaacacttcatgaatggctcattatctcctct

SEQ ID NO: 14520 - DNA, 917 bp, Diabrotica virgifera
  misc_feature (790)..(790): n is a, c, g, or t
  misc_feature (809)..(809): n is a, c, g, or t
  misc_feature (882)..(882): n is a, c, g, or t
attattataaataagtaaaagtgcattccacactgcatattaatttataattttatcgaataagagcaaattttattacttgtaagcattaattttgcgatatattttaaataagtgtctaaaatgcacaagaaacaagcatcgtctgactcgcttgaaatcgctcccttacgaactttggacgattttctattagaagcggctcgttttcagattccaaatgtgaaagatttagaaaaatggggcaatagggtcactcaaaatttgctctactaccaaaccaactactttttgatgtccatactaattttcatcatcgtgggagttatacatcccattaaaatggcttgtggagtattagcaactgctgtactgtttatgatattcttatatgttaccaatgagaaagtaacagcagcacaatttaaaaggaaacacccaattatttctctcattattgtttttgctggagcctattttatagcatatatgcttcaatctcttatggttttccttcttggagttctcctaccagttgcagcaatctttgtccatgcctctttgagattgagaaacttaaaaaacaagattgttaacaaagtagaaaacttgggacttcggacaacacctatggggttttttcttgaagagatgggattggaaagtgatcttttctgagaaacggtgtaaagattcaagttatcccatttgtgatggtttcatgtgattcttcagaagtgcactagactgttttatatcagtataaaaaattactataagaataccctanaatgggctactaatggtgngaaatcacgtacagagaatagaaacaacctattattaaatcttacatttacgatataatgcaaagtaagtagntttaagcgtttagcttttagtgatatatattttga

SEQ ID NO: 14521 - DNA, 186 bp, Diabrotica virgifera
  misc_feature (2)..(40): n is a, c, g, or t
  misc_feature (44)..(177): n is a, c, g, or t
cnnnnnnnnnnnnnnnnnnnnnnnnnnnnnnnnnnnnnnncagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttttt

SEQ ID NO: 14522 - DNA, 260 bp, Diabrotica virgifera
ggtacggtgagtgagaatcattttgatccaaaagatgagaggagttctgctcacaaggaagtaaataatggagatgcagaacaaaccattgaaatgcaccaatcaattgtgtagaccgacggagggaaaattgaaggggatgtattagacacacttttgatggtgatgagatacatggattccttggaactccttacatttaaccggctttaggagacctaggatttaatgctccacaaggctcgcagaactctctgtac

SEQ ID NO: 14523 - DNA, 187 bp, Diabrotica virgifera
  misc_feature (10)..(186): n is a, c, g, or t
gtaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 14524 - DNA, 873 bp, Diabrotica virgifera
  misc_feature (496)..(508): n is a, c, g, or t
  misc_feature (510)..(528): n is a, c, g, or t
  misc_feature (540)..(558): n is a, c, g, or t
gggtgtaccaaaagtagcgggatggtcgaatatttcgcgaaatgaacgttggatcgaggaactgagaaatatgtgttcaatatttttcaaaaatctatcaaatgataccaaacacgactccccacgaccgcatggaagtggggtggaggtaactttataatcttaaatagactcacatgttttatttattgcagattttgattccgtacgtaaaagtgagcaacttttattcgagacattttttttaattgtatgtatggcgctataatcggctataattgcataaatataatcggctataattgtaatacatggagctataatcggaaaaatgacttatcgtgagacactaggtaaattatagaaacggtctaatatctcgagaaatatacttccaagtaaatccaaaaaccatgtgtttaatatttatcaaaaacctatcgaatgacaccaaacactactctccacttgcacccacgggggattaggcggtacnnnnnnnnnnnnngnnnnnnnnnnnnnnnnnnncatttatccaannnnnnnnnnnnnnnnnnngatagatggcgctataatcggaaaactacggtttattggcggcatctatcaacagttctaaaaaatgtttcgaataaatgttgcttactttttcatggggaatccaactctgcaataaaaaatgggtgttcctatttaagattgtaaagtagttatccccccaccccaccctccagggattggagagggggggtcgtgtttggtgtctttcgatggatttttgaaaatattgagcacgtatttgtcagtttttcgatccgacgttcatttcgcggaatattcgaccgatccgttactttttgggaacccttatat

SEQ ID NO: 14525 - DNA, 835 bp, Diabrotica virgifera
agtccaggaaacaacacgcacctgtctgtattattcctttattttttatttcaaactgtgttagcattgtttaagaaagactatttaaaacattcttttttaatcaatggtctcagtttactgtttttaatacataacaaaaacatccctcggattgtgactgtatgaatacggtattgtggtattgttcgcttcggtatgctttgcgtcattaaatcgatggaatgaacgacacaattttggacgaaattcctcaaccaaaggaaacggtttgaaaatctaatatgaatgaaaccaatacaacccaagaggtgccacctgattggagcaaaaaatatgggactttttcgctatcaagaatttcgtagttataggactatacattccagttttattagtagcagcaactgccaatttgctgtttattgctattgtgattaagcacagatacatgagacgagccagtacttatttgttaatcaatttgtcaatagctgatttattgataacattgtttgctatgccaaacgcaatgtggagtgcatacaccccactgtattcccttggaaaggtcggatgtaaactactgacgtatatacaatgtgtatcagtatcaactagcatattaaccattacagcaatgtctctgcaccgatattttgctattaccaaaccgttatttggattgatatacccttcttttaaccgatgcagtacagctatagttatcatttttttatggattctttccatggcaattttttcaccattattatgggtcaatcaactagaagaggacgttcttcctatgcccgggaatgccataaccgtatat

SEQ ID NO: 14526 - DNA, 956 bp, Diabrotica virgifera
  misc_feature (89)..(105): n is a, c, g, or t
  misc_feature (619)..(638): n is a, c, g, or t
  misc_feature (710)..(728): n is a, c, g, or t
  misc_feature (788)..(788): n is a, c, g, or t
  misc_feature (848)..(848): n is a, c, g, or t
  misc_feature (874)..(874): n is a, c, g, or t
ggtagctacacattcttcttcattatcactcaatactacttgctgatcatcctcttcacttgcttccgaaagatgatcttcaatttcannnnnnnnnnnnnnnnnaactacttcaggagattcttcatcatcggaatcccataaattattatcaatatcttgcagttctgcagctgataatggttttcgggacattttattcgcactatctactttcactgtaattcaatataattttactggcttagtagttgtcgacactgacatcggtatcaaacgactggtagcagatgcgttatttatttcaaaatatgtataggtacctacctaaaaatattattacattccaacaatcattatcagtttttataattcatttagaatagctataacacctattgtaagcatctctttgatgttcacatcaaagagattgatgtttaaattgtttgttgcacgtttagactttattattggatttccggaatcataaaagtcttttacataatccacaaaaacattacctgactgccagattaacttctgtaacaaagatttagactttaggtataaatacaagtattgcccctttacgtgacaaaattatttcgacgcaatnnnnnnnnnnnnnnnnnnnnatattttgaatagctcatgactatgttgaaggaaacacacttctaaacaaattcagtgatgcataaaattcnnnnnnnnnnnnnnnnnnngtttatgataaaagaattgccctccgggcccaccttgcccggataagggttaaacattanattgttaataacaaattatctgaaggcttttcagcgtggtacccgcgaaaaatcgaattntaaaaaaataaaaagcttaaggtacngagggcagataaagtacatatcaactcaccctggctcctaggcctagggtaatatactatggagaaatattttcaacccgtt

SEQ ID NO: 14527 - DNA, 116 bp, Diabrotica virgifera
  misc_feature (15)..(44): n is a, c, g, or t
  misc_feature (52)..(72): n is a, c, g, or t
cacatttttttaccnnnnnnnnnnnnnnnnnnnnnnnnnnnnnnattatccnnnnnnnnnnnnnnnnnnnnnctcatttatcatataaattcatttactcgcggtgattacaaaat

SEQ ID NO: 14528 - DNA, 713 bp, Diabrotica virgifera
  misc_feature (278)..(296): n is a, c, g, or t
cattatttgttagaacgtctttatctaaattatgaaaccaaagaaaatgatgagaaaactaaaagcaactaccaaagtaatatagtatttgctagtagtcattttaaagcacaaaatagagtattgcagttaaaacattcatttgaaaataaatatattcctaaagaaaaaagtaacagtgataaaagtagagaaactaagttacccaataaatcaatgagcaataaatttgacaagttgaatggtacaaataatatttttgaatctcaagttgaagnnnnnnnnnnnnnnnnnnntgttatgtacggggcaaacaaagtgtcaaaacctaaggagtatgaagaaaaaggacgaaatcaggaaaacgagctggctagcaggattcaaaagttttttggtaaaacttcgtctaacatagatacagaatcttattcggatacagaaataccttctaataatgtaataccacacgaagaacacgaaaaaattcaggaaagtgaactggctagcagaattcaaacattttttggtaaaaattcgtctaacgcagataaagacacttattcggatatagaagtatcttctaataatgtaacaccacacgaagaaaaccaacaaaatcacgaaaacgagctggctagcagaattcaaaagttttttggtaaaacttcgtctaccattaaagaaacttattcggatatcgaaatacctga

SEQ ID NO: 14529 - DNA, 100 bp, Diabrotica virgifera
  misc_feature (11)..(33): n is a, c, g, or t
  misc_feature (63)..(94): n is a, c, g, or t
gtctgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 14530 - DNA, 241 bp, Diabrotica virgifera
  misc_feature (4)..(101): n is a, c, g, or t
  misc_feature (106)..(126): n is a, c, g, or t
  misc_feature (129)..(171): n is a, c, g, or t
gctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggnnnnnnnnnnnnnnnnnnnnngannnnnnnnnnnnnnnnnnnnnnnnnnnnnnnnnnnnnnnnnnnccacaatttttttgggtttataagaaataaaattaacccttagggcgggaaccagggggaaaattttttt

SEQ ID NO: 14531 - DNA, 478 bp, Diabrotica virgifera
attcccttagcgatcgctggtctcttcctattagctaagaaagccctcattatctcgaagatgcgagatcctggtgacagagtttttaatcgttataaaataccaagtactttttcggggcagaggtgtgggcggtgaatgataatcagaaagatataaataattaatggaaattgaaagatggatatgtatataaatttaatatggaaaaaagagacagcgaatcgtttggagcaagaagaaaagttataggcctcaaattatagcacaggatgcgaagatggaagttaaatcgattgaatagaaattatgattataacgaaagatatttatatgataatattgtaaattatgatactgataagcataaaaatacgcacgtcatacatactttgttttccaaaatgaaatgaggattacgtaacgttcagctactataagaacggatgacctaaccgttcgagtatgattatattta

SEQ ID NO: 14532 - DNA, 935 bp, Diabrotica virgifera
  misc_feature (11)..(29): n is a, c, g, or t
  misc_feature (72)..(89): n is a, c, g, or t
  misc_feature (193)..(214): n is a, c, g, or t
  misc_feature (241)..(261): n is a, c, g, or t
  misc_feature (708)..(709): n is a, c, g, or t
  misc_feature (795)..(812): n is a, c, g, or t
  misc_feature (887)..(888): n is a, c, g, or t
caaaaaatccnnnnnnnnnnnnnnnnnnnaaatttatcctccaaaaataaacaatcttttacaaattaatgnnnnnnnnnnnnnnnnnngtaagtaatgaaataacagacgctcccacaatcattcacttacatggaacgaccagtctcgccgtccacaacgtacacaacagcctcaggtcaccggtaaaagnnnnnnnnnnnnnnnnnnnnnngtgactttataagtcctcttaaaatannnnnnnnnnnnnnnnnnnnnagtgttttggtctgccaattttccacatcattttaaacaatttgttatgtttgtctaatatgtgtctgctttagtctggtctgtgttgtttttagctaaaaccaaactaaattctcaatcctcaaaattagtactattcaggcgaaggttttaataaattttactacttgcacacaataatagaaggtcaaccaaaaaattttcggcacatatcttcgttcaaggtccatgattcaacaccataaaaaaggacagagaagacgtagcatctcagcattcttactattacagtagaaccccgaaaatccgaactaattggggggacagcctgttcggatttcgaaaggttcggattatccgaaagttagcctaattagtaattcaaagctttcattgtcgttgattttgagtcgcaaatcgttctcgttagacagtggacaatatttnnttgactcagttgactacgagataatcgaagtaagtttatgtctaacctttataagtaagtctggctaattggttatgccaaagccnnnnnnnnnnnnnnnnnncttataagactacattaaagtacgtcttcatttttacaaattttaaatgccaaagttctattaatcctacattgnntcattttactggtttactctgtatattaaacatgtttttaagttttt

SEQ ID NO: 14533 - DNA, 916 bp, Diabrotica virgifera
  misc_feature (492)..(509): n is a, c, g, or t
gaccgctgctgctaacggcaacaccaacggtccaccaaagcttgaagtgaatcctgtggtggttcactgtagcccaggaacgggcaggacaggagtggtgattgcatgtgatatagcaattagggagtttgagcagacgaggcttgtagatatccccaaaatagtgtataggataaggagggaccgggctagcgctgtccagaccaaggaacagtatacgtttatctatagggtggtcagtctatatgctacaaagctgacaggtggagccttagagtccttgtaatactgaaatgtatatgttaaagaagataatatatgagtcagtgtcatctctacatttgaaagtataacttgggttcaagtgttcaagcatacattttattttgttgtactgctagtactatggcttccatttattgatttctacaaaagttaggaaagtcgtattagttaggtttatgattttttgaaatattcttgagagctcgnnnnnnnnnnnnnnnnnnggggaatcctggcgaataacgcaaatgtctcagtcttagatttagattagagtataacactgtggtataactctgtgcaataaatgtaatttgcgtcattgtcctcttcttcttctgaactgttgtctcttttctttctatctatctttcttttcttgtcttttcatttttagtgaaatttaacatttattatttttgtgttttcctgctttttggttatctttcaagtttaaattgagcttctttctttttaatgggctacttctcctcaatacatgcctcgagttcttctttataaggtgtcgaagttagcacagccgtttccctctccttttattttcagcattaatgttgtgtggattgtgcaacaattttgtgcaactctcccctataacctcagccgattg

SEQ ID NO: 14534 - DNA, 746 bp, Diabrotica virgifera
  misc_feature (249)..(270): n is a, c, g, or t
gctgtttccgagttataactgttacattgacgaaaaagaggtgttttcaacgggaccgggtttgcaaaggtcgattgagcggaaccggacttacagcggttttttcatggcggggttctcactcactcccacctcttatttgcacaggtagacttgaacttgtgaaatggaatatgcgcagaattttatgaagggtgcgatgatcggatttccggtgtcctttcattgggcaaattttgtgaaatttcnnnnnnnnnnnnnnnnnnnnnnaattgcgccctctggaggtggacttgcaattatgaaaatagtttccaggcttttctctaggcaaattttgttatgaaattttttttcccaaagctgtactatggacggtttctgagatgtggccgagcgccattcttattgggacacccggtacatattacgaagaaggtttctagagagaactaatagcactaacacttcaacgatacaccactgaaaaaaaaaaggcgaacttcgtttaagcggtctcaggagtccggtaacccaatatgaaaataggttatttcgcgcagctcatcatcgtaaattatgttgtaaggtagcatataagatatatgcataaaatcttgctttccatctgagcgtctaaacacctacacatttgaaaacagttttgtcaggaatatactgatggagattattagtagcaatcttttctggattaaaaagattgatcgtccaagtttaacaatatc

SEQ ID NO: 14535 - DNA, 232 bp, Diabrotica virgifera
  misc_feature (2)..(114): n is a, c, g, or t
  misc_feature (118)..(150): n is a, c, g, or t
  misc_feature (153)..(174): n is a, c, g, or t
  misc_feature (190)..(190): n is a, c, g, or t
  misc_feature (196)..(196): n is a, c, g, or t
  misc_feature (207)..(207): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctnnnnnnnnnnnnnnnnnnnnnnnnnnnnnnnnncgnnnnnnnnnnnnnnnnnnnnnnttttagtatcaaattnattccnatatataattnatttaattgcggtgattaaaaaata

SEQ ID NO: 14536 - DNA, 618 bp, Diabrotica virgifera
  misc_feature (17)..(41): n is a, c, g, or t
caataacaaagcccggnnnnnnnnnnnnnnnnnnnnnnnnnttaaccttgtttcggagccaattctttaccctgggctccccctaacttaaaaaaacgagcagaaaatttggatccaagaaaacccccccccccgggcccccggatttcctcaacccgggcgtggaagttagttttgattcctcccaaaagtttgtggaagtgggccctgcccccaaagccaacttgggaaaaagctacaaaagaacaagtcttgccccttacaaaaagcccaagtcttgctttccctttaactatggagaaggggacccccttttttccgcagaggggggggaggaacaaaaccaacccaatggggccaacctcgggggcaaaaacaaccaatggggcttttttctggcccacccgcttaaaaacgggatgggccccccccttcaaggggtttggttttttagcaggggccccccctttcttggaaaccttagcttcagccttaccctttaacctatttttcttttgaaggggtggcccgggccgggatttttccaaaactttaaaaaattggggggctgtttgtttgccaagggtttgaaaaaattggttaattggggggggaact

SEQ ID NO: 14537 - DNA, 925 bp, Diabrotica virgifera
  misc_feature (2)..(898): n is a, c, g, or t
  misc_feature (900)..(914): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncggcggtgatc

SEQ ID NO: 14538 - DNA, 831 bp, Diabrotica virgifera
  misc_feature (86)..(98): n is a, c, g, or t
  misc_feature (100)..(115): n is a, c, g, or t
aatcatcatccttatcatttgcaagatattataccatgacctttattaagagcttttagagcaatattattacatattagagaatnnnnnnnnnnnnncnnnnnnnnnnnnnnnncttactaataattgtattattactcacaacatcaattatatatcaatgatgaccagatattgtacgatacggaacttatccaggccttcatacttgactaactactaaaggttaacatcttaggaataatttcatttattacttcaaaactcttatttattctatatcatttttttgaggatccctctgctagatcatgagctccaactattgaattaggaatactttaacctcctaaagaaattcacagcctttaacccattagaactccctttattaaatactttacttcttttaacttcggaatcaactgtaccttgagcccatcataccctaatataaaatagtttttctcgaggacttcaaggattattttttacagatacattataaatttattgtactatttgacgaagatatgactatcttggatcacctttatgcaatttctgattcgatttatgccatcttcatgatttatagcgaccggtcttcatgtcttacatgtaattattgacacgaccttcctattactttgactaattctacactatctacatcatctttcatcgacacatcagcttcggtatgaagcgacatcttgatactgacattgtgaagatgtaatatgatgattcttatatatgtcatgttactgatgaggtagatttcaaccaccacccacaggagcacaaggcgatactgggtcacaacac

SEQ ID NO: 14539 - DNA, 838 bp, Diabrotica virgifera
  misc_feature (280)..(297): n is a, c, g, or t
  misc_feature (614)..(630): n is a, c, g, or t
  misc_feature (734)..(748): n is a, c, g, or t
  misc_feature (755)..(755): n is a, c, g, or t
  misc_feature (759)..(759): n is a, c, g, or t
  misc_feature (769)..(769): n is a, c, g, or t
agtttactcttattaattattagtaaccatggtctttaaggtagtcacccttactctcttagtagcttgtgctcaagctatccggtatgacggccatgccgcaacatcctccatcgtcttcaacgacaaccacaactcagtccagcacattcagtccgcgcacccagctccttcccacggatacgccgctccaatcgcccactactccgctccctcgccagtttcccactacgcagctcccgtaccagtagcccagtatgccgctcccgctccagtagcnnnnnnnnnnnnnnnnnncatcaaagtagctgctcctgttctccttaaaagctcaggaccttcccatggtgccagctcttactcaagcttgagcttcggcagtgacaatggatactacaatcaacactctgcccctgttgcacactatgctgcccctgcagctaaaattgctgctcccctgctcattaaagcccctgccaaagttgccgtagctccagttgcttatgctcaagttgctccagcatacaaccacggaggatacagccatggaggatacagccaccatgaagaagaatacgctcaccccaaatacgaattcgcctatggagtagaannnnnnnnnnnnnnnnncatccactcacacaaagaagttcgtgatggtgatgttactcacggagaatactcattgcacgaagctgatggaaccgtcagaaccgtcaaatacagcgtagacnnnnnnnnnnnnnnnaacgccngtgntgaaagatcntggcatgccaaccatgctcaccctaccaagtcattcttaagctgttgccccagtccatcatactaccat

SEQ ID NO: 14540 - DNA, 375 bp, Diabrotica virgifera
  misc_feature (4)..(21): n is a, c, g, or t
aaannnnnnnnnnnnnnnnnncgaccgccccaattaccgcctctttttacccgcgcgccctctcgaaatgaggtagactaaaattctttaatataaagcttgtcatatcatagtaacccgagataggtaccgtcccgtttacatgaaaaacatacatataccgttcgcctctaaaagacgaaatttgcgctcctgaataggagataatatgcccaaggaaacgaaagactagaatgaaggacctcacgacaataaaataccaattggaaatttccatacctgctactatgaccgaatgccacgtatgaaattgcactcactccattgaataagataaacaagacaccttaacatgaagtaaaagaacgagaaaca

SEQ ID NO: 14541 - DNA, 55 bp, Diabrotica virgifera
  misc_feature (9)..(53): n is a, c, g, or t
atattaatnnnnnnnnnnnnnnnnnnnnnnnnnnnnnnnnnnnnnnnnnnnnncc

SEQ ID NO: 14542 - DNA, 910 bp, Diabrotica virgifera
  misc_feature (404)..(444): n is a, c, g, or t
  misc_feature (519)..(537): n is a, c, g, or t
  misc_feature (728)..(728): n is a, c, g, or t
  misc_feature (795)..(795): n is a, c, g, or t
gtgatttgtgcagtgttagtaccatgactttgacaatcaaattggtggcaatattcgcttttgcagctgctgcaacagggtctcctcttacgacgtttggaaaacggactccagtactaccaacaccatccaaagaaccagactcttaccagcccttccaaactcagttaccaatggaactagaattaccaaaagaagaagccaatcctgtaccattctacgctcctgagccatccacggatcttaaagcaccacaagaatctcaagagccggactattatcaggcacaacagactatttagattcgaagagcgagataaggaaggggtggtaaaaggtcactatggcttttacgacaaagaggggaagctgcaagtagtccactacgatgcccacccgcatannnnnnnnnnnnnnnnnnnnnnnnnnnnnnnnnnnnnnnnnagtagtcaaactttgatcagactgaattagaaattatcgatagataatttttaattgcagaatattacttatagnnnnnnnnnnnnnnnnnnngggtggtattaatgtaagggcgaataaatatacacttttgaggatttttgaagcgaagcttctatattgacgttgtattaatttttctctatagttaaatgctgagtgatcgtcacgaaatagttaaaagagtccatttacgcgacgaggcaagtccgtagtttcaatggaaaagaaaacataagccgtgnaaaaaaaaatttgctgtgaagcaagagtcagaggaaacatcttaacaggtacggcttctgaaatttnaaagcaaaattatgaaaacaataacagagcaaactgtaacaaagaataataaaaagaacttctaaattggaaaataaaatatacttggaaatcaatgtcagaatgatacattttg

SEQ ID NO: 14543 - DNA, 576 bp, Diabrotica virgifera
  misc_feature (58)..(72): n is a, c, g, or t
attatatgtgttttttgaaacaattgacaaaaacttgctggccaccaaagataacttnnnnnnnnnnnnnnncccttacttctcaaatgagctatatactaatgaatacccggagcttccataaatgcaaaccttgtgaatacaaacacaggatactgcttgatgaaaccatcatgcttatacccttaaaaggaattaaaaaaaggtattgcttttcccacttctgtatctgaaaacccctgaatatgctccttatctcctgatgcaatggaatctgatttagttatatctcaacaaaatgagtcaatgactaattagatatctcagatatatgtgaccataccacatactggctcacactataaaatgcaaggcatctaccaacaaaccggtcactggattatccttacatgtcatcctcacagaaccttatgcttcaccatgtgctcttaagatgcactgcctgaatcagaaacctatgccatcacctgagctgaaccctaagccgcatgaatcatataattaccagccactggaaagtatgctgagtcatatgctgaaacactgtaatattga

SEQ ID NO: 14544 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14545 - DNA, 236 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (134)..(134): n is a, c, g, or t
  misc_feature (154)..(154): n is a, c, g, or t
  misc_feature (160)..(191): n is a, c, g, or t
  misc_feature (199)..(229): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagnttaaccggtgtgagccaggntggttnnnnnnnnnnnnnnnnnnnnnnnnnnnnnnnngaaaggannnnnnnnnnnnnnnnnnnnnnnnnnnnnnntaatatt

SEQ ID NO: 14546 - DNA, 953 bp, Diabrotica virgifera
  misc_feature (113)..(127): n is a, c, g, or t
  misc_feature (188)..(715): n is a, c, g, or t
  misc_feature (722)..(759): n is a, c, g, or t
  misc_feature (779)..(792): n is a, c, g, or t
  misc_feature (795)..(817): n is a, c, g, or t
  misc_feature (825)..(847): n is a, c, g, or t
  misc_feature (876)..(906): n is a, c, g, or t
  misc_feature (915)..(944): n is a, c, g, or t
cgttaatgttgaatatcaacaaaaaacaattttatggtttaatgaagggcttgaacgggttgtggtagatgaggtccgctagctctatagccgtctttgtcagcaacgtaggnnnnnnnnnnnnnnncgccgttcaatcctgggtaaaagtatcttcctgatacagagagtgattcctctttagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccgtgtgagccaggttggttnnnnnnnnnnnnnnnnnnnnnnnnnnnnnnngaaaaggannnnnnnnnnnnnnnnnnnnnnnnnnnnnngataatatt

SEQ ID NO: 14547 - DNA, 933 bp, Diabrotica virgifera
  misc_feature (628)..(664): n is a, c, g, or t
ggttggcgtctgggtaaagttcttccagctctttgttagttcttatcctatattgtcctgatgcttcatccagcacagacccaaaggatttccctttccttaggatttttctttcccaaacacgtagtctctcttcgtttggctttgtcatcgtccacgtttcgcttccatacatcacaacgggtcgtatggttgttttgtacacttgtatcttcgtacgtcttgttagttgtttcggtttgataaggtttttgagggcaaaaagacatctaataccggcctgtatcctattgattatttcttgtgatccgttattgtctcattgtcagttattgttgttccaagatacttaaattctctaacatctatgtatatgttaaataaaattgatttctaagatttaagcttcttcttcttcttatacttgctgtagatttatcgatctgctaatttcaacgttgaagtatttcttgggaggtagacgtctccccagtggacgcttgccagctggttttccttctagcgcaattcttggtagtccctgctcctccattctctttacatgactgatccattctcttcgcttttgcctactctatcttactacatcttgcacaccacattgttnnnnnnnnnnnnnnnnnnnnnnnnnnnnnnnnnnnnncctccatgcaattgctcttaatgtcttcatttcgactgttcgtagcatgctgttggttttattggcgtcttctcttgattcaatacctgtgatgagtgataacaggtctgatgcaagttttattaattctaactttgctgtccattctcatatatggtttattccagaccacatctcttaaacatccggacatggctgcggccttgtttattgtcctcttaggtctctggctgggtcatgataacttgataaattcccacctatctacc

SEQ ID NO: 14548 - DNA, 820 bp, Diabrotica virgifera
  misc_feature (49)..(71): n is a, c, g, or t
  misc_feature (184)..(204): n is a, c, g, or t
attgaattaaagtggatatatacatagtgaattcacggattacaccctnnnnnnnnnnnnnnnnnnnnnnnacagcatatttatttcataggatgtgacacataatgaattcctaaatagtcagtgctatatatcttatatcataaagaggcctaacatcacttcctaaaagtatttctttaannnnnnnnnnnnnnnnnnnnngtcattgtaaaactgtaaatgtcacccagtatatcgtcggtatactgcgaaaactgggtaaatgccgaaataccgaaaccgagaaaaaacgtttttaaagtttagtgttttgttttgaattaacgggacaacttctgtttgatattcggtattctagtgaaagatgcatatatcagaaatgatattctatcattagtttgaaaaagttaagacaactagctgattaaacctaaatttaagatggagatgcggtcacttatctggttttacctgtaaatctaaattaatcatttacccttaaaataacacatttataacaaatataataaaccaaatataatattttgtagttctctgatcggaatatgaggctttaactagttattagcaatgtttttaagggattagtcgataattaattataacatctaactggttttccctgaacattttattctggttgtagtcatataaatattatttacataaatgataggcagttttatagaaaaatcaaatttatttttgacgtggtatagatacaacaaaataatattactatgcttattactcgtcagattagtcactgaaaagcagatctgacaagatgccattg

SEQ ID NO: 14549 - DNA, 939 bp, Diabrotica virgifera
  misc_feature (8)..(700): n is a, c, g, or t
  misc_feature (707)..(744): n is a, c, g, or t
  misc_feature (779)..(800): n is a, c, g, or t
  misc_feature (873)..(890): n is a, c, g, or t
  misc_feature (898)..(936): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaagttataattggnnnnnnnnnnnnnnnnnnnnnntgttcgacttttaaaattttacttgatctgagttaaaaccggtgtgagccaggttggtttctatctttatttnnnnnnnnnnnnnnnnnngaaagggnnnnnnnnnnnnnnnnnnnnnnnnnnnnnnnnnnnnnnnatc

SEQ ID NO: 14550 - DNA, 202 bp, Diabrotica virgifera
  misc_feature (2)..(36): n is a, c, g, or t
  misc_feature (60)..(60): n is a, c, g, or t
  misc_feature (70)..(154): n is a, c, g, or t
  misc_feature (167)..(167): n is a, c, g, or t
  misc_feature (174)..(195): n is a, c, g, or t
cnnnnnnnnnnnnnnnnnnnnnnnnnnnnnnnnnnnctatttttaaagttaaaagcttanatttttttcnnnnnnnnnnnnnnnnnnnnnnnnnnnnnnnnnnnnnnnnnnnnnnnnnnnnnnnnnnnnnnnnnnnnnnnnnnnnnnnnnnnnncggggtgattacnaaataannnnnnnnnnnnnnnnnnnnnnatatcac

SEQ ID NO: 14551 - DNA, 506 bp, Diabrotica virgifera
  misc_feature (25)..(28): n is a, c, g, or t
cccttacctttgtggtgttcttttnnnnttttaggacattccttttcttaatacctattttgggcatatgataagctatagtgaaggttcgaataacttgaggggaggatattttctcgaaaggtaaagatggaatagagagttgggagagagggaaagtaaggaattatgaggtgtatagattttagatagtgtactgatgaagaattattttattgttattgtagaaaagaaaaggttgaaggtggagtgataggaggggtagtctagcattgttaaatgaagtgattttaaaggtagatgcagagagaagaagagtaagatagaatgaaagtatgtgttgaaacattttcaacaatgaataaggaaagggtggaggaaaagtttgttattctaggaagaggtaatatttggtgagaagaatgagtaagaacgggtataaatttataatggtgaatatgttgaaggtatgtaatggaagaatttattgtgcaaggagcggatgt

SEQ ID NO: 14552 - DNA, 868 bp, Diabrotica virgifera
  misc_feature (78)..(96): n is a, c, g, or t
  misc_feature (410)..(443): n is a, c, g, or t
aaaatttaaaattgtaaggcttactcccataattttacattattagaactgtataaatttgatatcataaattagaannnnnnnnnnnnnnnnnnntagtcttgtggcatataaatagggttaccataatctattaaggccaaatccggacaggggtagtccaaagggttgtagaaaatgtaaaatgtgaatttgactgtgttgctacctctacattgtacatattatatgcgaaatgcatatggcacaattaaaagtacagctgtttcgctacaatatgcaactaacatcgaaaatctttgccagtttaaaatacatatacacctatgttttaacatgataagcagtgcgattaacttaactaggtgctgagcagaatgaaatttcccaacgtgtatagggccatgtgnnnnnnnnnnnnnnnnnnnnnnnnnnnnnnnnnnggcatttctcatatctggacaccaatctggacatgtctttcaaatccggactgtccggacgtatggtatccctacatataaatgctatttatttttgaatacaccctataaaaacatcaactgctcgtgctacatgatctcttcagtcccattttagtgttgttattctttcaataaagtctgccactcctgatcttttgcgtatagtagcatgagttattctatcatgtcgagaaacccatagattatcaccgacagaatgcactaattaaatacttttctcttcagatacattagaatttttgagtttatctgtgtaatagacgaagtaattaaaaagtgctgacctcaaacaaaaaaatataccataggatacagaaaccctacacaaataaaaatcgaagcctgtgtatttgcggatgata

SEQ ID NO: 14553 - DNA, 519 bp, Diabrotica virgifera
ccttccacgcgcccgcgaaatttagatacatcatttattgcccttctagataaaatcaatgtgatcatggctgttcgagtaaaagatcatcaacttgaatggaggataagactttcgaggatctcgtaggaagtagtgatgtgataagacagtgaacagtatagaattatggagtgcatagattttaaatatatgctaatgaagaacataccggtggttggagtgatacagttcagctgatgatcgagagataggctgggatactccaaaatggatactgaactgattctacagtagacgcgatataacgagaaaagcatataatcaaaattacggcgaggccttttcaactctgactaagaaaaccccgtaaaaatagctctttctcccccgcacacttaatatttgctgaacggactaaagacgaacgggtgcaaatttcagatgtcccaaactctgacggaatgaacggaagaatcatcgtgcaaggagcgggatgtagtcgcttccccagtcttt

SEQ ID NO: 14554 - DNA, 225 bp, Diabrotica virgifera
  misc_feature (2)..(220): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgat

SEQ ID NO: 14555 - DNA, 211 bp, Diabrotica virgifera
  misc_feature (2)..(38): n is a, c, g, or t
  misc_feature (40)..(75): n is a, c, g, or t
  misc_feature (81)..(152): n is a, c, g, or t
  misc_feature (157)..(203): n is a, c, g, or t
cnnnnnnnnnnnnnnnnnnnnnnnnnnnnnnnnnnnnngnnnnnnnnnnnnnnnnnnnnnnnnnnnnnnnnnnnnctcatnnnnnnnnnnnnnnnnnnnnnnnnnnnnnnnnnnnnnnnnnnnnnnnnnnnnnnnnnnnnnnnnnnnnnnnncatcnnnnnnnnnnnnnnnnnnnnnnnnnnnnnnnnnnnnnnnnnnnnnnncttgcggt

SEQ ID NO: 14556 - DNA, 670 bp, Diabrotica virgifera
  misc_feature (581)..(581): n is a, c, g, or t
  misc_feature (626)..(627): n is a, c, g, or t
  misc_feature (645)..(646): n is a, c, g, or t
gctaaacataggcctcccgtaaataattacattgtatccgatcttgagtactctgaccccgaccaccttgttcgaggacgatctcgattagcataatcatcgtgtctaggtctccattctagaattttctttgtccatcttccatccttaaatctgccaaaatggccctctcagttccatttcagcgttgtaaatctttgaagtgcgtctgtaacaccagtttttctcctatgtattgtatttgaaactctgtctctgagggatatattcaacattggtctctccattgctctctgtgccacttgtattttatttattacttttctggtaagggtcaatatttctgcttgatatgttagaactgggagtacacattgatcaaagatcttccttttcaaccacatgagaatatctgatctaaagacctacccttagttttccgtaagccgcccatgccagtccttttctcctgttcaactctgtttgtttgattatccctgtttacctgaaatcaatatgaatatatattagaaaatattttttcagtaatgcccccttttttatccaaccttattcgggtncatatcttttattttaagctaatttcggtattttttaagctattnntttatttaatacttctannatttatttttgctattacattaat

SEQ ID NO: 14557 - DNA, 793 bp, Diabrotica virgifera
  misc_feature (479)..(497): n is a, c, g, or t
ggtccaccgtatattgtcttgtcagagcctatcaaaatgagcgtgtttcttaccctcttgggttacgggatcgctctacttctcgtagcagcagtatcattctatgcctatttcctgtattcctacacatactggtctaaaaaaggagtaccatatctagagccaaagtttccatacggaaactgtactagtcttttggctaaggtgaaaggatattctgtaggaatggtagacagctgctacaagaaaatgagggagcaaggatggaaagttggaggcttcttcacaatagccagaccgacactcttggtattggatcctgaatatgttagagatattttggtaaaggacttcagtaacttcgtagacagaggattttattacgtcaagcatgataagatatcagaaagtctcttcgtagtggacgaaacaaattggaaaaatattcgaacaaaactaacccctacattcacgacagnnnnnnnnnnnnnnnnnnntcctcttataacccacgcatgtggacaaatgacgaaattcatggaacaattggccgaaaagaaacaagacatcgatattagagagtgtttggcccatgtttaccacagatgtgatagtatcttgcgcattagggctcgacagtaactgttttacagataaagaaagcaaattcagaaatataggaaagtccgtacttcagttttaaggatgtattactttcagctaaaagtatccgttgatgaattatgctccggagcttagcttttaaaattagggattcaaggcgtgaaaaagg

SEQ ID NO: 14558 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (160)..(191): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccgggtgagccaggttggttnnnnnnnnnnnnnnnnnnnnnnnnnnnnnnnngaaaggaa

SEQ ID NO: 14559 - DNA, 549 bp, Diabrotica virgifera
  misc_feature (38)..(86): n is a, c, g, or t
tttcccgcggccgcccacgcggccgcccacgcggccgnnnnnnnnnnnnnnnnnnnnnnnnnnnnnnnnnnnnnnnnnnnnnnnnntacaataaagctccagatgtacttggttcatttgttgtattcgacggaaagttaccctgtgtccacattatcagattatgttccggcatctgagacgcttggaaatgatcggttagcaacatctgtgagaaattcacgtgtctctggtacgcctcgttctcccgctggctgtcaccgcaaattctgtgtaaatctttaagaattgctgaagcccataactgaacatgaacatccggcattttacttgcaagttgcatcgctggagttaccatattcctactttctctgctgttacctaaagacagaaatatatgaccgagaagaacaagcgaaaacgatgttaaccgatttaagtcttcagcattggccatcttcagggtttctcgcagatatctcttcgcttcgttgtacccgcccctggaagaatggttgcaggccttgtacataatagggacctgctctg

SEQ ID NO: 14560 - DNA, 130 bp, Diabrotica virgifera
  misc_feature (21)..(51): n is a, c, g, or t
  misc_feature (62)..(82): n is a, c, g, or t
  misc_feature (111)..(129): n is a, c, g, or t
caaagctgacattcttttacnnnnnnnnnnnnnnnnnnnnnnnnnnnnnnnattatcgagtnnnnnnnnnnnnnnnnnnnnnctcatataataaatttattcaatttggannnnnnnnnnnnnnnnnnng

SEQ ID NO: 14561 - DNA, 924 bp, Diabrotica virgifera
  misc_feature (404)..(430): n is a, c, g, or t
  misc_feature (520)..(544): n is a, c, g, or t
cgtctacatttcatcactgattcgggcgacgtatccggcccagttccatttcagtgtgccaattcgggaaattacatcggtaactcctgttcttcgtcttaactcttcatttctaactcggacacgaagcaacttactcagtattgacctttccattttcctttgagctatttgcagcgttttaaaagttgtagatgtcaatgtaaatgtttcggcaccataggtcatcacaagcaacacacattgatcaaatgtttcacgttttaaagaaattgttatagacatttgtcgcttttaaagatgtctttgagttttttataggctgcccacgctaagtttattcttcttcgtagttcgcatgtttggttgtctcttgtgtcttggagtgattatattggtgtttnnnnnnnnnnnnnnnnnnnnnnnnnnnatctccgcttttgtaccttttagtacctcgtacataaacaaaataaacatatctaaagtgaaaacaatcgcagtagatatagaaatctcnnnnnnnnnnnnnnnnnnnnnnnnngcagtaattgcacgagagctctaaaattatcgatttttatcctgagtgacgctttgacagttttaatttcacgacccgaaggggagtgaaattatgtcgaaagtgtcacgagggcaaaaattcgataataattttagagatcgatggtaattcgctcattatttcatgactaaaactctctttttaaatcattttaactaatgttttattgatatcttcacctgaacatttgctaaacctgtttcttggtgttctctgtgataaagtgtaaaacattaattgtcattaatgtcaatgaatggtcatttttgcctagtaacgaagagcatctgacgaaatgtttgacgacgggatattatcaaaattatcgctgggatttt

SEQ ID NO: 14562 - DNA, 829 bp, Diabrotica virgifera
  misc_feature (601)..(601): n is a, c, g, or t
  misc_feature (792)..(792): n is a, c, g, or t
ctgtggacagaacgccgaatgtagagtcgttagccatacgccaaactgtgtctgcctggctaatttccaaggaaacccattcatacaatgtctaccaaagatagaaccaactgttattgaaaaacctacaccatgcataccttcaccttgtggaattaatgctgaatgccgtgaacaaaacggcgctggagcttgtatctgtataagagattacataggtaatccttacgaaggatgcagaccagaatgtacgttgaactcagattgtccttccaacaaggcttgtattaacaacaagtgcaaagatccttgtcctggaacatgtggcttgaacgctgaatgccaagttatcaaccacctaccagcttgcgtctgcatcactggatttacaggagacgcgtttaaaaattgcagagttgttgaaataatagaagaaaatccaaatccatgtcaacctagtccttgtggtctaaatagccaatgtcgtgaagtaaacagtcaagctgtttgctcttgcttaccggaatatacaggaagcccaccaaattgtagaccagaatgtacagttagctcgaatgtgctcataatagagcatgcttanaccagaagtgtattgacccctgtcccggaacatgtggattaaacaccaaatgcgatgttattaaccacagccctatatgtagttgccaaaacggtcgcactggtgatccattcaccagatgctaccctataccacctcctgtaccagatataatcgaagtgaaaaatccttgcgtaccttccccatgtggnacaacagtcaatgccgtgatgtaggaagagcaccatc

SEQ ID NO: 14563 - DNA, 930 bp, Diabrotica virgifera
caccggaactgttttttgtctgtcttgcatcttcgttttatttctctattgaggtttcttaaactagctttttccctttcactatgcacgccacttgacaaagatttcttctattctcaatgatttgaaaggtttcatatgttatccagtgtttccgttttacaggattttatctttggatgatcaattggtgttgttacacaatgtttaaaagtctcccatatttcttgtgatgttccgttacgaatagagggcattattttatgtacttcctggacaaggtcgtccttctttcttagttctatcctatttgtctcttttcgtttgttgggcactttaagcttaagctttactttagctacgagtagggtatgatcggatccgcatatcgcccctggatatgatctgactgtttgaattgacgatctccagcgaatattggtaaggatgtaatatctatttgatttctagacctatctccaggacttttccaagtataaagtcgacgtacatggtgtttaaatcgagtattcatgatagaataattgtttgtgatagcaaactcgattaaagggtcacctctttcgtttctctggcctataccgaacttccccagtacattctttatgtcgtcattctgtgtagtgttgccaacttttgcattgaagtcgccacatattaaattaagctctttatttggtatgttggcgattgtcgtttccagtttttcgtatatatcttgtataatgtgtgtataatattaatatacacggattatacgacttatgacagaagctcgaaacaaatgactgcgaatgaaaagccctatactcaagttatttagacatacttttattccaaatggagattaatgcgacagttccctcttttttttggttgtaatgaatctttgtcgacatcagcgactca

SEQ ID NO: 14564 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnat

SEQ ID NO: 14565 - DNA, 706 bp, Diabrotica virgifera
  misc_feature (508)..(530): n is a, c, g, or t
  misc_feature (686)..(686): n is a, c, g, or t
gttcgattttatacctgtgtgatgattccgataaaatcctttaaagctgttcctgagctacaaatatacctccgggaaataaatattcctatatctttgcttccgatgaatatgccaaccgtctattgatatttttcattcgcgaacagtatagaacagtaaatttttagttctattactaactgctgaagcttaaaagtgaaatattgtcatatatcttttatctttactgatatgtatagggcgcttcaggatctcagaaattagtttttttcctcttttcttctcctaattatcattttaatcaataagtgccgaaacctacataataagaaagaatttataagtaaaattgcatcttatttgatcccatactctctttctcagcttgatttcaacgcttggtttctccacttttgtggtacgcctcataatatgcccccagctctgcacatccgtgtctctctcctaatataatataaacctgaaacattctgtttgatctatnnnnnnnnnnnnnnnnnnnnnnnacccgcataaactcaaatacgactctaaatacgccccagagctcttctctttcgaatatctctcaaaatatctctaccttgaaaaattcttttgctatgagtatgatgcgtttatgcaatgcactaataaacaatcacacattattctaccactanacaatataaaagagtctgga

SEQ ID NO: 14566 - DNA, 1063 bp, Diabrotica virgifera
  misc_feature (960)..(996): n is a, c, g, or t
cccacgcgtccgcttatatctgccgatgactatattatcaatttgtcgaatttagatataatagacgtgagccttttggaaaatttaatgatagaaactttcaaatcagacacaattttagaaaacaagatagcgattttacattatcttttggttcatatggaagacgttgaaactgcatctgagttaatatgttggcattcagctacaccgtttactatagattaccctgagctcctcaaagaatttcttctggctacatcttacgcatccgtacagaaaaaccttcccttaaacgccgcaaaactagcgactttgcttccaattacaactctgcgtcttggattcgatatggaacttaagaataacgattacttaataaatctacgacaagaagtactttggaatgcctctatgatggtaatatcgccccaactacggattactccatataaaagcgacctgtgggttaagttatgggaccatctagctaagttatccaaacctgggttaagatttaggtctagtcaagtattagataagctgagaatttcattagactgttatcaacctgaggcactctctagatgttctacgccattgtcaccgagcggaggagcagcttctacgtttgcggattttttaagtggtacaagaaatcaaacggattttctacctttctatgaaatggatagttgtactgccagtagacagggagcatattatctctgtgaacttgagggagttaagcatgcattttgttaaaaacaacctccggacactaacaagaaaattttccaaatggccggatcaatctgccatgcacgttcacgcaggtggccccaaaatacgcgggagctcaattggaacaatctagaacaacttggccaataagaatgcaaagcaggaacctttgttcccggggaaaaagtcaataagggattcctttttaataaaccnnnnnnnnnnnnnnnnnnnnnnnnnnnnnnnnnnnnncaaatttcctcgggaaaggaattacctggggtggggggaaccccccacagcgcttcccccttccccc

SEQ ID NO: 14567 - DNA, 167 bp, Diabrotica virgifera
  misc_feature (2)..(14): n is a, c, g, or t
cnnnnnnnnnnnnnattacctttagggattaacagcgtaattttattggagagtccaatcgaataataaagattgcgacccccatgttggatttaaagttaatattggggtagccccccaattatttacgcctgttcaacttttaaaattttactggacttgggctt

SEQ ID NO: 14568 - DNA, 892 bp, Diabrotica virgifera
  misc_feature (96)..(116): n is a, c, g, or t
  misc_feature (278)..(295): n is a, c, g, or t
  misc_feature (314)..(332): n is a, c, g, or t
  misc_feature (384)..(417): n is a, c, g, or t
  misc_feature (829)..(846): n is a, c, g, or t
gtaacacatataataaacacatataatagtaaaatttcaacattgaccgattaacaacgggcattgtcgacattggccgggcaatgatagaaatgnnnnnnnnnnnnnnnnnnnnncatcaatgtccaatttctatggacaataacgttaatatccggccattgtcgataatgaccaattcaaccggccattgtcgatattggccggccaataacgttattggccggatttacgtcattgtccgtaacatatataaaaaagtattctcatttgcgtannnnnnnnnnnnnnnnnngtgacattccgtttaactnnnnnnnnnnnnnnnnnnntttttataggctaaataatcattatctggtaattaatattatttgttttatnnnnnnnnnnnnnnnnnnnnnnnnnnnnnnnnnntggatttatgtataaaaagtaaatgttaatgggtcatcacttgaattgtaaattgtgcagccaatagagacgcagtcgctcttacaagaggtaatcgaaatgaagatgatcgcagttttattcttgtgcgaagaaattgcagaaaatgcaaactgtcccgatgttcctggtgtatgggatatgaaagatggagaaaagaactcggtccatgaaaacctgtaacattgccacttgctatggaagtgaaactttacttcccagctaaccttgttcccgcgtcgggaagccctctccacactgaaagggggcaaaaccggggaccagaacaaaaatagtaccatagagggaatgtcccacagcaattgtggggccgccaacaaaggggagggcctcaaaaacaattacgggagannnnnnnnnnnnnnnnnntttcattaaggaaaatcttacaaaaacaaaaatgggagcgcctttt

SEQ ID NO: 14569 - DNA, 799 bp, Diabrotica virgifera
  misc_feature (92)..(112): n is a, c, g, or t
aaaaatacctggggtaaccaaaccaaaacaataataaaaaacatttaattaaatgtccttatttttacatttcgaaaatgaatttggatagnnnnnnnnnnnnnnnnnnnnngattgcagataaacaaaaacctgatgataatactgaggagatagaagatactcattttcagaaatatctaagtgaatggaagaaaaaggatgtccgaacagacgaaggaattccaaagttttttaataagattcctaaggaacatgaaccacttcgagtcaaactaagggaggaaagcagatcaaatttatttaagagaaagagtttacagctacttgacaataacgaactaaaagaactatgggtacttttagatcagaaccaaagcaatccagaagaacaattgatcagttacacagactttcagaaagtggctaatttggcaggggccaaagtcaagccgtattttacttcagtattatttgccaaattacaacaaggtgatcctcaaggaagagtatcgataatgtcattatttaactatgttatgagaaaagtttgtttagatcaaactagaatcggtttgtcgttatatgatgctactggccaaggatatcttacggaagtagatttagaaaactatattaccgagttactaccaactctcccacaattagaaggattagagaagtcttttcatactttttacgtttatacagctgtgaggaaatttttgttcttccttggtgttgttcgaacaggcagagtaagaattttagacatttagcctgttcgtttctagacgat

SEQ ID NO: 14570 - DNA, 346 bp, Diabrotica virgifera
  misc_feature (81)..(102): n is a, c, g, or t
  misc_feature (239)..(262): n is a, c, g, or t
taacagcgtaattttattggagaggtcaaatcgataataaagattgcgacctcgatgttggagtaaagtttattattgggnnnnnnnnnnnnnnnnnnnnnntgttcgacttttaaaattttacctgatctgagattaaaccggtgtgagccaggttggggtctatccttcaattattaatataatttgaggccgaagggacctcgatataaaacaatttttctttttatatgcaaagnnnnnnnnnnnnnnnnnnnnnnnngcccctagatgatcaaagaattacctacggcggcttgcgaggtcaaacctccctcattgtcgccccccaaaattcaaattccct

SEQ ID NO: 14571 - DNA, 629 bp, Diabrotica virgifera
  misc_feature (589)..(615): n is a, c, g, or t
ccagcgttcaggtagttggcaaagaggccacaaaatggggtactatactttcgtgtgcggtgccctacgaatcattccccacccaagacggctattttaccattggtaccggctccgaaccacagtttaaagacttctgtgaacgaatacaaagcccagatcttccacaaaacgaaaagtatttaaccaataaattgagggtgcaaaacagagaggaattggtgccgttgctaagaaccatcttgaagacgaaaaccaacaaagaatgggccgatatattcttgggagcatcgtttccgtgtgggccggtcaatacaatgaaagacacctttgaagatcctcatgttaaggcaatcgatttggtgaaaactttggaccatccggtagctggtcaaataaaggtggttgggcctgcggttaaatatggagaggggggaaattttgttaaaagtgcaccccctacgttggggcaacacaccaaacaagtgttaagtgaaattttaggttttagcgatgcgagtattgaagattttaaacgacgacaagttgtagaatagatattttttttaatttgccctacaataaaccnnnnnnnnnnnnnnnnnnnnnnnnnnngttttatgtctttt

SEQ ID NO: 14572 - DNA, 68 bp, Diabrotica virgifera
  misc_feature (2)..(39): n is a, c, g, or t
annnnnnnnnnnnnnnnnnnnnnnnnnnnnnnnnnnnnncgttttttattgcaagctggaaatgaggg

SEQ ID NO: 14573 - DNA, 972 bp, Diabrotica virgifera
  misc_feature (811)..(811): n is a, c, g, or t
  misc_feature (832)..(832): n is a, c, g, or t
  misc_feature (870)..(870): n is a, c, g, or t
  misc_feature (890)..(891): n is a, c, g, or t
tacttttttaacaatgaggccgaattacaattgcaaatagtgatagccactttgaaaaatggataacccaaacgacaatgcagcatcagagccaagtttggaagacaaatcttcagcaccaggagaggacgaaaagaaaaacgagagtacctctaataccttagaaaatattaatcttactactcacgaggaagatgatcccgagactgatgacgacgatcctctaaaagaaggggaaacagctccgttgctagcaccaaacgaagattccaaggagagtaaaccagatactccaactagcaaaccattagcgcttaacttagataatccaggaaatcagcaaattggtactgagcttgtgactaaatctgataatacaatgagcaaaccatcaaatgataatccatttaataagccacttattgatgatccagcaatcaaaccaccaacggataatccacttaacaagccacttaatggggatccagctagcaaatcattaaatgataatccacttaacaagccatttattggtgatccacctagcaaatcaccaacagcgcccaacttagaaaatccaggaaatcagcaaaatggtactggatttgtgagtaaactaaaaagcgtggctgaaaattttttatccagcagtgacagtagccgaccgactgaatatgatccagaatctctagacaatgaagagtcgactccattgttatcgggaattccattaaatagacggttcctggatagactatggttggtgctttttataatcctcatagtactagctgtttccattggtgcattnttgttaatctggttgggccanacacaaatctgaagtggtttttttaattatattcttanaaaccaatggattacccttnngagcggatatgaatctccccatcacatgagaaaattgaaacttcctgcacgtagcgtctttctgatcgagcttaattctat

SEQ ID NO: 14574 - DNA, 754 bp, Diabrotica virgifera
  misc_feature (15)..(753): n is a, c, g, or t
caggacgcgtagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 14575 - DNA, 575 bp, Diabrotica virgifera
  misc_feature (12)..(12): n is a, c, g, or t
  misc_feature (211)..(239): n is a, c, g, or t
cccctaacgcgnccgaattttaataattatttctagtttacccttaattgtgtgtgtattggttagtattgcttttttaactttacttgaacgtgaagtattagggtatattcatcttcgaaaagggcctaataaagctggatttttggggttgattcaaccttttagtgaagatattagattatttactaaagaacagatttatcctttnnnnnnnnnnnnnnnnnnnnnnnnnnnnnctcctattttgaattgatttgtagttttttttttatgaatttgaataccttttattactataaatgtaacttttaattcaacaatattattttatttatctgatactattaaaatgaaatattttacaatatgggctgaggagatcatctaattccaatgtaagtttatgaatgaagattacgttcaattgttgcacatactttcatttcggacatcatttagattgtgttgtaatatagttattatttctaaatatattagtgaaaaaatctatacatctattttatcgtaagaaaagatgatgtgctagctatgtacatcattgaatatttatt

SEQ ID NO: 14576 - DNA, 166 bp, Diabrotica virgifera
  misc_feature (2)..(17): n is a, c, g, or t
  misc_feature (19)..(92): n is a, c, g, or t
  misc_feature (94)..(152): n is a, c, g, or t
gnnnnnnnnnnnnnnnnannnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnccaaagggaggccg

SEQ ID NO: 14577 - DNA, 115 bp, Diabrotica virgifera
  misc_feature (4)..(47): n is a, c, g, or t
  misc_feature (78)..(113): n is a, c, g, or t
cacnnnnnnnnnnnnnnnnnnnnnnnnnnnnnnnnnnnnnnnnnnnncttcataagaatttattcttaagtaaaagcnnnnnnnnnnnnnnnnnnnnnnnnnnnnnnnnnnnnat

SEQ ID NO: 14578 - DNA, 766 bp, Diabrotica virgifera
ctagtctcactcggcatacgagtcaaacaacctctaataaaagctctaatcaactgctgaaactttggataattcttcatctgatgaggcaaccacttccactcctgatcgtaagaggggtgctgctgctctctgtattgccggggtaaccgttcacctgcccttacaagcgccatcaatgtccccttacctgttacacgtgtattccctgacttatgacctgctacctacagacacccttattgtaccatctctaacaaaaagtcacgtatctgtcaatgccacttcatacatgttaactgcgtgtgactatcttgatagtcttgataaaatattacttgctatctaatagatgttggctcttctcattattacttcttaagagctattggatctaatgaccacgaagatataagctacctatactgattttctgacggaactgacatccgatccacactaattataacaactgactccttctcacgaacaatgctcaatctcctgtgattgcataacgtctattatcatatgatatcttaaagaaatgatatcgatgatgattctttatatgagctaaaccatgtgtttattccgaagcataacacggatctacctatgactgtgttctatcaagatatactgcctatgtatactctccccgaatatgtataaaattatttctcatatgactcacacaatcatctagataccgatgatctcttatgcattagagaactactatatcacactccactctccacct

SEQ ID NO: 14579 - DNA, 849 bp, Diabrotica virgifera
cgaagctacactagacgacgacgacaaactatgctagtaaaagaaggttagtacagagttagtaagctcgaaatgtttaaactgtgttaataaaagtcacttgaaagttgtatacattagataatacttacgtcaagaaaagaaggtccatttgaagaattattacaattttgtgctttaatacaaactcctacgtctccgtttttagtttgttctaatctaagttgttctcgtaaatgattcacctcctctgacagtttttctattgtagctgtcgagtcggcttgcgtgctacgttgtgtcttttgacttttaagcagttggcactcttctaaaagcttctttttctcttcgacttccttcgataagaggttttctaaatttacaagttttgattgcaactgcgatagatgactagcttttaaattctctagttctgcttctttcgcagctaactgacccctccacgtcatttcttcttgctctacacgtttttggagttcgtttaacaagccctccgtgtcgtctatagtatttttgtagtgctcaatttgcgcctgcaattttatcacttcggaagatttctgaggagaagaatgttgcgaactgtgttgttgctcttctttgagagatctgacgtacttctcgatcagtttagcacattgatcctgccagtcgctagagttgagcgtctttaaggcttcgatgtcggggaatagccgttgcatgaattgtttctgggaatcctgctctttacttatgatctccgaagaaaattgattattcttcgttttctgttcctccaactccttttgtatcaattgggaatttttttgtttgatggttcca

SEQ ID NO: 14580 - DNA, 900 bp, Diabrotica virgifera
  misc_feature (345)..(363): n is a, c, g, or t
aatactcgaaatgtttacttagattaaaacagtgtatatacctacctatgtttagtagacagttttggaataatacctgaacagaaaaacagtgtacttactattatttagtgcagatgatagatgatttagtgcaatagttacaatataattaaaagataataatttagatttgacaacacatgacatatcataaatcttccaaatatggcagtagtactagctctttttgttggtgctatagtagctgcgatttcatattggtggatgggtatataccgaatcagatctaaactacactggataccagagatacctcgactacctttaattggtaatgccttnnnnnnnnnnnnnnnnnnngaaattcttggcaaatttgaagattacttaagtaaacataatggactgtgtaccatagaattggccacttataagtttatagttacatcggatcccacatttttggaattcctattgggcaaaacagatattttgaataaaagtgacgaataccagtttttgggtaattggttaggtaaaggacttttaacagctgcagctccaaaatggaaaagaagtagaaaaatgctgactccttcgtttcatttttcaattcttgatgtctttgtcgatacgtttgattccaatgctgcaattttagtggatctattggataaagaaactaacaaagatagttttgatatatttccgtatgttaaaaactgtacgatggacgttatctgtgaaacgtcaatgggagtatcaatacatgcccaaaaaaatccaaaatcggactatgttcgagcagtagcagagttatgccgattgctgatactcagaacgtactcacctttaaaaccttcgattttttttatcgccttacttctgactataaat

SEQ ID NO: 14581 - DNA, 189 bp, Diabrotica virgifera
  misc_feature (24)..(116): n is a, c, g, or t
  misc_feature (132)..(182): n is a, c, g, or t
cgtaaaaagctcacatttttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgataaaaaagtaannnnnnnnnnnnnnnnnnnnnnnnnnnnnnnnnnnnnnnnnnnnnnnnnnnatttttt

SEQ ID NO: 14582 - DNA, 827 bp, Diabrotica virgifera
ctggaccatatctactgagcattgctatgccagaccatgggattggagaccagaagcaagctttttaagacctaccaagacattatttatgccgaaactaattcctacgaaaccagcaatacccgaaacagaagaactgatagatgttgaagctgaagttgaagtgccagtccctaattatgatgtggctaaggcaaaaactctaatgaatgaatgtgaaaaccaagcaattgctgcaagaacagatatagaggtagactgggaggaattggtgtcaaaatcaaattggacgagtaatcaaaataaggtttttaatggtatggtcaacattctcaattacttcaatctttctaaattggcatatagtggaagccaaaatgaaccacttttaagaagaacagtgatagacaagggcgtgcaaagagtgaggcgacttttggcttctgtatcatgggaactcaagttaattcaatggttacaccagactatgattgagaatctacctgcgccatatttggggagttatcttgatattttacagactcttaaatcaaaacttcccaattttgtggataaaatgatgcatgtatcttcagcaaatagaacgaatacattgagtaacgcaaatctagcacctttattagaaaaaccatgggatccagtgtccactagtttaaatgctgtataaaccaaagaaactaccgggaactcctattatactgattgtgccatcaggtacagcagtgtccaagatggtacaaaaatggacgaaattacttaccaatttagctacagttattactatacagacgagctttgggtcaact

SEQ ID NO: 14583 - DNA, 741 bp, Diabrotica virgifera
  misc_feature (150)..(173): n is a, c, g, or t
aatcttgtactatccacttattattttaatacctttactcgaagaagacggcattttttataattgagtaataatgtcctgaaaactagcctgatactagttccagttatctataaatttaagagataatgtataatgcatcgtgatacnnnnnnnnnnnnnnnnnnnnnnnntcctgattaccatttactttctattaaaagattgataagaagaactataataagctctgacattatctaaggacaaatataatatcctgaactgaaatgctgccgtcaaaatatctgaggacttcctaaggaacttcaatatcttcaatatgtcatatataaaacagatcatacctgcctcttgcctcagatcaatcattactacctctaaaacataaattcaatattatctatgaattaaaataatcatttttaaaaacatacaccaataatgacataggcgaatatgaaaatctcataaactgtgtccatgtagtagaatgaatagccctcttgagacataataagaattgtgaaaattattatgttactataggacatgtaatagaatctaccattatatgtgtaaagacgatttaccaaccatataacatcttgagctcatattgtgagcttatattccacatggaagattaattacatggaatgttagtatttacaaagagacatcagcatctaactgaccagatagctctgacgatgaagagatgcacgactacgatgatga

SEQ ID NO: 14584 - DNA, 710 bp, Diabrotica virgifera
  misc_feature (172)..(189): n is a, c, g, or t
  misc_feature (222)..(246): n is a, c, g, or t
gtgcgattgtggatcgcctagacagaccataagtcattgtgtttcagattgcctaaatcgtgcctaccgtggaaacctccaggactttgtggaatgctccccagaagcaattgaatggctatgtaaattggacattaatatttagattcattcattatattttagtgtttgnnnnnnnnnnnnnnnnnntgtgtatttatcgtactgtgaaagtccatacgnnnnnnnnnnnnnnnnnnnnnnnnncggggactcgctcacttcgcttgctaccgtttaattatgagccacaaattacttcaacacggtacaccttgctgctcaagttggcatgccttagcttgcgagatcacttcactacggtgactcgctacaaaggtagtgcagcccagagctgtcgcttccagaatggagaatctcggttcgctggcctccttaagtatccctctgcctgagatgtttcggataagtggaaatgggtggggcatctgcgcggactgtggaagtcgaacggatctagagttgatgcgtgttctcgccgtatcattacaatcctgcaaattttcctgcaagaatggctgtatccgttaactgaaaattgattgcccattaggcgcaatcccttttgcatttgtaaaacgtatcctcaccatgattttcccccagcacggtcctggggaactgacaacctccaccttctaaccctgcta

SEQ ID NO: 14585 - DNA, 142 bp, Diabrotica virgifera
  misc_feature (11)..(41): n is a, c, g, or t
  misc_feature (54)..(66): n is a, c, g, or t
  misc_feature (68)..(85): n is a, c, g, or t
  misc_feature (87)..(99): n is a, c, g, or t
  misc_feature (101)..(136): n is a, c, g, or t
catttttttcnnnnnnnnnnnnnnnnnnnnnnnnnnnnnnncattattaatacnnnnnnnnnnnnncnnnnnnnnnnnnnnnnnncnnnnnnnnnnnnncnnnnnnnnnnnnnnnnnnnnnnnnnnnnnnnnnnnnatatca

SEQ ID NO: 14586 - DNA, 943 bp, Diabrotica virgifera
  misc_feature (73)..(91): n is a, c, g, or t
attttggcccaacagtagtacaaactcagacttatggaacaaaaaagaagcaagaaccaatacataaagaaannnnnnnnnnnnnnnnnnnatgggtgggtcataccatactctgcggaaaccagacacagacataacaaaacaagcattggaattccaaccttcaggaaaacggaaacaggggaggccaataaatacatggaagaaaacaattattaaagaagcagaaaacgtcggcctaacctggaaagaagttagagaaaaagcacaagatcggcaaaaatggagaatgacagtagatgccctatgttccagtgggaactaagaggataagttcaatccaccttctatataatagagaagtttccctagatatcattaaaagtattgaaaacatctaccaaaacaataaaatggaaattagaatagatggataacttacagaacccatagccatgggcagctcatggagccctatgcttttcaatttaatcatggatgaaaccatcaaaagcatcaaagaataaagagtatatacaatgggaaacaaaggagtaaaaatactctgttaggcagacgacgcaatattgatatcccaagatgaagatagtctgcaaagattagtccacagatttaacataagagcaaaagaaataaatatgaccattttatctcaggaaactaaaacaatggtaatcagtaaagaaccaatcacatataaaatatgaattgattttttaaggttaaatgaaaggtaccggatgtctttttctaatatccccgccaaatggaagtcagctctcattagagctgtatacaattacttccctgacgggctcctccttttttacatttttctattttccttcaatttttcctccactttttccctatccgatttttaacccattcttcaaatttttcttacccccttttcaatttt

SEQ ID NO: 14587 - DNA, 805 bp, Diabrotica virgifera
agtgaactctgactcttcaacaatttgtcaattattttactttcccaataaaacaatgtcaatcacgaactatatcgtcatacttgcttctatccttattgcgtctacagccgcacagaggggattttatgctggcagcagtccgaaaggcatccccggtgtagcagcacgatttagacccggaggcagcttgtataatcctcctcaagacgtcggtaccagcagtagatttggagatagtagatttggcgctggtcttaatagaggaaaccaaggacctgtttcttttacgggaaaccaaggagttgcaagcagtttcggagcgggtaacagtatatcaggacctgtagttactggaaggttttttaacattatcattcataaccaatggagaacatatgtttacgacccattcgcagacgcttggtatcccaaaagatattaatttcgtgtattaaaatgtatgaaacgactgtgatacaatgtataatataatataaaagatttatatagtaatagacaatatttatcaatataattatcaagaattgtaaaggcagataagtatatacttattctgttcaggaattgacaaaacagaacggtcaaaaaaggatgtatgcttatgactcaaaatttatactttatatccacgctaattctaaattaatacatggattgtaagtacagtagaatcgcgattatccgagtctgggttatccgagcccccccggtaaccgaggcaaaagtcataatgggtgagttaccactttcaacttttggcgcaacatcggtgccttaaaac

SEQ ID NO: 14588 - DNA, 838 bp, Diabrotica virgifera
  misc_feature (18)..(46): n is a, c, g, or t
  misc_feature (509)..(529): n is a, c, g, or t
aagagctgtaacgccacnnnnnnnnnnnnnnnnnnnnnnnnnnnnnatgaagcaaaaacataataattatattacttggttgcctattcctattgaacggagtcctggacactcaacataacgctgatgtttaagtcagaaaagcctttgaactctggctttatagaagaatcttgaaaataccttggacaacccacaccatcaacgaaaatggtctgaggagaatagatggggtgctgctgaagatcatcaaagttagaaaagttagctacctgggacacataataagaaacgaaaagtaccgcctcgcgcaactggtcgtccagggtatgattgaaggaaaacgaggtcccggtaggcgccagatttcatggtttagaaacattagagactggaccggccttgattcaacatatttgtttagaaccgcattggacagagacatatttgtcagtgtagtcgctaacctccactaaaggagacagcaccacaagaagaaggttgcctannnnnnnnnnnnnnnnnnnnntatagacatgactctgtctgtttttttcaatgtgcctctagtaagttgtcgttccatcgttttcgtggtcttcccactgatcgtattcctattggggaaccgcctctcgctgtcctgactaccctatttgttgtcatttagcttatgtggtcattccattctttgtggtttcttttggttgcctattcgggcgttaaaatcccccagttttatcatctttcctctaacttgatctactacttttgttgtaattcgtcccaaaatattttctttgttatttgaggcaggttattttctgggccgtatact

SEQ ID NO: 14589 - DNA, 975 bp, Diabrotica virgifera
  misc_feature (303)..(323): n is a, c, g, or t
  misc_feature (688)..(705): n is a, c, g, or t
ttttgattaggtgaaccatcgagttcgtatattgttcaattttacatatacataagtgcagattcaaacattgttaaaaaataaaacaataatatatccttaatataaatatataaatgggtaaaaaataagcgaagtttgagtatagccagcgttagggacgaatagaaaagattcaacatcagattggtatcagttccacgatataagcacctcctacagtgaaatttacaaaacaattatgtttaaccttagagagggcgtgcggtcgtaaattttacgacagaaacacaaaatttcccnnnnnnnnnnnnnnnnnnnnnacacaaaatatcgtaaaatttacgatacgcgaccactcatgttgcattatagggcgcgcccactcgaagtttaaaatattgatacaaagatatacttggcctattaattatcaataactgctaaacattggttaatcttaaattttcaagacaattgacacatgatattgaaatacagactgaataatattattaagatcgagacttaagaagtatccccctctccatttaactatgatctaaactttaaatttgaattaataaagtattattgctctaacatctcgttattgatcatataacatttcagagatatataaccattacaaatagaggacaggtgccattttggaaaatataatccnnnnnnnnnnnnnnnnnntgacgccttctagatgtctcatcgcgaagtcgatgagttaaaataccaattgcgttgaaaaaaaatttatagtcaactttaaggaacggcctttttcccttccaataacttattaaccagaggggcaacgccctggcccaaaaaaatgaacaaaaactgggtaatcacaaattattgatttacccacttaacaaaagggggtggctttaaaggcgttccttttttctcttatcaattttttaccaaatttaaagatttctttttttgaaa

SEQ ID NO: 14590 - DNA, 246 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(245): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattannnnna

SEQ ID NO: 14591 - DNA, 119 bp, Diabrotica virgifera
  misc_feature (13)..(13): n is a, c, g, or t
  misc_feature (17)..(17): n is a, c, g, or t
  misc_feature (23)..(107): n is a, c, g, or t
  misc_feature (111)..(111): n is a, c, g, or t
  misc_feature (113)..(113): n is a, c, g, or t
gtaaaaagcttanattnttttannnnnnnnnnnnnnnnnnnnnnnnnnnnnnnnnnnnnnnnnnnnnnnnnnnnnnnnnnnnnnnnnnnnnnnnnnnnnnnnnnnnnattngnggtgat

SEQ ID NO: 14592 - DNA, 912 bp, Diabrotica virgifera
  misc_feature (883)..(883): n is a, c, g, or t
cttgtgttaattattgaaattagttcaatctaattctattagattttcaaaagtcgaaatagtcaatacaattattatgtacattccaaaataatggaacatgatagtccaagagcccaaaaaaactgcaaactgtctccaggtttagaatttcccatcatttttacagaagataatgaaatatacaagataaaagctacttttaatggtttctctgtaaaaatagatgaaactgaagataacaaaaaagttgttggtatgggttattttggcaaagggaattattcaagaagctacccaatattcaacaataatggcagacatagtattctgagggaccgtcagtatcaaatacgacagtactggggacaagctaaccagagtaaagagacagatgtatttgtagtgccagattccgatggcgaatatgagaaatattttaatgaacttgaacctaagtgtgtgaaagatacatctggattggaagaagtagttttcttagggttagaagaagcattttttctctcacactgtgtggaagtgctagaaatttctcataactcctgtgttttgaactctgagaaattgtggtctttatttacagacactgatttatactttccatataattatgcagtatataactattttcgagcaaagaattgggtagtaaaaccaggaattaaatttggaggtgattttgtgttatataaacaaggacctatgttctaccatgcttcttatgtggtggtagttgatgttttgaacaacaaactacaaagaattcaagaattgtgtagacgccctttgggaaacacttcattattatgcttttgatagatatgccaaactgctggtaaacagctcatggtgtgccagctanaactagatgaaagtaactgtatattctat

SEQ ID NO: 14593 - DNA, 884 bp, Diabrotica virgifera
ggtattttttgacaataaataacatattgcatgatttataacataaaattaccaatgataaattattgtccttgtttttaggatctgcgggtagtgtggtagcaaaccgactgtcagctaacccgaactggacagttctagctcttgaagctggtatcaatgaaaactttttaaacgacattcccatcaccgcttggtttcagtcaaaatacccctacgactgggggtttaaaactgaaaaacagccaaacgcatgtctgagtaccattgatggaacgtgcctgatagctaatggaaaggccgttggtggaacgtctgttaccaattttatggtctataacaggggaaataagttatcacagtaatgacggacccttgaacatagaacctcctggctgggaatcccccttagtggacttgtttataaaagctggagaagaacttggctattctcaaaacgatccggatggcaaagaacaattgggtttttctaaaattagaggcactgaaagacgaggacgaagatgtagcactgcaacagcttttattaagcccatattaaatagatctaattttaatcttcagtctggtgccagagtcaccaaaatcttaatcgatcccaccaccaagaaagctcacggagtagaatatataaaatatggaatcaaacatacagtccatgctaggaaagaaataattttaagtgcaggtactataatgagccctcaacttcttatgacatcaggagttggtccacaagatcatctgactcaaaaaggtataacctgcctcaaggactcaaaagttggatacaatttacaagatcatattggcgtagtttttcaagctctatttgttaatgaaagcgttaccttcactgacgc

SEQ ID NO: 14594 - DNA, 888 bp, Diabrotica virgifera
  misc_feature (482)..(498): n is a, c, g, or t
  misc_feature (790)..(790): n is a, c, g, or t
  misc_feature (825)..(826): n is a, c, g, or t
cggacgcgtgggctttttgttggtacgcgggatccaggcctagaaatactatgtcacaaatgatggcgtaatcccttttctataggtataaaaattttgtaaatatcattcatttcttaaatctacacaacattatcattaaaaatgatccattactaaaaaccgttaagcatatctgtgaatatcgcataaccctcaaataaaatgtgtcatcataccgggcttgttcatgcttaaaaataaaatatgtagacaagatataaatatatgtaataggtaagcagtttttgcaacgacaatccaatcacaatcagtgttgtttataataatagtaattccgaacgagttctattagcttttctacgtccatctcgaaaacaaaaccgcaacttagaattgagtcatcccacgacaccagaaaactgtacgccgatgacaaacgttcgcatggctagacctggcaccgtattgactgatattannnnnnnnnnnnnnnnntacgcaactcgcaggtgccaggttgtgttcgcttaggatcaatttgcgccgggactaaatgatttcatgttaagatgatcaaattaaaaattgcataacaccacaaaaaaatatctgtcttcagcactgctcgcgtttgatatgcagggtaggaactacaaccgataaacagatatagcatatacattgcgttcagaaaatatcccgacaaacgaagaccggagagtcctcagataattttaagacaattgaactcaagtcatctagcccgaaaatgcttcctaagggagcncaagctcttagatgatggcgtcttgtaattagttnnctctaataactctagaacgcttctattaagaaaaacgaaaactggtacgcctatttacatac

SEQ ID NO: 14595 - DNA, 923 bp, Diabrotica virgifera
  misc_feature (23)..(41): n is a, c, g, or t
  misc_feature (51)..(65): n is a, c, g, or t
  misc_feature (67)..(79): n is a, c, g, or t
  misc_feature (143)..(171): n is a, c, g, or t
  misc_feature (454)..(476): n is a, c, g, or t
  misc_feature (842)..(842): n is a, c, g, or t
cgtgtgtttcggaattttctttnnnnnnnnnnnnnnnnnnnccgattgcannnnnnnnnnnnnnngnnnnnnnnnnnnngtattgtcattataagttttggaaaagtgatggtataaaatttattttggccagccttttgtgnnnnnnnnnnnnnnnnnnnnnnnnnnnnngagagtgcaaactctggtgatgagagggagagttcagtgccagttgttcctgaaaatccagcaaagggtattcctactggaaaatacaagcttgtaggatggggtatagatactactggccgcagactaattgatgaaatcattcaaatagctgcgtttacacctgaatcacagttttcacagtatgtcatgccatttggagatttgaatcctacctacagcagaagacatggtatcagagtagtaaacacaatccgctacagaaggttgaaagatgtcaacnnnnnnnnnnnnnnnnnnnnnnngagtgaaatttctgctctccaagacttcttgaaatggttggagactgttaaaggaaatgacgttgatggaattatattgatttattatgaacttcgcaaagcctcaccggggatgctgttagaatcattaagaagacataatatgattgaaaggttccaaaaggtggtaaaaggctttgctaatggcttcaatatagcccaagcaaaatgtggcaacaccacgaaatctttcaatctccatataatgtctaaggtattgttaaacaggggtgcagagcacttcaacagtgcagtagatagagcaagggcttcatttgatattgctgctcatttagctcaaggggaaagagaggaatttaagggagnagcagccagtaaagattgtactggaacagaaagtcatctcatggaaagtgtatgtccatatgtcaatcctatagatgctga

SEQ ID NO: 14596 - DNA, 785 bp, Diabrotica virgifera
  misc_feature (2)..(20): n is a, c, g, or t
  misc_feature (201)..(219): n is a, c, g, or t
gnnnnnnnnnnnnnnnnnnnctgaccaggcttccgggtcgagccgcgttgatattttcttggccgagctttcggcgtcctctcgacagtgtagtgtctggagcctcaggagactgagacctcggaggccctgaagataacgtcagagagggcctcgaaagctcgacaaagagaatatcgacgcggttcaacccggaaaccnnnnnnnnnnnnnnnnnnnttggctctacaactccatgtgggtcttggccgcgtttactatttccctccattgttgtcggtcctgagcagctatttcccattgctgtactcccattttgcgtagaccactggctactgcgtccttccatctctttcttgggcgaacaactgaccttctgccatcggcctttcccaaaatgtggcgttcagaagtctttcgtcactcgatcttggcacgtgacccgcccatcttattcggtttgctttgatgtagcgtattatgttttcatctccatatattgtctggagttcatcactgtgccttcttctccatctccattctcctgttctctcttctctgcaaggcccatagatattccgcagtatctttctttcaagtaccagtaattttgttgtttccctctgagtctctggttctgagtccatgtctcgcttatacgttattgtgggacgaattattgtcttatacactcctatttttgctgcccttaagagtatttttgatttaagtacgggcattaatgtaatatgccctgtttcctgcaatgatcctggctgccacgt

SEQ ID NO: 14597 - DNA, 185 bp, Diabrotica virgifera
  misc_feature (2)..(44): n is a, c, g, or t
  misc_feature (70)..(145): n is a, c, g, or t
  misc_feature (164)..(184): n is a, c, g, or t
cnnnnnnnnnnnnnnnnnnnnnnnnnnnnnnnnnnnnnnnnnnncgttaaaaagctcacatttttttacnnnnnnnnnnnnnnnnnnnnnnnnnnnnnnnnnnnnnnnnnnnnnnnnnnnnnnnnnnnnnnnnnnnnnnnnnnnncatctacttgccgtgatcnnnnnnnnnnnnnnnnnnnnnc

SEQ ID NO: 14598 - DNA, 920 bp, Diabrotica virgifera
  misc_feature (62)..(85): n is a, c, g, or t
  misc_feature (758)..(758): n is a, c, g, or t
  misc_feature (828)..(828): n is a, c, g, or t
  misc_feature (856)..(857): n is a, c, g, or t
  misc_feature (885)..(885): n is a, c, g, or t
atttccaattacactattatcttttgattttatccattttaaaaaaatgtgttgttttcacnnnnnnnnnnnnnnnnnnnnnnnnaccttagattattattagaatacttagaaggacaaatgaaggatcgaatgaaagcttataaccaaacgatggtattaaaggtgagaaattttacctcggattttaccttctggatccagagttgcaaccgaaagtagtttttaagtcgcctaaataatacaagcgatatattattcgacgggcctcagcaagactagaacaaatatatacttccggtttcataccggtctgtccatccgtctatctctctctgaatacagctcctcggttattagaataaatagaatgacaaataaggtgtcgaatgaaacttcatatcccaaagatggtattaaagttgaggacattatcctcggacttgcggttcccgagttgcaaccataagtactgttttaaagtagccgaaatagtacaagcgatgcgtaattcgaggtgacttagcaagacgacatacttctggttttttatcacttccggttaaaacgttacaaccggaggtgccacattatacatagttgcagaaataatgcatgtgatacatctctcgacgcgtttgaaaatcgaggtcgaatattcaattccggtgttaatgtcatttcctgttaaaaaaatatgaccggaagtttgacaaaaatgactcaaaattaaggaaatcgtatatcagttgacgcanagttacacgaagagtttaaatagacttccagttctattttcggttacggtgggtgaaaacttatgaggtncactgcttttatcttataaatatacttnntgtcagtgcatattagacaccaaaattnctgggttttaattatgacacttatcaaatcaaact

SEQ ID NO: 14599 - DNA, 970 bp, Diabrotica virgifera
  misc_feature (179)..(196): n is a, c, g, or t
  misc_feature (667)..(690): n is a, c, g, or t
  misc_feature (721)..(756): n is a, c, g, or t
  misc_feature (872)..(872): n is a, c, g, or t
  misc_feature (896)..(897): n is a, c, g, or t
gacgaaacccgggaagaccacccacaagatggactgacgacataaagaggatttctaccaactggattgcagcgcaagataaatctgaatggaagtttttcgaggaggcctatgttcagcagtgaacgactatgggctgatgatgatcaaacaaacatcaaagatgtgtgtgctgatgnnnnnnnnnnnnnnnnnncataataaaagggtaatcagcacactcatggaattaaatttgtatccagcgctgtggtcatccatcttgatcaggcatgcttttgagctcgtcgctccatctcatctgaggccctcctcttcctctcttatgttcccatggtcgccagtagattatttgcttgttccatctttcatccgcttgtcggatgacgttccttaacgtctttcactttggttactcctctgatccagacgtttcttttgcgatctttaagttttatatgacgcatttgtctttccatcgacctttgcgcttttgtcactttatcgatattctcctttgtaagtgtccaaacttgggagccatatcgtcgctctaatggacaaattgcgtaagtcacaaattgaaaattttacaggagagacaaaaaactttggaacttgcctatgtccaaaagacaacaaaagtaataaaagagaaaattgaccnnnnnnnnnnnnnnnnnnnnnnnncacaaactttctacttattatactatatccnnnnnnnnnnnnnnnnnnnnnnnnnnnnnnnnnnnnacattttctaacgttttcaatcaaaacaacttcagaaacactgttacaagcgaacatctgatcaaacaatggacataggcaatattcgtataaatgtgaaagaacgtttggacttncagcaaattcgtttagcgaaatannataataatggcgcttgtggaattgtcaggggcgtacttttaccgtctactactagatgacaccaaaacaattt

SEQ ID NO: 14600 - DNA, 886 bp, Diabrotica virgifera
  misc_feature (121)..(142): n is a, c, g, or t
  misc_feature (282)..(330): n is a, c, g, or t
  misc_feature (493)..(511): n is a, c, g, or t
  misc_feature (823)..(841): n is a, c, g, or t
gatgataatattggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatcccaatcctggtaaaattaaaatatatacttcaggatgannnnnnnnnnnnnnnnnnnggtgatagagaattggatcccctccacagctggatcaaaaatgat

SEQ ID NO: 14601 - DNA, 145 bp, Diabrotica virgifera
cccacgcgtccgatgagctttttattatctctatgactcgatacctatagaaccaagctatggttttaggtatcgagttactaggataaacaatatgctgcatactaaaattaaacccggtactgtgggataagaacatcagtat

SEQ ID NO: 14602 - DNA, 218 bp, Diabrotica virgifera; identical to SEQ ID NO: 7300
  misc_feature (6)..(28): n is a, c, g, or t

SEQ ID NO: 14603 - DNA, 492 bp, Diabrotica virgifera
gggtaataaagggttttatttattggtccaaaacagtatttttaacgccattcactggcacctccccaatttggagcagcagcagctggagcagcaggagcagctggttgacttgtagaccattcctcttgagcaacttcagaagcccaatcttgagtagcccgtgccattgttgctattgaacaccctggtgaagttttcgtaatttcatctcgtccctatggccagcgggctgttcttaagtttgctgctcacactggagctacccctattgctggaaaatttactcctggggcttttaccaatcagatccaagctgaattcagggaacctcgtctgttgatcgtccctgaccctgcttttgatcaccagcctatcactgaagcctcttacgtaaacattccagatattgtatggtgcagtattgattccccagtacgtcttgcggatattgccatgcccggaaactacaaagggtcacccatgattgga

SEQ ID NO: 14604 - DNA, 830 bp, Diabrotica virgifera
  misc_feature (120)..(143): n is a, c, g, or t
  misc_feature (325)..(343): n is a, c, g, or t
  misc_feature (806)..(806): n is a, c, g, or t
gtaatgcagcccgatcgcccgttctcacatatgcgcttccttagaatataaaacgtgccaaacattcttgtaggtatctgatcgaaggaggcttgatcttgaatttgggtactttgtagnnnnnnnnnnnnnnnnnnnnnnnntgtgtttttattgaaccttgaaaatcgtcattttccgttttttcagttttaaattgtttatggctcgaaaacgattgactttggaagaagaattgcaaaggaccttttttgttcccaatgatccagggaacctgatgtggtgtctgcccgggccgcaaaaattgatttttataaattgtttnnnnnnnnnnnnnnnnnnngtgtagcaatgacgcggaagttgtggcatttaggtgtaggaaatggcatatgaagggtagtcagtgtcccttggggattccagggctcaaggaatgtgcggggtgttccacttgaaatagagttcattggatttccgggaaggcgggggatttggcagcaatgttgttgccactgtggtatcggccgcattgagggacccctacccaccgggatctgtaaaaatcgttccagctgtttccgagagggtgacgtgttgccggactttttcgcaaccctgtatgtacctaccataaaaagataatagaaaaaaataaacctttcattatgcgtctccctctcgacgtatacagttcccgtcgagtgatttacggtgactttattttgataaaaccttaaaaatgcaatttgagtaatagaaaatcatagcacggataatccgcaaccccgataatccgcacacgnataatcgggggtctactgtataca

SEQ ID NO: 14605 - DNA, 940 bp, Diabrotica virgifera
  misc_feature (227)..(246): n is a, c, g, or t
  misc_feature (428)..(448): n is a, c, g, or t
  misc_feature (565)..(585): n is a, c, g, or t
  misc_feature (760)..(777): n is a, c, g, or t
  misc_feature (886)..(886): n is a, c, g, or t
gcaatcttgttttattaatacgtattccaataaacggataaatttaaacgagataaattgaaacgtttcgggacctcgaatttattttccattaaccaggatattcctataaccggtactttaataagcgggttcgactgtacaatcttaactacctcagtactttggggtgctctcttgtacaatcacattcaaaaatttagtttgaataacacgtatatacagcnnnnnnnnnnnnnnnnnnnntggattggtacaataatcccttcttttcattcatctgtcattattcttctcaccagagagaaggagaatgagacatggtagagatacatactctaatcattttctctcaatccttcccgaactcccgcttcctttggaaaggaaagtttagtattattgacaaatatcaccgtctcaatatnnnnnnnnnnnnnnnnnnnnnatctccacatcacgtaccagaacgagtacagaaattcaatcactttaaactaatactatcaaagaagaaaacaatacgtatatttaagcaatgtattatgtttatttatactaatcnnnnnnnnnnnnnnnnnnnnntaaatacttttaggttatttgtacatatttcaaagatgaatcccagttttagaatattttgttaattttaatattatgacactgttttttagtttaagttaattcatgtttttgttattaaaatagaaatatttaatgtatacaaattgcacaaggaaacactgaacgatagcgnnnnnnnnnnnnnnnnnnggattttttttcactcgaaaagggcagaaagttagaaattagttatgtactagcatatgaaaaaggtttaggctctctaaaagagtacttcgacaaatgacatatgtangatgtgaatggggcttgctacgtcgttcacattgagtttctgcgcaggtagtct

SEQ ID NO: 14606 - DNA, 803 bp, Diabrotica virgifera
  misc_feature (39)..(58): n is a, c, g, or t
  misc_feature (234)..(252): n is a, c, g, or t
  misc_feature (494)..(515): n is a, c, g, or t
  misc_feature (661)..(661): n is a, c, g, or t
  misc_feature (713)..(713): n is a, c, g, or t
  misc_feature (719)..(719): n is a, c, g, or t
  misc_feature (746)..(746): n is a, c, g, or t
  misc_feature (750)..(750): n is a, c, g, or t
  misc_feature (766)..(766): n is a, c, g, or t
  misc_feature (781)..(781): n is a, c, g, or t
cacggtgccagtagatatcgcataaatcgtttaattttnnnnnnnnnnnnnnnnnnnntgatttacatgtacctctttttataatagatgctcattgctcatgcaaattttcaaaacaattattggtacagtactttttattttagaaattcccaaaaaagtatctatatgaatttcgtacttttacactaggatagccccttaaaatgccacaagaaaataacttcagaccgnnnnnnnnnnnnnnnnnnnattccatttcgacattctaaaaattaacaaaaaattacagaaatacaaaaatttcttacgtttttagcatgaagttcttcaatcaagctatctttttcaactaatgcttgctgaagagtattcaattttttttccgtgttcattttcatattttgtaaactatgattttcttgtttcagaagctctattaagacttgtttttcatcgttgtctgttctcaattgttccgcagtcctttttannnnnnnnnnnnnnnnnnnnnntaaataacaaacagtttttaaaccgttaacagcatctaaagtttttagaaatttttcacaaagtatgttgattcttctcaataagaaacactgcacttcgtgagattgtgtgtttattttttgttctacatctttaatagccttanaagaaaaactgttttagtagaatcattatacgaggtatgtcccgaaagtatntgactntcataacttcacatgcaaaggaactanaggnttttagcacacactgnggtactatgtggaanatgtttaattcataatagcatg

SEQ ID NO: 14607 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14608 - DNA, 896 bp, Diabrotica virgifera
  misc_feature (631)..(654): n is a, c, g, or t
  misc_feature (677)..(707): n is a, c, g, or t
aattaggaccagtaggagaatttaattaaacaccatagctcctacatggaaaatgggacactagatctagaaattgccctacgatgaagaatggtaaggcagtcggacctgatggacccactgccgatttggtttggaaggcttgagaagaggaaggggttgacagagaaggtaaacgaggaggtcccttggccaatatcctttgctcatgatatcgttttaataaagaagaggaaagaattgttggaacaaacctaatgttataatattgttgtttgatatgtactaagctcagagagatgtattgaaacacgacaaattagataaacataaagatatacttagatttgacaaaattcgtgctacataattttttagtacctaatgttataatattgttgtttgatatgtactaagctcagagagatgtattgaaacacgacaaattagataaacataaagatatacttagatttgacaaaattcgtgctacataattttttagtacctcggaagctctagtctcagagaatttagggagtggattctttaatagatgttcatagtatactcttagtctcagagaatttagggagtggattctttaatagatgttcatagtatactcttnnnnnnnnnnnnnnnnnnnnnnnntagaaaaatcgaaataaggatgnnnnnnnnnnnnnnnnnnnnnnnnnnnnnnngggcgccattgctaagggaaccaaattttatacataaaacaatagaaataaaacaaagaaagataaatccaaataaaacaaagacacatagtcaactaaaaaataaacataatatacaaaatattataatgtaacttaccttatttactttatactcaaaattctatactcagtcaattttttactgtt

SEQ ID NO: 14609 - DNA, 902 bp, Diabrotica virgifera
gttgatttttgcttatgtttttttactcacttgtaaatgttggagtatttttgtttaatggaattttaatactttgctaaaagatgtatacacctacctctgtatcactttcaggcccagccttttcatttttgctctacgaaaataccaaatcgcgatttcatcaggaaggatttttacttggagaaatcatcaagaaggagaccaaaacgataacagatagcgatcaacaacaggttaatataagcaaaataatcaaaatcaactctgtggtgccatttcctcaaagccactatatttataatggcactggaaaaatcaacaaagacaaagttagagagtttttaggaaatcaattcagcaaggtcgtggcttggtataagtatcaaaaatgccccaatacaaaactaacgcttagagacaaaataatacacaggcaacttctagaattattcgatattagtgcagaaatgtttacttgttgtttgctaaccacagaaccatcagacaacgcggctactcaccttttttcacaaatattcgttcgttgtaatagcttaggatgtgataatatacctatagtcataccaaatctaagtgagtccaataatatgtataaaagttctgaaacatcttccgagacttttaagaagatattaggtgatataaaaatcgataagagaaacacccaaggactggttattattaataagatacagaatgcattgcagaagcatatcgatacattggtgactgatttagctgaatctgaaagatatctttatgaactggaaaaggaggttagccagcaggagatttataaaaaggtgaaaaagaagaatagtgaaacctttggattcttctaacgctttgtccagtgatcatttaaataattctctaac

SEQ ID NO: 14610 - DNA, 328 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(240): n is a, c, g, or t
  misc_feature (257)..(316): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnccaaatagaaaattctnnnnnnnnnnnnnnnnnnnnnnnnnnnnnnnnnnnnnnnnnnnnnnnnnnnnnnnnnnnnccctttaaagga

SEQ ID NO: 14611 - DNA, 720 bp, Diabrotica virgifera
  misc_feature (7)..(59): n is a, c, g, or t
  misc_feature (61)..(74): n is a, c, g, or t
  misc_feature (116)..(135): n is a, c, g, or t
  misc_feature (193)..(214): n is a, c, g, or t
  misc_feature (216)..(253): n is a, c, g, or t
  misc_feature (302)..(333): n is a, c, g, or t
  misc_feature (389)..(407): n is a, c, g, or t
  misc_feature (560)..(580): n is a, c, g, or t
  misc_feature (585)..(608): n is a, c, g, or t
  misc_feature (614)..(626): n is a, c, g, or t
  misc_feature (628)..(640): n is a, c, g, or t
  misc_feature (647)..(679): n is a, c, g, or t
attttcnnnnnnnnnnnnnnnnnnnnnnnnnnnnnnnnnnnnnnnnnnnnnnnnnnnnngnnnnnnnnnnnnnnccacattgtgtgagactatttcatttttataaccagaaaccnnnnnnnnnnnnnnnnnnnncatcatggactatcaattcaacctcatatatttattattctctcatgtacaacacctnnnnnnnnnnnnnnnnnnnnnnannnnnnnnnnnnnnnnnnnnnnnnnnnnnnnnnnnnnngattcgtttttccctatatctaattcttcaggaaataaactacactccnnnnnnnnnnnnnnnnnnnnnnnnnnnnnnnnctatctcattactattacacattttccggcacgagctcccacttcctattttatgnnnnnnnnnnnnnnnnnnncaaatatacgactacacatttccatcttttacaatatgtgattactcatcttcacataccattatctttacttattatcaatctcttattacaatataaatctaaattatttacatttcgtaatgatgatcatagtattattagaaaattgcnnnnnnnnnnnnnnnnnnnnngttgnnnnnnnnnnnnnnnnnnnnnnnncttctnnnnnnnnnnnnncnnnnnnnnnnnnnaattagnnnnnnnnnnnnnnnnnnnnnnnnnnnnnnnnntatgtccgcgctagtttgaccgtgctaatgtagcataatca

SEQ ID NO: 14612 - DNA, 680 bp, Diabrotica virgifera
cataacgcgtccgctgccgaccggcagtaaaattgtcgacttttcacagacataagaactctcaccatgtctaccagtgccatcactgaagcagcctacctctttgactcactttaaaagctgcatatcaagcccaaaaaaaatgcccaaactgaattagatgtaccaggcgcctatatacccaatcaatatactaatgtaggaaaccctataatatcacgattagcagaagaaattcctagcgttaaaattcctgtgacactatttccatacctccattgagagaaattgaggagataataacagacgagaatttctcccctatcgtgccgaaacatagaaagaatgctgtacaacaaatcaacattttcatacccacccgcgacgtggatgatcttctcccaaaacatgtgtatacaaggcatcgagatagatccgtatctatacaactatgctctatcggatgtaccattgcataaagcacacacccagaacgaacagataccatccatcattacatcctttccctactaatatgtgcacaagaaagaaatcaatcacgatatagtaagaaaccaacatagttcctagccatgcagggacgacaacaaaaataccaagagatactactgctacatacttgaaaccataacatcgtacagactacttcagagaagatt

SEQ ID NO: 14613 - DNA, 871 bp, Diabrotica virgifera
ataagatcttaataagacctgttgttacatatgggatggaaacaatgacgattaacaagaaagaggaaggaagaccttctgaaatttgaaagaaaaataatgagaacaatactgggccacaatgtaacaagatagggagaaataagaatgaaatcaaatgccgaaattgaagaagaattaaagagagaaaatatattctgatgcataaaatcaacccaacgtaaatacgggacatttaggcgtcccgagagactttttcgggacaccgggacaaatcgttaaaaaacgggacaatcccgtttttacgggacgtttggtcaccctatcttaaaccgactggtcagtcagaaacttgtgtttgaaatgtagaataaaataaaatgatcgtacctaaaaattctctcaaatattccagaaaatgtgttggaagtcctcttctcactaattaatgattcttttgagaaaggtaaatttccagagtgcctaaagacagccatcattattcctcctcataagggtggtgccacactctaaacatgagctggatattagtgacactcaatatgggttccgcaatggtatgggcaccagagaggcattattctccttcaacgtgctgacacagagatgtttggatgttaaccgttctctttacgtctgttttatagactacaataaagcgtttgataaagtaaaacatgaccgactcatggaaattctgaaaactagaaacctagatgaaagagatttaagactaataacacatctctattacaatcggcgagcaatagtaagaattgaaaagaaacatctgaagaaatggaataaagagaggagtcaggcaaggctgcatactatcacctctattatt

SEQ ID NO: 14614 - DNA, 889 bp, Diabrotica virgifera
  misc_feature (617)..(635): n is a, c, g, or t
  misc_feature (753)..(753): n is a, c, g, or t
  misc_feature (758)..(758): n is a, c, g, or t
  misc_feature (776)..(776): n is a, c, g, or t
  misc_feature (792)..(792): n is a, c, g, or t
  misc_feature (835)..(835): n is a, c, g, or t
  misc_feature (840)..(840): n is a, c, g, or t
  misc_feature (864)..(864): n is a, c, g, or t
aaaaattaaaattcttttacgtagaattttattactgaacaataagtactcacttttttcgttttcatcatcaatcacacctctactgctgccaacaactgaatgcctacttaatgtcaactgactgcataacttgcaattttatatcttcttctcaagatgccttcttctttcgaaggttggcgattatcacgactatctgtattctgtttacttacagctgccctaaaaagctgctgcgagcaattaaacctctttgatgttgcgtagccatgacatttgtcgccttccaatactacgctttcctattctttcccagcataatattctgcagaagctggtattggctgtgagccgatgagtagaagggatttgacagttttccccagcgctgttagaacaattttatcagaaaagtacaagtttcaaagccaataaaaacagaggtaacctctaaatttcacataaacttcttcttttcctcaatggcctcttgcgtaagcagtgatccagtcgcacgaatttatatattaaacttctacttttactattaattatgtgaattcgttcagtaagcaggttacaataatatttcagttaataatttgtgtttttcnnnnnnnnnnnnnnnnnnnctcgttttgtatatttcacatacaccaattttatcacaaaagtacaagtttcaaaccgcgagacagcgctaccgtcgaacctcatagccaattgtgtttatctcatcacgtaccctanaatgnggcgaataggaacagtgnggtgaataggaacaanactttactaaacaatttacataatcttcctaaacatatatatnacttntcgttgggctatttaatttttttncagttgactaacgtgatatggcttt

SEQ ID NO: 14615 - DNA, 905 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (689)..(719): n is a, c, g, or t
  misc_feature (730)..(765): n is a, c, g, or t
  misc_feature (767)..(786): n is a, c, g, or t
  misc_feature (794)..(816): n is a, c, g, or t
  misc_feature (818)..(818): n is a, c, g, or t
  misc_feature (820)..(821): n is a, c, g, or t
  misc_feature (845)..(890): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttactannnnnnnnnnnnnnnnnnnnnnnnnnnnnnncaaaatttatnnnnnnnnnnnnnnnnnnnnnnnnnnnnnnnnnnnncnnnnnnnnnnnnnnnnnnnntttatccnnnnnnnnnnnnnnnnnnnnnnntnanntaaatttatttttaagctcatccnnnnnnnnnnnnnnnnnnnnnnnnnnnnnnnnnnnnnnnnnnnnnnatattggtaataaat

SEQ ID NO: 14616 - DNA, 678 bp, Diabrotica virgifera
  misc_feature (29)..(48): n is a, c, g, or t
cggacttccagtcacttctgacaactccnnnnnnnnnnnnnnnnnnnnctaacgacagggccaaagagaatctcggcagagcgaatgcagcatatgtgttcctgtccactctgtcaattggctgttggttaaccaaaagctgagtatgtaatatatttcgctcttactaactaccattactttctttttttcgtattgaaattaagtccatgttcactacttatatcttatatgcgcgacattattctttgcaaatcatctaggcctaggctatctgcaaaaactactgcgatgtcggcatatctaatgatgtttagatctatcctctaatccagtttcctccaagatggtttatgagtatgagcttatcatgttgtactctatcaaatgcctttttgtagacgataaaacaaatatataggtacgtcacagttgacatatcttcacctctgcataagcacttggacagacaatagagcctctcgggagcctaatggcaaggcattgcggaatccaatctttgtccatgatacttgttcttcgcattttttatatattctgctgtatatcactcttaaaaatgttttaagcaagtggatcattaggataactattattctgcctcgcatgttgaaatgagaaatgtcatgaatgtgaaaatatatgaggaaaacactt

SEQ ID NO: 14617 - DNA, 990 bp, Diabrotica virgifera
  misc_feature (7)..(30): n is a, c, g, or t
  misc_feature (944)..(962): n is a, c, g, or t
  misc_feature (964)..(980): n is a, c, g, or t
gaggccnnnnnnnnnnnnnnnnnnnnnnnncttttttggttcaaccatctcgatgagtcttcatttgcccttttgtcttaatttttcacatacataattatccctattaaatttgtcttgtcttattcaaaccacacagccataacaatttaataaatttctagggatgcagggcatccctaccatttcgttcgttgcaattcgtaactgcacgccggggtttgtcctggttgggtcagagagagcagcatatgtgcctcctgatgagagactaataagtttcgaaaccggtagaggtgcttgctgcactctctgattgaactagaatataatgcggctgtagtttcgtgtagcaacgaaattgaaaatggttattcatttttgattaataaatttctattgtattcattatcaatttctttttaaccgattaattaatttaagatcttacattagaagtattatcattttcattacatttagtttagtttttatggttaattgttaaaaactttaaatgaatgcacattggttctataatatattacgaaataattaattgctactgattaatatgatatttttgtaacaaggcagtgtatacgtcctattaatagatttttgtcatctcttctttgctacattttgtttctttataaacacggttaaagaaaaaggtttttaggttcggttaagagtcagtttgggatcaaatcattctcacacaacaatttttttataaaggatcaaggctatgtgaagaagaaatgggtaaatgagataaaccattaggtactattaaaattctgcataatgatttattagctgaatataaagctgtaatagatatattatatcttctatattactaaaatgttgatgaaagaaaacactatttacaacaataaggttttttatatttttaatggttcgtatcaatgacnnnnnnnnnnnnnnnnnnngnnnnnnnnnnnnnnnnnataatcatat

SEQ ID NO: 14618 - DNA, 243 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (168)..(193): n is a, c, g, or t
  misc_feature (203)..(231): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtggtttctatcnnnnnnnnnnnnnnnnnnnnnnnnnngaaaggaccnnnnnnnnnnnnnnnnnnnnnnnnnnnnngattaatatttc

SEQ ID NO: 14619 - DNA, 913 bp, Diabrotica virgifera
  misc_feature (294)..(311): n is a, c, g, or t
  misc_feature (394)..(418): n is a, c, g, or t
  misc_feature (744)..(766): n is a, c, g, or t
  misc_feature (838)..(857): n is a, c, g, or t
ggtgtaacgccgacataggattgagtggtctagccatctttgtctgtcacatgcgcgggatcggttggttaaaagagatagatagaccaccgatcgactgtttccatgctgtttccgcgttacgcttttttggtgagtacgccttgtctacgcttaatatgtcaatggtgcaagtacttggaagggaattgagaaacgatcgtgcgcgaatagcggagaaatcttgaaactttcttaaataattcattgtcaattgaaattgtcaaattgacgtatatttcatatctactgtcnnnnnnnnnnnnnnnnnntatgttgctccacaatattgatataatatgcaataattatttaaaagtaaattgaattaattttatttgcttgtagtagtgcnnnnnnnnnnnnnnnnnnnnnnnnnacatacaattgtttaccttttaataacataaccttaatattactttttatgaaaaccacttgcacctttttctccaatatggctataaggtagcgaccccacaaacttgaacttaagtttatactaaccccacctatacataaaaaaattgcgtcttctgaaaaatgcagccataagtgtaacttttcaatggactatatcgaatgatattttgtcgaaagactaaattatttctgcaagtatcactcgatttgtcgttttaacagggtcgtagcattcgttcagtacttatagacgaatttggtgatcaaattagtgattatacnnnnnnnnnnnnnnnnnnnnnnnaaattacggctatactattttctagcctagaaaaaacgtataaaaatgtttaatttgagcaaaaaagtaaannnnnnnnnnnnnnnnnnnngaaaacatacattttctgtaaaaagacttgtttcttcttctacattatgtaaatta

SEQ ID NO: 14620 - DNA, 882 bp, Diabrotica virgifera
  misc_feature (121)..(121): n is a, c, g, or t
  misc_feature (130)..(130): n is a, c, g, or t
  misc_feature (133)..(133): n is a, c, g, or t
  misc_feature (361)..(382): n is a, c, g, or t
  misc_feature (654)..(693): n is a, c, g, or t
  misc_feature (833)..(833): n is a, c, g, or t
aaaacaaatttaaaattttgaacgtttctctttaatttcctataataaacttattttttcataatatattttcttaacaaatgtctatattagtgtattttttagtgaaatataaatatgnctaaaccgnggnttagaaataactataagaaaacgaaaaaatatactgggaacgatccaagtgatgttagaagtctaccaaactatggatatcctggtttaagaatatattttcctgatgataatgacatcaaaatagaattactgaaaaaacgtctagaaatattgaaatcattttttcgtcaaaaccactcatctgaatctcttgaaactataggacgtgacaggttctttacactannnnnnnnnnnnnnnnnnnnnngtgaagaaatcatttctgaatggcctgaatttaaagaagaattattggacaattcggagtatacattaaaatgcatgggattatccatgcatgatctggtttcgaaacattatgaagaacaaaatgagccaaactcaattttattcgatactatattagtacgaatttgtaatgtggagccaataatgcagttgagagatcttcgtgttaattattttggaaaaatggttacgattcgaggcacggtgataaaagctactcaagtgaaactnnnnnnnnnnnnnnnnnnnnnnnnnnnnnnnnnnnnnnnnggaacccaagttttaagacaaccagatggagtttacactgtaccgagtaaatgccagaccaaagactgcagagctcgatcaaatttttctgttgatcacgattctccatttaataaagtgatcagttggcaatctattanaatcccagagccgttatgggctgatcaatatgaaacagcaagaacacca

SEQ ID NO: 14621 - DNA, 973 bp, Diabrotica virgifera
  misc_feature (285)..(302): n is a, c, g, or t
  misc_feature (629)..(648): n is a, c, g, or t
  misc_feature (810)..(810): n is a, c, g, or t
  misc_feature (896)..(896): n is a, c, g, or t
aaagaaaaacgcaaagactcctctaatatatcaagcctacggtattttcggcgtaaataccctttcaattaaaaatttaaagtaacattcatttaaatcaaagtgcttcttatttctcatgtatttgattaagtatcaaacttacagaaaatatgaagtatacatacacactatatttggcagtaattgctatatggtaggagagccttggatgcgtttgtgaagattaggtactaaaacctaaaaaagttaatttaagttttccattttagtggggattctccnnnnnnnnnnnnnnnnnnccatttccaaaaatcggtttttccgattatagcgccatctatccataatttgagaaaaagtttcgactaaaagttacttatttttacgtaaggaaagcaaatctacaattaaaaatgggggtcctatttcatattttaaagtaacccccagctcacctccgtgggggtcgtgtttggtgtcattcgatagatttctgaaaaatattgaacatgtattttttagtttttcgatctgatgttcatttcgcgaaatatcgcgggattcctatttaaaattttaatgttacccccgctccctccgtgggggtcgtgtttgttatggttcgnnnnnnnnnnnnnnnnnnnncaacacgtatttttcagttttttgatctgattttgtgaaatattcgctttttttgtgaaactttctgactcgcccatttcttaatcaccgctaaaatcgatttttcaaatataaactactgctctgcatgtacttaacttaccttatcttaatttgacgttntcgccagggataaatcaggatatttcgttttcgtctaaggatagatttttttacggattgccctcaacgcacgccactatattaangagtcatatacggtaggagtacatttacagggtacaaggtttctccccatgtgatttcctgacgcgcttgagtaacg

SEQ ID NO: 14622 - DNA, 101 bp, Diabrotica virgifera
  misc_feature (4)..(57): n is a, c, g, or t
  misc_feature (74)..(98): n is a, c, g, or t
caannnnnnnnnnnnnnnnnnnnnnnnnnnnnnnnnnnnnnnnnnnnnnnnnnnnnngccgtgatcacaaaatnnnnnnnnnnnnnnnnnnnnnnnnncac

SEQ ID NO: 14623 - DNA, 708 bp, Diabrotica virgifera
  misc_feature (7)..(31): n is a, c, g, or t
  misc_feature (33)..(65): n is a, c, g, or t
  misc_feature (73)..(93): n is a, c, g, or t
  misc_feature (95)..(139): n is a, c, g, or t
  misc_feature (141)..(344): n is a, c, g, or t
  misc_feature (346)..(368): n is a, c, g, or t
  misc_feature (378)..(401): n is a, c, g, or t
  misc_feature (412)..(469): n is a, c, g, or t
  misc_feature (471)..(498): n is a, c, g, or t
  misc_feature (500)..(537): n is a, c, g, or t
  misc_feature (552)..(579): n is a, c, g, or t
  misc_feature (626)..(667): n is a, c, g, or t
  misc_feature (669)..(702): n is a, c, g, or t
tcccccnnnnnnnnnnnnnnnnnnnnnnnnncnnnnnnnnnnnnnnnnnnnnnnnnnnnnnnnnncctatccnnnnnnnnnnnnnnnnnnnnncnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnncattccttcnnnnnnnnnnnnnnnnnnnnnnnnccatattttcnnnnnnnnnnnnnnnnnnnnnnnnnnnnnnnnnnnnnnnnnnnnnnnnnnnnnnnnnncnnnnnnnnnnnnnnnnnnnnnnnnnnnncnnnnnnnnnnnnnnnnnnnnnnnnnnnnnnnnnnnnnnctagcaaaaatatcnnnnnnnnnnnnnnnnnnnnnnnnnnnnctttctcacctgtcttctaaaaacatgtctttctgtattcaatatcnnnnnnnnnnnnnnnnnnnnnnnnnnnnnnnnnnnnnnnnnncnnnnnnnnnnnnnnnnnnnnnnnnnnnnnnnnnncttatc

SEQ ID NO: 14624 - DNA, 164 bp, Diabrotica virgifera
  misc_feature (2)..(77): n is a, c, g, or t
annnnnnnnnnnnnnnnnnnnnnnnnnnnnnnnnnnnnnnnnnnnnnnnnnnnnnnnnnnnnnnnnnnnnnnnnnnncaattgaaattattctcagtttaggaattgaggatattattatcattgaaaaattggatagttagtaagaatatataggtggaatat

SEQ ID NO: 14625 - DNA, 216 bp, Diabrotica virgifera
  misc_feature (11)..(30): n is a, c, g, or t
  misc_feature (33)..(33): n is a, c, g, or t
  misc_feature (63)..(76): n is a, c, g, or t
  misc_feature (78)..(105): n is a, c, g, or t
  misc_feature (163)..(198): n is a, c, g, or t
ggtggatgacnnnnnnnnnnnnnnnnnnnnttnataaagaattctatccttacgttaccaagnnnnnnnnnnnnnncnnnnnnnnnnnnnnnnnnnnnnnnnnnncattattactaagttttttagtattaattcattatatataaaatcatttattgcggtnnnnnnnnnnnnnnnnnnnnnnnnnnnnnnnnnnnncactcactaatttttgat

SEQ ID NO: 14626 - DNA, 569 bp, Diabrotica virgifera
attcattcaatttggagtttataccatgatttatagatcacaaagagcaatagaaagtaaaagataaattcctgtccaatcctttttttatacataattttgcatgcatagagatcgacccacttgggagtttggtagtttttgatgtctcgaatttcttagacctgttgtccagttcgggtgatttttttaaatgtgttatagccttattttttttggcaatacctctgtaataatgttgttgctaggcaggtgaattttcattgtacacccggtataaaatttacctgtgtagcagcaatattgttacagcgatattgccgaataatcaggctataacgtatttaaaaaatcacttgagtcgtacaaccggtttgggaagttcgagacatcaaaaatggccaaatttttgagtgggccgatttctatgcaagcaagtttagtttgccggtttggaacaatgctacaatggtttaaaactatactaatatgtatactgcgtgctactaatatcgaatatgaaggaaattgggccattgaaataatgataattccatatacagtctatt

SEQ ID NO: 14627 - DNA, 565 bp, Diabrotica virgifera
  misc_feature (2)..(19): n is a, c, g, or t
  misc_feature (382)..(399): n is a, c, g, or t
cnnnnnnnnnnnnnnnnnntatttagcccaacaaaaataaatctctaaggagacaaaatctaaaaataacacctgttcccaataaaaaaagaaacacttacgttttatactcacgtttcgcacgtgttgtagtaaaagatatataaaaccttattcaaaactttgcgttttaaaaccaatagtacaaaatgaaaaacctggatgtgttcatgatatttctaactgtaagactagtctccgtgtatttcgttcaaaccttttacgtgccagatgaatattgggagtactttggaagttgtcaataagctgttatatgaatatgtcctattatcgatgttaggaattgttaacatcattgtctgcacaatatgtacgcgtgacnnnnnnnnnnnnnnnnnncttgtgcattacactaagtgggattgatgtcggttcttacaataagaggcggctggctatatttacagatacaggttcacgtgggatcgtatcgaatttatctaaattagaaatagacgggatacatttttcgttagcggatatcaaatatctataggcaaaaagg

SEQ ID NO: 14628 - DNA, 954 bp, Diabrotica virgifera
  misc_feature (5)..(5): n is a, c, g, or t
  misc_feature (787)..(787): n is a, c, g, or t
gttancatatttggaaaatattaatagtttgatgtaaagaataatagtcaggatgtaattaagttttattctcatataacctataatttagtttcaaattactcccgggaatcatacttaatcattaaatcaatatttaataagaaatacaaatgttaattctcagttatagaaccgtctgcaaagcagctgtagcctttcgtagtttggctcttatatcaaacaatccaaagatgtcaaatccggagaactacaaagaagcctcctccatttacgatttcagtgcaaaagatatcaaaggtgaagtggtctctttagaaaaatacaaaggacatgtctgcataatagtgaatgtagcctcccaatgtggttacacaaaaaataactatgcagaattaaatgatttgtttgatgaatatggcgaatccaaagggctgaagatacttgcgtttccgtgtaatcagtttgcgaatgaagaaccaggagataacgccaccatctgccagttcgtgcaaaacaaaaacgtaaagtttgatgtgtttcaaaaaatcaatgttaatggtgacgactctcatcctctatggaattatctgaaatacaaacaaggaggcacccttggagactttatcaagtggaattttaccaagttcattgttgacaaaaatgggcaaccagttgagagacatggaccaagtacgaatcccaaagatttagtgaagtcacttgaaaaatattggtaaataatgttacttgtatatttgctttttatctaagtcatgtaatctanaaaatatttataagtgatacctacaattttatttatgctaaaaactgttaaaaaatcgtttatatacctattcaatgtcttttttatttggttcattttaatgcttttgttttcaaaatctgtaagtatagcttttagattgactgtattcgctttctagtatttta

SEQ ID NO: 14629 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnngaaaggga

SEQ ID NO: 14630 - DNA, 556 bp, Diabrotica virgifera
  misc_feature (20)..(20): n is a, c, g, or t
  misc_feature (29)..(29): n is a, c, g, or t
  misc_feature (31)..(31): n is a, c, g, or t
  misc_feature (34)..(34): n is a, c, g, or t
  misc_feature (73)..(74): n is a, c, g, or t
  misc_feature (81)..(81): n is a, c, g, or t
  misc_feature (85)..(85): n is a, c, g, or t
  misc_feature (101)..(101): n is a, c, g, or t
  misc_feature (160)..(160): n is a, c, g, or t
  misc_feature (187)..(187): n is a, c, g, or t
  misc_feature (199)..(199): n is a, c, g, or t
  misc_feature (219)..(219): n is a, c, g, or t
  misc_feature (254)..(254): n is a, c, g, or t
  misc_feature (355)..(355): n is a, c, g, or t
cccctgaggggcccgggaanacaaaacangncangcagaacttttgcaggacgggcaaggaacaggacgaggnnacagganccanagcggaacggcagccnacccgcacaggaaaccaaaggcagaagaaccaaagagcacagaggagcccgacaaaganggcagcagccacgcgacgaacgggggnagagcaacaccnagacagcacaggcaaagggncacagaagaccaggggccaccagagaaaccagcancggagaacgggaaacgcaaccaaccaacaacacacgggggaaacacggagaaagagaaagcgacaggcgagccagacaacgcaggacgcaccgggcagaangaaaacggcgaaaaaagcggaacaggcaaagggacccccgacggacaaagaaccgagcacgaaggaaagcaggcaaccgccgaaagcgcagaaggcgggggacaaaccgacgggcgcaaagccccaagccgcaacggacaccccggaacagagggaacaacaacgagcgagaaacacgaagaccaaccacaaaaccaccac

SEQ ID NO: 14631 - DNA, 801 bp, Diabrotica virgifera
  misc_feature (133)..(151): n is a, c, g, or t
  misc_feature (579)..(592): n is a, c, g, or t
  misc_feature (594)..(608): n is a, c, g, or t
ctgagctgcagaactaccaaacaaccatattaaatcttaattattaaagaataattaatatagttttatttcaaatctgccatattatcatattaaacatctactgttaataataattcaccaacaacgatgnnnnnnnnnnnnnnnnnnncgtatttactcctctagtgaaaccgtataatttttttacgtatttggtgctccagtgaagcaatctttttgaagccagtgaaaccgaaacactggcagcggtaaaatgcatttattaagcaaacggcgatcttagccgatgtgtcttcggcaatcggcgatgtgcggcctcggaaatgtgtttgggagctgcaattcacgacagttattcgtgaccgttgcatctgtgccgtgtttagaaattctgtttaatttgttttgttcgagcgtgtttaaaacaatggagtttcaatttaaattaggtgtaaataaatttcaaaaacttcactagcaacaacagtttgcaagggcaaaaatggggcaatttcagcgagaaagagcagctaatgaaaaggtggaaagagtatttttaagagttcttaaacccannnnnnnnnnnnnncnnnnnnnnnnnnnnnattcaccacacagcagaacaactagttgagcaaccaatattggaagaaactacaaacgtcataaaacatctaaaaaataacaaagcgcctggcacaaatggaataactgcagaactgataaagaatggtggacatgtgctatggaagagtatccataaactaatcgagcgcatatggacactagaagtcatcc

SEQ ID NO: 14632 - DNA, 923 bp, Diabrotica virgifera
  misc_feature (826)..(849): n is a, c, g, or t
agccaatatggcgaagttgaaggaaatgcaacagcaacaagagagcgaagaatgggtaaatatgaacgaaagagaaagaacccaaaacacttcatatatgcatcacatcggcaatctagctcgcttcgataatattttaggcaaagataccatagggatgcttgaaaaattaacttctaaaattaatctagtttttacccactcgacgatggtcgacaggatagctgctatgttaaattatttcttacttaatcttgttggaccaaataaaaagaactttaaggtgaaggatgccaaagaatatcacttcgatcctgcggatacggttctagaaatatgtaagatatacgtcaacctgaaagaaagcgccgctttttgcctagctgtttctcaagatggccgttcgtatagtcctagtctcttctcgttagcggaagatgtcctggttagaataggcggcgggcctttgataggggaactgaaagaagttgcagccaaggttgcggaaaaatcaagtgaatataaagcgaacgaagaagttttggcagaagcacctgaacattttttggaccctattatgtctacgttaatggctgatcctgttattctaccgagttcgaaacaaattgtggatagaagtaccattgctcgccacttacttagtgatcaaacggatccattcaacagatcacccttatctatggatcaagtgataccaaacacagaattagcccaagaaattagaaattggatagacgagaggaggaggaaagcagcgaatcaatcgtagagcgatttttagatgggtatcaggaagttgtccccnnnnnnnnnnnnnnnnnnnnnnnngttcaatagaattttttctacatgtgtataactgttatatgtttttattcattggtataaattattcagggggt

SEQ ID NO: 14633 - DNA, 820 bp, Diabrotica virgifera
  misc_feature (156)..(189): n is a, c, g, or t
  misc_feature (240)..(272): n is a, c, g, or t
  misc_feature (284)..(314): n is a, c, g, or t
  misc_feature (365)..(385): n is a, c, g, or t
aaatactaataagtcttggtattagtacttttgtaccactaaactcagtcatatatcttaagaagatcaatattatattatatgatgattacacaggtcaacatgaattttgagtctgagttctgtacctctgattttgattacttaagcctaacnnnnnnnnnnnnnnnnnnnnnnnnnnnnnnnnnntttacttttgtacttaccagaactaaatttaaaattttatgaaaaagctcnnnnnnnnnnnnnnnnnnnnnnnnnnnnnnnnncaaattttgaannnnnnnnnnnnnnnnnnnnnnnnnnnnnnngacggcatatgtgaaacccataaatacaaaagagaatacaaacaaactttnnnnnnnnnnnnnnnnnnnnngtacataaggactgtctcttatgagcccacaaatgtagtaacctatcatgttctcattatattctccttcatacagctgttcgaagttcattacatcttggtgaaagcgttccccttgctcttctgaatttgcaccgaagttgtctttaaattgaaccaagtgagcatgtagcatgtgtactttaaggtacatcctgcaactcatgactttgaagctgccaagcatattagaaataagctctttgtaattgtcagcctttgacagttttggaaaaattgtcttaaaaattgaaaggcctcacagcctttacgaactgtttcatgagacttaattttatggaggcattcaagcatgatggggctccacatttaaaactcgctccgatgacaccatgagtgctgctggtagtgaagtacatcggctctattatccca

SEQ ID NO: 14634 - DNA, 802 bp, Diabrotica virgifera
  misc_feature (190)..(231): n is a, c, g, or t
  misc_feature (615)..(615): n is a, c, g, or t
  misc_feature (655)..(655): n is a, c, g, or t
  misc_feature (660)..(660): n is a, c, g, or t
  misc_feature (717)..(717): n is a, c, g, or t
  misc_feature (731)..(731): n is a, c, g, or t
  misc_feature (769)..(770): n is a, c, g, or t
  misc_feature (775)..(800): n is a, c, g, or t
gtgagacagaagaaatgtaaaatgaaaatgtaatatagttataatgtaaagtaaaaatgtaatgtaatgttgtttgttgttgtgctgaggaaagattttatgatgggtcatgataggcatttacatttacaatgtttatatttgttttgaatcttgaatggatgtctcacagtaccgtgtaaatgaagtnnnnnnnnnnnnnnnnnnnnnnnnnnnnnnnnnnnnnnnnnncgaggaatcacacattataaaacaagtctatgcagttccaaaaccaaaatggactagtctttctaatagaagattgcaagattatggaggtattccacacgaaaaaggaatgataccagaaagaataccgagttggttacaagcatatttaaataaaattgctgagttacaaattttcgaacagtgtaaaccaaatcaagtattagtaaatgagtatttacctggacaaggtattatgcctcattctgatgggccgcttttttatcctacaataagcactatttcatgtggttctcacactgtattagaatttgtaacaaatgacgagagtcgaaagaaagtctgcaatatatttttagaaccaagaagtttaatcataattanagatgatttgtattcaaaatacttacattccatttcaganagaanatttgattccataaatgactgtgctaataaagattgttgtcaattagattcctgtgnatcagaactggagnagtcaacgaggatatctttaactattcagaatgttccnnaaagnnnnnnnnnnnnnnnnnnnnnnnnnngc

SEQ ID NO: 14635 - DNA, 601 bp, Diabrotica virgifera
  misc_feature (3)..(15): n is a, c, g, or t
  misc_feature (19)..(57): n is a, c, g, or t
  misc_feature (69)..(100): n is a, c, g, or t
  misc_feature (261)..(298): n is a, c, g, or t
  misc_feature (355)..(377): n is a, c, g, or t
  misc_feature (419)..(453): n is a, c, g, or t
  misc_feature (521)..(552): n is a, c, g, or t
cgnnnnnnnnnnnnnaaannnnnnnnnnnnnnnnnnnnnnnnnnnnnnnnnnnnnnnttaattgggggnnnnnnnnnnnnnnnnnnnnnnnnnnnnnnnncttaaaaggacccaattttacgaccggggggggggaacgaaaaatttttttaaaggggcccccaaatttaatttccggggccggttttttacaccgggggggggggaaaaccccgggggtcccccaatttattcccttgggaaaacccccccttttccccnnnnnnnnnnnnnnnnnnnnnnnnnnnnnnnnnnnnnntccccaaaatttgccccccttaaaggggaagggggcccccccctgaaggggcctttnnnnnnnnnnnnnnnnnnnnnnnaccccaggggggacctttaattttgccgggccccaaggcccnnnnnnnnnnnnnnnnnnnnnnnnnnnnnnnnnnnggttccggggttttccccgaaaagtttaaaagggggggccccttttgggttcccattttggggttttnnnnnnnnnnnnnnnnnnnnnnnnnnnnnnnnggggggggttccggagggggccctcccccctgaaaaaaggttttttccc

SEQ ID NO: 14636 - DNA, 973 bp, Diabrotica virgifera
  misc_feature (815)..(837): n is a, c, g, or t
  misc_feature (943)..(943): n is a, c, g, or t
gagcaataaaagaattcgcagtttgagaggaaagtttcaacaccccgtatcttggaaacgaagcatttgcggacatacgtttatagagcaaactgtcattatgtaacaccctgtataggcccacacaaaaaattattacctccttcatgagacttttttttattgagttattcatgtcgggttggacagcgtttctggtgtgaaaaattttcgggagggggacggttcgtaaatatgggggtttataaactttggtgcatctatggtggttcctgtttatctgaaccatctcagatagttaaggggtggttaccccctactataggggttgatgaagtaacactactcacagtatattcatttatttataagttgaagtaactacggtaaagagttggtggctaaatatttatccgctgtgatgtttacccgctgggatctcaaatacccatgattaatctttacgcaatgaatttagaacgtcgaatgtggaatcccctgtttatgttttggtatatataaaaagtgaaagtgtttgtattataaatgctgaatcaacttgattataaataaagaataatatttgctactacagctgaccttgcattatcgataactgatacacttgtatagtaatataggtcaatcatgtttatgataaacaacgcgtattcgtttaccaaggacatttaaatattaaaagaattagtcttgcccttaataagatggttactaagagatgctgtgaatcccaatacacatccgacaactggagtaagtatccttgaaaatttgtcggaaaatattaccagtgnnnnnnnnnnnnnnnnnnnnnnnctgcaaaaaaacccatcatttatgactctatagtggacgcacatatccacgtatagtccccacatatgaggggtgcatcataaagagtaataaattatacccattngtaacattgagttaccaagtgtcaaaaatc

SEQ ID NO: 14637 - DNA, 359 bp, Diabrotica virgifera
  misc_feature (6)..(122): n is a, c, g, or t
  misc_feature (128)..(150): n is a, c, g, or t
ctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcaccccggtttaaactcaaatcctgtaaaattttaaaaggcaaacagatttaataatatagctggtacaccaattataaactttaatccaacatcgagggcgcaatctttattatcgatttgaactctccaataaaattacgctgttatccctaagggaatttattcttataatcaaaaaaattggatcc

SEQ ID NO: 14638 - DNA, 812 bp, Diabrotica virgifera
  misc_feature (650)..(676): n is a, c, g, or t
  misc_feature (747)..(767): n is a, c, g, or t
ctttcatcttgtcatttcacattcgatgacgtcacactttgaaccgtgaaatatacccacattaaatctacaaaatccataagtttttctggagtggagagttgctaattcagactttacagtagattataatatttgaataatttaaattgcattttcagatatttattagcaacctctacattttgctaaggatccaaagtcaaactacactttttgagctttaaccagggattggctttgtcttgtcatgtcatgtcactcttgtcgtgttgaatgttcatttcctgtttcctcagttggtctgtgcccattgaactggcaagtgcctggcattttcgagcagggaagcatgttgccctttgagcatgtattctattatatctggcagcatcgacttgtagtcgccatgttctgttaaagtataatatgtggaccatatattgtggggttgccactttgggtggtgtgctggtttcgaactgctcagtagaatgtgagtgttcccacatgttttttctttctaacagtcacaattttaacatttttgctttggtctggcgtggaagtgcttcattctaggcactgaggatgttctgaattagaacgaaaacgttttgcaatccatttggatgacattttggatagtnnnnnnnnnnnnnnnnnnnnnnnnnnngcaatttgaagtttttacttctgtatgagttttttaaactatggtatacagccaactattgggattttccnnnnnnnnnnnnnnnnnnnnnatcatctttccacctacattttccatcttgttctggatcgatatc

SEQ ID NO: 14639 - DNA, 51 bp, Diabrotica virgifera
  misc_feature (4)..(48): n is a, c, g, or t
tgcnnnnnnnnnnnnnnnnnnnnnnnnnnnnnnnnnnnnnnnnnnnnnctc

SEQ ID NO: 14640 - DNA, 848 bp, Diabrotica virgifera
  misc_feature (7)..(47): n is a, c, g, or t
  misc_feature (67)..(133): n is a, c, g, or t
  misc_feature (135)..(168): n is a, c, g, or t
  misc_feature (180)..(286): n is a, c, g, or t
  misc_feature (288)..(364): n is a, c, g, or t
  misc_feature (367)..(451): n is a, c, g, or t
  misc_feature (466)..(533): n is a, c, g, or t
  misc_feature (538)..(553): n is a, c, g, or t
  misc_feature (555)..(575): n is a, c, g, or t
  misc_feature (579)..(598): n is a, c, g, or t
  misc_feature (613)..(630): n is a, c, g, or t
  misc_feature (641)..(664): n is a, c, g, or t
  misc_feature (676)..(732): n is a, c, g, or t
  misc_feature (775)..(797): n is a, c, g, or t
  misc_feature (800)..(842): n is a, c, g, or t
aatgggnnnnnnnnnnnnnnnnnnnnnnnnnnnnnnnnnnnnnnnnngtacctggggtatcagggannnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnngaaaggttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnggaggataatattannnnnnnnnnnnnnnnnnnnnnnnnnnnnnnnnnnnnnnnnnnnnnnnnnnnnnnnnnnnnnnnnnnncccgnnnnnnnnnnnnnnnncnnnnnnnnnnnnnnnnnnnnncccnnnnnnnnnnnnnnnnnnnnggaatggccgcggannnnnnnnnnnnnnnnnnaagcataatcnnnnnnnnnnnnnnnnnnnnnnnngatgaagggtgnnnnnnnnnnnnnnnnnnnnnnnnnnnnnnnnnnnnnnnnnnnnnnnnnnnnnnnnngaaagcttaaatgtttttaaaaagacgagaaagacccctatannnnnnnnnnnnnnnnnnnnnnnggnnnnnnnnnnnnnnnnnnnnnnnnnnnnnnnnnnnnnnnnnnnggcgcg

SEQ ID NO: 14641 - DNA, 81 bp, Diabrotica virgifera
  misc_feature (7)..(48): n is a, c, g, or t
catctcnnnnnnnnnnnnnnnnnnnnnnnnnnnnnnnnnnnnnnnnnnatatcaactcaataattttttgatcccattttt

SEQ ID NO: 14642 - DNA, 801 bp, Diabrotica virgifera
aattcagaatggaaaaagtgttgtttgtgctgatggcactgtgcttgtgtcaaggcagtttaggccaactctgtcgttgcccacgtggcgaaatttggaacaattgtgcgtcgtgtgatcctgaggctacttgtcaaaacagaatcccggaagctccaggtatctgtccagctgtttgtcaacaacgttgtgaatgtgactctaaaaatgggttaatccgtgatcaaatctctggagcatgtgtgcctatagacaaatgtccaggttgttcacggggagaaatatggaatgaatgtgcctcgtgtaatcctgaacctacctgccaaaacaggacaagccaaatcccaaaaatttgtccagatgtatgttatccacgatgcgagtgcgatgctaatgctggatttataagagatgcaatttctggacaatgtattcctcgggaacaatgccctgcaggtcagtgtggcccactagaagttcttaatgaatgtgcatcaccgtgtgctcccgagcgaacttgccgaaatcaatctcccgatgttcccgattcatgtatacttccttgcgaacaaagatgcgaatgtgatgaaaaacggggattaataagagatgaggaaaccggcaaatgtattgatatcagaaaatgtcaagcaggtcattgtggcccactagaagtttttaatgaatgtgcatcaccgtgtgttcccgagcgaacttgccaacgtcaatctcccattggccccgacgcttgtatcctttcttgtgaaacaagatgcgaatgtgatgaaaaacagggattaa

SEQ ID NO: 14643 - DNA, 160 bp, Diabrotica virgifera
  misc_feature (2)..(28): n is a, c, g, or t
  misc_feature (42)..(42): n is a, c, g, or t
  misc_feature (54)..(76): n is a, c, g, or t
  misc_feature (78)..(90): n is a, c, g, or t
  misc_feature (116)..(136): n is a, c, g, or t
gnnnnnnnnnnnnnnnnnnnnnnnnnnntatagagtttatanattattcatagnnnnnnnnnnnnnnnnnnnnnnncnnnnnnnnnnnnnctggcgtgattacaaataatttactnnnnnnnnnnnnnnnnnnnnnctaatttttgattccatttttttg

SEQ ID NO: 14644 - DNA, 807 bp, Diabrotica virgifera
cctctgttacaaaatgattaagtaatctttgttcactttattgtttgctatagttttccgatcatcattcggattccgagagaagatcttatactataaagatgtgcaagtattggtggctgctggaccatcaactctaaaaactcaacctgcatatcttactctataatctaaactaccagaagttcaaactttagaatgcccataccactatcaattctaactctaaaatccctcctaccgaaaagtcatactttataagctatacctgaagttttactctagaagccagaccaatcaattgcaacacttgaagctagacccgaattttcatctcttgaattgaaaccataagtatcaacccttgaattaagtccaaaagtattcaacacctgaacataaactaaccgttaatgacaagatgtttatgatcttacaatgtgttgaaaaacatgctaacaaatcaatctcccgactaatactaaaatattatattggctattattataggatgactggatgatagagacatgctgagaacatcaaaatgatgatgacttatataacaaggtcctcccataccatccaatagatgaatgctgatgcatcccatgctattgacaccatcaaacaatgagttataggattagatatacaggctgaactaaccactagagcgatgaagcaggtcgatagactaacaacagcgatcaagtaacattgatgatgtcttatcccctgagacatagattgaaggattgttatgaacttactattatctataactgattcctattattataatat

SEQ ID NO: 14645 - DNA, 750 bp, Diabrotica virgifera
  misc_feature (455)..(475): n is a, c, g, or t
cttttgtttcttgcgatctgctcatcttcttatctaaaaatactgtaaccttcctctgtacccggaacttctccactatgagccctgctatccccgttgatcatagagctacctgtgcttcttattgacattggtaggtcctgcatactgaagcggagtcttgtgatcatgtgacattcttgtaacgttcccccacctttctactcgattcttccctccatacgtcattcctgaatgctaccaccgagacatcaccgatttttatcaaacgatgccgtcctccgatctaaatgttgctataggtgaaccgaaaattactgctcctccctcatatccatatgtgatgatggaacaaccgtctgcatatccttgcactacgcgaggccacatgagacaacaacttattcatgattataccgacgctccttgaaatactcgatcgaacaccttcgccnnnnnnnnnnnnnnnnnnnnngatttccatcctattgctgttccatcacctgctgtttgaccttactctctcgtatcccatgcttcccgaacaatctgatttcaaccatatacaggctcccctctgccgttgaaatcctacatcaacctcatgtggccccgaaggacatggacctagacccccccgatgagtcaccctctcaacatttgctgtcgtcccacttaactgagactacatctatcatcttctaaatttaattcactttttagaattgtatatatcacccatctcgctcc

SEQ ID NO: 14646 - DNA, 157 bp, Diabrotica virgifera
  misc_feature (12)..(32): n is a, c, g, or t
  misc_feature (35)..(94): n is a, c, g, or t
  misc_feature (109)..(146): n is a, c, g, or t
catttttttacnnnnnnnnnnnnnnnnnnnnncgnnnnnnnnnnnnnnnnnnnnnnnnnnnnnnnnnnnnnnnnnnnnnnnnnnnnnnnnnnnnctcggcgtgattacnnnnnnnnnnnnnnnnnnnnnnnnnnnnnnnnnnnnnnctttttgatcc

SEQ ID NO: 14647 - DNA, 301 bp, Diabrotica virgifera
  misc_feature (2)..(88): n is a, c, g, or t
  misc_feature (90)..(108): n is a, c, g, or t
  misc_feature (110)..(144): n is a, c, g, or t
  misc_feature (212)..(269): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnncnnnnnnnnnnnnnnnnnnnnnnnnnnnnnnnnnnngtaaaaagcttcaaatttttttaaaaggaccaaaaagacccctatagaagttctataaaaattaatcnnnnnnnnnnnnnnnnnnnnnnnnnnnnnnnnnnnnnnnnnnnnnnnnnnnnnnnnnnggggctttaaaaaataacttcacctttttttt

SEQ ID NO: 14648 - DNA, 755 bp, Diabrotica virgifera
aatgataactttgggtggggatgctgattttgaaatggttgatacgtatgatccattttcagagggaattcagtttaatgtgaggcctccgaaaaaatcttggaagaaaatttctaacttatctggaggagaaaaaacgttatcatctttggcccttgtctttgctctgcattattacaaaccttcgccactttatgtaatggacgaaattgacgcagccttagatttcaaaaatgtgtcaattgttggaaattatattaagcaacgtaccaaaaacgctcaattcattataatctcccttcgatccaacatgttcgaactgtgcgataatctcataggaatttacaaaacgtacgattgcacgaagtctataacgatagatccaagagtatatgacgagcaaacaaaacataacgaaaagcgagtgtcgcttggatcgaccaacgaagagagtagacgaacgtctgtgcccgcttctggtactggagattctggagataaaaatccagaaagaaatgttagcaatgaagttgtagacgaacaacgttcgaacttgatggaggttgataatgtcatccagagtacaaataatgccagggattcatctggtctgtctagtagcatgagtgaaaatgaaaatagtttacaagaatcccaagtgcctgaaatatgaaggggtcagtttcgtgatttagttactacttcttgatataaatgtagcatttttagttactttaatacatttacatatttgt

SEQ ID NO: 14649 - DNA, 697 bp, Diabrotica virgifera
  misc_feature (2)..(690): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatt

SEQ ID NO: 14650 - DNA, 867 bp, Diabrotica virgifera
  misc_feature (747)..(774): n is a, c, g, or t
  misc_feature (832)..(832): n is a, c, g, or t
agaggataaaacgatctatatgttgtataggtacaataaaatctatacattcaaactatcatacgctattggtttagccgaacccctttccattacagtatttgattatggaacttcaaaactcactcaaaaggaattgttggacattgtaaacaagaacttcgatttaaggcctggtaaaattgtcaaagaattaaatctgagacaacccatctaccaaaagaccagcacctatggccacttcggacgggacggttttacgtgggaacagcccaaaacactacaactaaactgacaaccttccgtaacaatattttagaaatcttttattgacgcactagatgcctccttctagattttaagttcagaaaaaacttctgtgattggcgctctgaaccttgagaccgacgcgattttttgcctctctgaatcggaaacattctacagagcaaagtatcgcgtactaacaagtaactgtcgcaaaacgtgcccacagattcccgatatagaccacagtggcgtttcaagcgttactgcaattcagtgtgagtcaaacgttcagtttcaagttagatattactcgcacattgtgttgtgtttaagagaaaaaataatttggaaaagagcatttctataaacactccggactgtattgggaatggtggtcatccatgcatgaaaagttcttgcaaaaacaatatttatatattatgtattttatacaactcatcagtgttcactggttgnnnnnnnnnnnnnnnnnnnnnnnnnnnncctacaactctacattccttgttattttaaaataatcgtcaaattaacatagaatttngcagaaacatgtacaatgggcatttaagatctgct

SEQ ID NO: 14651 - DNA, 106 bp, Diabrotica virgifera
  misc_feature (2)..(100): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacag

SEQ ID NO: 14652 - DNA, 609 bp, Diabrotica virgifera
  misc_feature (2)..(479): n is a, c, g, or t
  misc_feature (506)..(506): n is a, c, g, or t
  misc_feature (558)..(578): n is a, c, g, or t
  misc_feature (594)..(594): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagttncaatcgataataaagattgcgacctcgatgttggattaagtttataattggnnnnnnnnnnnnnnnnnnnnngtctgtcgacttttanattttacatgatctg

SEQ ID NO: 14653 - DNA, 700 bp, Diabrotica virgifera
gtattatagatcgaattgaaatatgctattttgtgagatcacagtaatgaatagaagggagatactattcgcacaggagtaacaactggaaaaaaatatgcttagtggatgtaagagcaaacccttataaatgtgtccctcgcgtatccagtctaaaaattaatcattaaactaatcctccttggcacataaatatacccagctttcttacaactactattggaaggtataccactaccatctactgtagggatgccttccaaccagtatgtcaaaaaacattatccctgactataaagtacggagaatacaatgatttattaacaccatagatacagctaggaatctatccatactgagcaatagctataggcacgctagatctagaacaaagaagcatactgatgcccttctaacgagtacaatacgattaagcatattctaatcatcacacatactataagaacactttacacataattatggaaatatgcaatatctggatcaggaaatactatcggtgattaatgccgatcatacttagaagcgaatcttcaaatgtgggctttgtatattacggaaagatatgcaagaacggtacccgaagtaccaaaaatagtttttcaccggcatcattagaatttgtatgtggtgcaatgatagtggtgatactctccaccactgattatcctgtatgcgc

SEQ ID NO: 14654 - DNA, 832 bp, Diabrotica virgifera
aggaatcgagagtgctgtctaggtaccgtcttcctgaaatagttccagctccagttccactgtgcagtcaccactagtcaccaccaacgccatcagccaatatccctccacctacctatctgccagagcctgcagagagacttcaacacaaacaaaaattagtacggtattcaagaaaagatcagccgtcctagagtgaaggtaataaagtccccttgggacgctgctttagaaaccgggtcagttgacgcagcttttgttgaagaaccaacttggacaacgaaaggcaactacgtagctcctgatgtaaattcgtacgaagcagctctgaaaaacgattcattggacaattggagcgtaccgaagtccaacgaccagaagatgtacgctcaaaatccaagctataacagcaacagcatcaataaaataatcgatggtaaccagaaaggatcgagcaatgttgatgaatataaaccaacaatgcctcaagggtgggctacccataaacaatttggatcgaacactctaccaagaactaaaccaaagtctacagcctcaccaacttacaaaccaccaggcagcccttcagttttcatccctaaagaaaggcccagctattttactccctctgaatctgaacctaactacaattacaaaccctctttgcaaatatcggaagcgcccaagccaaccaaaatcctggacttacacagtcttcaatactataatgtatcaccaaagggatggacagaagcaaagaattactacaagacactgagttatagccaatccagagaaatgtactctgatttttagatagcagttcatattt

SEQ ID NO: 14655 - DNA, 61 bp, Diabrotica virgifera
  misc_feature (30)..(55): n is a, c, g, or t
gtttttgtagtattaaattcatttatatcnnnnnnnnnnnnnnnnnnnnnnnnnngaaaat

SEQ ID NO: 14656 - DNA, 629 bp, Diabrotica virgifera
  misc_feature (83)..(108): n is a, c, g, or t
  misc_feature (136)..(156): n is a, c, g, or t
  misc_feature (281)..(304): n is a, c, g, or t
  misc_feature (306)..(343): n is a, c, g, or t
  misc_feature (353)..(397): n is a, c, g, or t
  misc_feature (468)..(493): n is a, c, g, or t
  misc_feature (495)..(515): n is a, c, g, or t
gctaatcctcgtgctttgaccttagtttcgtttctgtatctttggatacttcttcaagattgtgaaagaatattgtgtattgnnnnnnnnnnnnnnnnnnnnnnnnnncctagtgtttgaagcttgagtatttagnnnnnnnnnnnnnnnnnnnnncataatattatatacgtatataattaagatatttattgaaaattattaatgtaaaataattatttgagaaaagtaatgctgaaacgaaatgatatatctctatatgtttatcaaattatttaggnnnnnnnnnnnnnnnnnnnnnnnncnnnnnnnnnnnnnnnnnnnnnnnnnnnnnnnnnnnnnnggaatatgcnnnnnnnnnnnnnnnnnnnnnnnnnnnnnnnnnnnnnnnnnnnnncagataagaactaagacataaaataatcttagttaataataagttataaataatattaatgtaatattcgnnnnnnnnnnnnnnnnnnnnnnnnnncnnnnnnnnnnnnnnnnnnnnngatgattagagatgaataaaatagtagtaaattaacgcaaattaagtaggaatatataggcgaattctacgaattctgtatcacctgtttctcaagaacatgaattactggatt

SEQ ID NO: 14657 - DNA, 871 bp, Diabrotica virgifera
  misc_feature (562)..(651): n is a, c, g, or t
  misc_feature (781)..(781): n is a, c, g, or t
cctgccagtagtcatatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgngccggtacgtttactttgaacaaattagagtgcttaaagcaggccaaaacttcgcctgaatactgtgtgcatggaataatggaataggac

SEQ ID NO: 14658 - DNA, 862 bp, Diabrotica virgifera
  misc_feature (608)..(626): n is a, c, g, or t
  misc_feature (674)..(674): n is a, c, g, or t
  misc_feature (720)..(720): n is a, c, g, or t
  misc_feature (726)..(726): n is a, c, g, or t
  misc_feature (787)..(787): n is a, c, g, or t
  misc_feature (814)..(814): n is a, c, g, or t
  misc_feature (818)..(818): n is a, c, g, or t
tgaagatcctagtgcggaattcgaaaggataaaacgcgaaagggaagaacaatataaaccaaagttattgattgatgtaaatttagagcattggaaacagaaagaaagggaaaaggagagggaattggaaaggcaaaaagcccgcgaaagagaaagaatgcgggaattggatagagaaagagacagacaacgaaaacgagaagaacgagaaaaaaggtacattatggaacaagcagctcaggaattagcagcagtggaggcggaaccaatcgatagtgatagtgatatggaagctgataatcattacagtcctgctcctcctgaaccagaccctgtttctatggataattctaattcggctcagtggacccaagtgcaagctccagacgaagattccaagcattcgtttatatcaaatcatgacgaacacgtagttccacctaccagtacgggaatgaagatcaccttagctaaaccaattactttacaatcaccaactagagattccaaacgacgaaaatcggatcttagagaagtgtttaatccagatgaggacgatagcaatactcaaattaaaaaacggaaattagtacccttagattataacnnnnnnnnnnnnnnnnnnngagagaaagaaaatggtgaaagcaaaaaatcagaagaatcgaaatctncagaggaaaaacgtagaaatatcaaatctttaatagaacgattccnactganaaagaagccctatttgcgtatcatctagactggagtgccatagatagtgttcttatggaanagaaattagaccgtgggataatagaanatantagaatatataggggaaccagaaccaacgctagtagattttatt

SEQ ID NO: 14659 - DNA, 240 bp, Diabrotica virgifera
  misc_feature (27)..(27): n is a, c, g, or t
  misc_feature (80)..(102): n is a, c, g, or t
  misc_feature (113)..(113): n is a, c, g, or t
  misc_feature (162)..(193): n is a, c, g, or t
  misc_feature (200)..(230): n is a, c, g, or t
taacagcgtaattttattggagagttncaatcgataaataagattgcgacctcgatgttggattaaagtttataatgggnnnnnnnnnnnnnnnnnnnnnnntggtcgacttntaaattttacatgatctgagtttaaacaggtgtgagccagggttggttnnnnnnnnnnnnnnnnnnnnnnnnnnnnnnnngaaaagnnnnnnnnnnnnnnnnnnnnnnnnnnnnnnngaataatatt

SEQ ID NO: 14660 - DNA, 866 bp, Diabrotica virgifera
  misc_feature (533)..(551): n is a, c, g, or t
  misc_feature (595)..(612): n is a, c, g, or t
  misc_feature (624)..(624): n is a, c, g, or t
  misc_feature (686)..(686): n is a, c, g, or t
  misc_feature (783)..(783): n is a, c, g, or t
  misc_feature (809)..(809): n is a, c, g, or t
catgtatatcttcacttcatgtctatacgcttttctggtgttattagtgacatcatctaatgcccaagaccagaatgagcagaaggtcacagttcgagtatatcatgaatcactatgtccctatgctaagaagtttattgtagatcaacttgcacctacgatgaagggaaatttgtcaagatacgtcaatctagaactagtaccttatggaaaagctaaggaaatccatttagcaaatggtacacaatattatgaatgtcatcacaaagtccaagaatgttatggtaaccgtatccaagcatgcgtagacaaccacattgaaaagtccaaacgggaggagtatttaagtttcgttagctgttttatgggtaatttgacgacaaatgtcgagaagaaacaagttgatgatgccttaaaaagatgtatacctgaacctctagatgttgaccaaatacgtaattgcactataagtccattaggcgataaactcatcgagaacaatgcaaaaattacaaatggcttccaaaagcctnnnnnnnnnnnnnnnnnnntagtgtttaacggagtctacaatccatcggaaagttcagaagcnnnnnnnnnnnnnnnnnntgtactttgttncaaaatcaagggaaagaagccagaggaatgtgccaatttacctaacaaaggtggtgaatccnaaatccaagatgccaatttaactaacaaaagtggtgaatcaaaatccaaagatgccaatttaactaacaaaggtgttgaagcaaataaagtctatantcgaacgttacttgtagcattgttgntaatattgtacgtataactgtatgttttgcaaaattaaaataaacatttatgtaagc

SEQ ID NO: 14661 - DNA, 280 bp, Diabrotica virgifera
  misc_feature (2)..(251): n is a, c, g, or t
  misc_feature (253)..(265): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnncggtgattacaaatc

SEQ ID NO: 14662 - DNA, 764 bp, Diabrotica virgifera
  misc_feature (7)..(42): n is a, c, g, or t
  misc_feature (44)..(71): n is a, c, g, or t
  misc_feature (73)..(121): n is a, c, g, or t
  misc_feature (123)..(141): n is a, c, g, or t
  misc_feature (144)..(274): n is a, c, g, or t
  misc_feature (276)..(373): n is a, c, g, or t
  misc_feature (412)..(454): n is a, c, g, or t
  misc_feature (456)..(485): n is a, c, g, or t
  misc_feature (493)..(510): n is a, c, g, or t
  misc_feature (515)..(534): n is a, c, g, or t
  misc_feature (565)..(606): n is a, c, g, or t
  misc_feature (619)..(646): n is a, c, g, or t
  misc_feature (697)..(718): n is a, c, g, or t
ctaaaannnnnnnnnnnnnnnnnnnnnnnnnnnnnnnnnnnncnnnnnnnnnnnnnnnnnnnnnnnnnnnncnnnnnnnnnnnnnnnnnnnnnnnnnnnnnnnnnnnnnnnnnnnnnnnnncnnnnnnnnnnnnnnnnnnnctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatcaggattaacaattttcatattttagaatatgtnnnnnnnnnnnnnnnnnnnnnnnnnnnnnnnnnnnnnnnnnnncnnnnnnnnnnnnnnnnnnnnnnnnnnnnnngattcacnnnnnnnnnnnnnnnnnncatcnnnnnnnnnnnnnnnnnnnngaaatatataggtctagtaaaggaattcgcnnnnnnnnnnnnnnnnnnnnnnnnnnnnnnnnnnnnnnnnnncattaaatatagnnnnnnnnnnnnnnnnnnnnnnnnnnnngtggccgcggtagtttgaccgtgctaatgcagcataatcatgagtttctcnnnnnnnnnnnnnnnnnnnnnnctggatgaaaagaaaactgtgcttatttactgtataaagaatttta

SEQ ID NO: 14663 - DNA, 847 bp, Diabrotica virgifera
ataaaccactactaaatttggaaaggactgtaacgtaacaagatactggttgaatgcagtatcgaaaattcgaaagacatgccagaccagtttagctgttctagatgaaggaaaaaggccagtgtagagagtatcggaataaaagcgcaggtaatgcaggtaatgcattgttctatggagaagatattaggcgttacttattgtcacagcagttacaagccgaagaacttgacttagcaactgccatgcatctaatcaaaagtaccaaagaagaacttaaaaaatccagaactgacgacacataccgcgaggttttagaaaaggctaaatctttgacagacagtagtggtgttttatttgacgagcaaaaaaggacgatgactgttcctcatagactcgctataagcgtattaatgtcaacaactggcaataaatataccgaaacaaaggcatatacttcgaagttaaagatagcattctcatggaacacaatcgtcgcttctcagaaaatgaaggtctgttcccagtaccggatgcctttaagaaagaaaatcaagcattcatggcggaagaggaattaaagccattaatagaaaactacaaaaattttctaaatatataacttctacatctgcaactgcctttagccaataaccatttacaaacatgcgatgaagactccgttttgtcactactcgaatctctcggagtgcttctagtggcatactcagaagtgattcatatttgtgctacactgcctatcaccacagttggaaatgaaacatttttctctgtgctaaaaagagtaaaagggtaggtacctgcgaagttctactggtgatgaaaa

SEQ ID NO: 14664 - DNA, 74 bp, Diabrotica virgifera
  misc_feature (9)..(61): n is a, c, g, or t
  misc_feature (69)..(69): n is a, c, g, or t
attattaannnnnnnnnnnnnnnnnnnnnnnnnnnnnnnnnnnnnnnnnnnnnnnnnnnnngtgattanaaaat

SEQ ID NO: 14665 - DNA, 57 bp, Diabrotica virgifera
gacgtctgggtggtgcgattttatatccagaaaatatcaaatatctgctcttcaaag

SEQ ID NO: 14666 - DNA, 681 bp, Diabrotica virgifera
cgatagtgagaagtgaagacggtggtcctttgaagaaagatgataaaacattatgtcttggactgagagttagcatgctccctaatccttttggaaaactccttcagaggagtcgactttgctgatctcccaggtccgcattgtgaaaacataggatgctggaacaatagattagagtcttgttcagtgtcaatgttggtgaccttatgatactgacaccaattataggacacgggtagggaggatgactgttgcgcatagtactgaacgcactgatagaggtataactttcacaactacagaacgaacacgtccaacacccccacgacccccatataacataaccggatgtacgaggggagacagaactatcttccttggccaaaaagctaatgataaatgcaatgcatgtacatgcgtcagacaatcctaagtcttgtgccaacgagaagaatgtcttgctgaccataacttgcattgcaactgtgaaccaaactccgcatggatttggatgtacggatgaggactattccgagttgcagaacaagtatagaccgagggagtccaattcgatatatgaacacttcccccgcagcggtttgtaaatgacaatagcatcccataagaagagtttccgttccataaatcaatcccccggagatttccgatcaaaattcagtg

SEQ ID NO: 14667 - DNA, 388 bp, Diabrotica virgifera
  misc_feature (2)..(265): n is a, c, g, or t
  misc_feature (267)..(387): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 14668 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14669 - DNA, 134 bp, Diabrotica virgifera
  misc_feature (10)..(132): n is a, c, g, or t
gtaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnct

SEQ ID NO: 14670 - DNA, 154 bp, Diabrotica virgifera
  misc_feature (13)..(49): n is a, c, g, or t
  misc_feature (51)..(66): n is a, c, g, or t
  misc_feature (73)..(73): n is a, c, g, or t
  misc_feature (108)..(140): n is a, c, g, or t
catttttttaccnnnnnnnnnnnnnnnnnnnnnnnnnnnnnnnnnnnnncnnnnnnnnnnnnnnnncacattnatttatactcataatttatctaattcgccgtgatnnnnnnnnnnnnnnnnnnnnnnnnnnnnnnnnnatatcaatcactaa

SEQ ID NO: 14671 - DNA, 844 bp, Diabrotica virgifera
  misc_feature (107)..(129): n is a, c, g, or t
  misc_feature (799)..(799): n is a, c, g, or t
ctatttattaattcaagattataacaacattgttcatatcaaggcattttatgtatgtggtcaacgcttgtgtacaaataaattagcacaaaaatgcccaaatgtcnnnnnnnnnnnnnnnnnnnnnnnctaataacaacttacgacataaaacaaatcaactcatcttattaagagtctggattaaggattcggttttattattgattcgtacaagtatgaggtaaccgacaattactgagcctaacgttatgaacattcctatcgattcgaaaattagtttcggtgcaaatatgttccataccatcaaatggcgacaatggatcgtggcagctagcatacttgcaaatacccgtattgcatgtcctaaaatatatttcgcagctaatttaaacatcgacgttaacatcagtctatctctttcaaacaaaataacttctcctctagaagcctctactctaaactcctgttttttctcgcaaacggaagggatcattacaaatactgtgaacggcgtgattaacaataatggcagcaatactcccattaaaatatacgaacaaaatgtgttcaggataatcaaggttccgggaataacgttattggaaaatgttccagttgtgcctataaatgcagcttcccaagaaatgttaggaaacgacggttggtgtcctgtggcgtagaagaaatattgtgccaaaatgatccatatgagtatcgatatattcggaacgtcaaacagttgttctatatctgtcgccttctcaattcgtaatacggatgttactatgagaacaancgcagctgctaggaacataatcactgaagatggagctactgcatc

SEQ ID NO: 14672 - DNA, 802 bp, Diabrotica virgifera
  misc_feature (351)..(371): n is a, c, g, or t
aaatcggactatagggttgctctagagaccgctgtagatattctgtgctctcttgatgaaggtttggatttgtaaatcatcctgccaaatgcgtcgaactagtgtccaagattattggaagtacgagtcatgtgccaatgtgaaccatctacaacatcaagagacaccacacccacaactaaagctcttcctacagaaaccactgaagacaaaccactggaactacaggaataggaacttctagacccacaagcactggtgcacaaactgaaactacagaaactgaattcggctgtcaaactggctggacttcttggattaacccatatgatcctagaaactaggatgaannnnnnnnnnnnnnnnnnnnnccagttccttctaatgaaatacttaaatacttgaaagattcacctaaatgtgattccaatatgatggtagatattcaatgcccaactgttaaagatcttgaatcagcctacaaagttgctcaataaactggatctgcacattgagtgttctcttgagataggcttaatttgtagatcttcaggaaatgaatccaaatgtccagactttgaagagaagttcatatgtcccgtgagaaccaacaacaattacacaagccatctcccaaccccaccaacagacaccaacacacctccaacaataccacaagcaatccttagatctttgcaatggaacgctgctcatccagtataaaatgctcattgaccacttagacccctactacatcattaaattgtaagcataagatgtatatacattgttatttttatgc

SEQ ID NO: 14673 - DNA, 990 bp, Diabrotica virgifera
  misc_feature (461)..(481): n is a, c, g, or t
  misc_feature (623)..(655): n is a, c, g, or t
  misc_feature (825)..(825): n is a, c, g, or t
  misc_feature (919)..(920): n is a, c, g, or t
  misc_feature (935)..(935): n is a, c, g, or t
aacgaatgccaaacctatgagggaacttacacatttttttattacgtaatattattcagtttcctttaaaaataatatttccaaactttcacgcggtaaaacctcataataacttagaagataatttaaaatctatatatttttttctgttttctggccttggtttagaagaacccttagccaatgtaaaatagttcaaactatcaaaaacgcttgtgacgttacattactgtattttctactgacgtttatagtgtctaatttaaaattatatacaattttgtttactttgttggtgcagaatgtacatgcacaactatatgacgtcaatatgcgttttggaccacctgttttaatttgaatttttaatcgtctttaggggccaaacgaaagacaaacaaaactttttttatctttgatacatgttttaaattatgttctgttgtgatttataacatttnnnnnnnnnnnnnnnnnnnnngcaagttccctatttacacaaacaatttaatatttccaacaagagcattatttaaaattccttgttcccgctaagggatagggacttcacatcctagcagggggcgttaagacgctagaaaaccggaagataagtatagctnnnnnnnnnnnnnnnnnnnnnnnnnnnnnnnnnacatcggttatgactataaatatctgaaaaatacatacatacttgtaaagtaaacaccactcttaccattttctaatattatctaagtattgactggacttttctatctgcctcatgaataatgaggtaaattagaatttcatttattttgcataaaaaatacatgtaanttccgttatcataaaataattataggaatatctaccgatattattactctggggtccgtatatctatcctttttttctacttttctactatggnnatgagaaataaattnaaattttaaaaacaatttggtggtattccctagaggaaatataaaattttatcta

SEQ ID NO: 14674 - DNA, 389 bp, Diabrotica virgifera
  misc_feature (32)..(51): n is a, c, g, or t
ctatgtccagcagtggattgagagaggctgtnnnnnnnnnnnnnnnnnnnntatgcacacattattctttaatggtgagatattaattgtattctaatttaaaacagataaaagatcggtagttgtcctgttgtatacgtattttacgttaatttattcagacagtaatgagatccagttgcctatgcacctaattttttaggaaatagactacagttcttcattgacaatatacatctaattcaatagatgtagagtgttactattacttgtttttacggatgaccgtgcaaagccccagtctatccacagatcagtagtaaaaacgaattaggattggaagtttgcatattttagaatgtgacgttatttatttgtactgcattatt

SEQ ID NO: 14675 - DNA, 268 bp, Diabrotica virgifera; identical to SEQ ID NO: 6456
  misc_feature (4)..(46): n is a, c, g, or t
  misc_feature (52)..(74): n is a, c, g, or t

SEQ ID NO: 14676 - DNA, 198 bp, Diabrotica virgifera
  misc_feature (170)..(192): n is a, c, g, or t
taacagcgtaattttattggagagtcaaatcgataataaagattgcgacctcgatgttggattaaagtttataattggggtagcaggtatattattaagcctgatcgacttttaaaatttttactgaactgagtttaaacgggggggagccgggtgggttctatctttcnnnnnnnnnnnnnnnnnnnnnnnagggac

SEQ ID NO: 14677 - DNA, 254 bp, Diabrotica virgifera
  misc_feature (9)..(9): n is a, c, g, or t
  misc_feature (13)..(16): n is a, c, g, or t
  misc_feature (26)..(26): n is a, c, g, or t
  misc_feature (28)..(28): n is a, c, g, or t
  misc_feature (31)..(31): n is a, c, g, or t
  misc_feature (35)..(35): n is a, c, g, or t
  misc_feature (49)..(49): n is a, c, g, or t
  misc_feature (58)..(58): n is a, c, g, or t
  misc_feature (61)..(63): n is a, c, g, or t
  misc_feature (72)..(74): n is a, c, g, or t
  misc_feature (83)..(83): n is a, c, g, or t
  misc_feature (90)..(90): n is a, c, g, or t
  misc_feature (176)..(176): n is a, c, g, or t
ttaaagcgnccgnnnnataaaaaggngnagnaggnagacctttcaaggngaacgaagngannnaagacagannnagccagcangcagagnggggcaaagaaaaagaaggccgaagcaaagaaacagaccgacgggacaacggaaaaaggcaccgaaaggcacaagcccgacaacgnaccaacgcgagaacgcaacgacgaaggccaagcccgagaaaacacgcacgacccggaggccaagccagcagagcccaa

SEQ ID NO: 14678 - DNA, 450 bp, Diabrotica virgifera
aaatgttcttactgtcacctgttaataattaaaataatgggtcacagctggaggtgcttttgtaatcttcacgcttgccttatagaagtatgttcacatcaaaaagagaacaagcataaaaagctgacactcaagacaccggatataaagataaccattctgaatgtgctacccctccaatccacactagcggaaggccaacgggaaccaccgaaaaatatgatcgctgacaattcataagtcaaatctgcaggaatatctggataccgaggaatatcataagcgatacaagatccctatgactccgtagaggacattatagaagacaatgatggccgcaactgatgagtttgaagattatgaaatgtaacatcataataatgttctcatttattgccagacctatgtatttgagtcgcaatcatacaaacatcccgacgaaattatttc

SEQ ID NO: 14679 - DNA, 932 bp, Diabrotica virgifera
caatataatttttgaattgagtctcgtcaagataagtattcaatattctaccgacatgaagacctgctttatgatgcattaacacgaatttgttatccaatgtggctggcaaatggcaaaatattatcttctaaaatggttttaatgtacatatcagctgtcattcacccaatcacctccacaaattcgatatctcctttccaagaaataccactccactaccgttcatgatatggaagcaagattgacaaaacttcgtctacaaataagttagcgaaaagtatgtcagttgtaacctcatacagagcgttagttatggtggtggcggcatagtgacatggagcgatattgttttgaaatgacataccgaacacgtggaggtgataaaaacattttcatataggcgctactatataaaagacattggcgctaatgcacgtcttcatgtcgctagaatggtgaatgcttgccttgatgaggttcaatttaaaaattatattggccagtatatacccgactataggatttatatgactaaaacatcacattcggaaacgaaatcctattctcatgatactggggggctaaggatagcagcacaaaaaaaattcatttcatatgcatatgcaatatttttgtccgtgagtatattttagacatttgtattcttttttcatcatattttgttcttcatttgttaatacattctatttaaatcctaaaatgtaattttatcatcctttaatatatgtaccttgttttattgtacatccatttgtacattatgttcgtcttcttattaaatgatatttattattatcttctccaaaggcttttatttgtattctgtagggtagggaagctgagtccagtcacacagcatttatgccagtgtgtggtggttttaaagtgtatcatctttaagtatcatc

SEQ ID NO: 14680 - DNA, 91 bp, Diabrotica virgifera
  misc_feature (20)..(43): n is a, c, g, or t
gggccccttagcgtccgagnnnnnnnnnnnnnnnnnnnnnnnncgactatataggcgtctttcttttggtcgatgactgtaggatggtttc

SEQ ID NO: 14681 - DNA, 717 bp, Diabrotica virgifera
  misc_feature (19)..(61): n is a, c, g, or t
  misc_feature (71)..(111): n is a, c, g, or t
  misc_feature (118)..(177): n is a, c, g, or t
  misc_feature (188)..(514): n is a, c, g, or t
  misc_feature (516)..(530): n is a, c, g, or t
  misc_feature (532)..(550): n is a, c, g, or t
  misc_feature (552)..(566): n is a, c, g, or t
  misc_feature (575)..(587): n is a, c, g, or t
  misc_feature (589)..(612): n is a, c, g, or t
  misc_feature (614)..(636): n is a, c, g, or t
  misc_feature (644)..(707): n is a, c, g, or t
gtagttaattaatattggnnnnnnnnnnnnnnnnnnnnnnnnnnnnnnnnnnnnnnnnnnnaccttggggnnnnnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnaatgaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnncnnnnnnnnnnnnnnnnnnngnnnnnnnnnnnnnnnctttttggnnnnnnnnnnnnngnnnnnnnnnnnnnnnnnnnnnnnngnnnnnnnnnnnnnnnnnnnnnnngtaagggnnnnnnnnnnnnnnnnnnnnnnnnnnnnnnnnnnnnnnnnnnnnnnnnnnnnnnnnnnnnnnnnctttatttaa

SEQ ID NO: 14682 - DNA, 626 bp, Diabrotica virgifera
  misc_feature (87)..(114): n is a, c, g, or t
  misc_feature (263)..(281): n is a, c, g, or t
  misc_feature (331)..(360): n is a, c, g, or t
  misc_feature (560)..(587): n is a, c, g, or t
tggcattattaattctcttgtatctcgtgagcatgtattgttaatattattgacttgataatttattgtaattgctttatatattcnnnnnnnnnnnnnnnnnnnnnnnnnnnnaattatgaatattttgtttctataatttttttcacgatacgagtttgcgaggggtctttagggatactgctgttaattatcatagaccctgcttatggaaatgagctatatttctagcttgtttcttctttatgatcacattgttattnnnnnnnnnnnnnnnnnnncctttatgttttagaactaatttttgatgacttcatggattgatatttcnnnnnnnnnnnnnnnnnnnnnnnnnnnnnngaagaggtctacattatttctctatttacgatattttaggtattgctttttgatcttatcgtttaattttactaacattttgacgtccgcactttagtatatttacctagaggaaaattatatacatatggaattcattctcatgaatgtttattatcatcattttttttaatatcatcgatatcttcagtattttctgnnnnnnnnnnnnnnnnnnnnnnnnnnnntcttgaaatctagattaggacgagatttattatcaatta

SEQ ID NO: 14683 - DNA, 888 bp, Diabrotica virgifera
  misc_feature (669)..(669): n is a, c, g, or t
  misc_feature (681)..(681): n is a, c, g, or t
  misc_feature (725)..(725): n is a, c, g, or t
  misc_feature (756)..(756): n is a, c, g, or t
  misc_feature (778)..(778): n is a, c, g, or t
  misc_feature (827)..(827): n is a, c, g, or t
cggacgcgtgggctggcctgaaagaatgtattctcagtggaatgttgtcggtgtcggggaaaaaggtcttacacgtcgatcgaaacaagtactacggtggagagtctgcttcaatttgccctttggaagaactcttctcgaaatttggggttcctcctccggatgagtcctatggcagaggtagagattggaacgttgatctgattccaaagttccttatggccaacggaatgctggttaaactgctcattcatacgggcgttacacgatatttggaattcaaatccgtagaagggagttacgtctacaaagggggcaaaatagctaaggttccagttgaccagaaagaagctttagcctctgatttgatgggaatgtttgaaaaacgtagattccgcaatttcctcatatatgttcaagatttccaagccgacgatccaaagacatggaaagactttgatcccaatactcaaaatatgcaggctctgtatgaaaagtttggcctagataagaacacccaagattttactggacatgcgttggctttacacagagatgatgattatttaaacagaatggctgtggagactattaaccgcattaaattgtattctgattcactagccagatatggaaagtctccatatttgtatcccacgtatggattgngtgaattacctncaggtttcgctagactatcggcaatatacggaggtacctacatngtagacaaacctattgatgaaatagtcttangcgaaggagggtaagtagttgnggtgcgttctggcaaacgaatagctaaatggtaacaggtttattgtgantctacatatgtctctgataaagtacgcaagaagggaaaagtcatcagatgtatttgccttt

SEQ ID NO: 14684 - DNA, 714 bp, Diabrotica virgifera
  misc_feature (326)..(343): n is a, c, g, or t
gtactattcaaattttgaatcgtatttaaattattgtacagagaaatcaatgtgaataaaaacaattttaatttgtgatgactaaaattattataagacgttaaaaaataaataaatgtaaattattgagaccatagatatattgagacaggtttggagtttgcagataacagaaaagtagtaaaattagtaaacccaaaacatgtcggattcacaggaaaaaagatcttttacgacagaagaatggaactatcttacaaagtattttgttggaaatacatttcgatatagagataacattataatacctaaaggtgttggacccnnnnnnnnnnnnnnnnnngaagaaaagatggtagaatctttttttgagagctgtgcttttaagtctctgatgagttgtgtagtaggatatggattaggagcagctataggtttgttttcatcaagtatggtcctgcttcagttacagatactgcagaacctcaactgcaaggcaggtatttagagaaatgaaaactacaactttgggtatgcaaagaatttgcagtgtaggactctgtttctggatcaatgattatagaatctcaaggggaagtcaattggaaaatgggactatgctgggcagtacaggtggattattggattagggctggtgtaaagccggagtagtgcgagcatgagcttgcagcatttcacagctatcgatatata

SEQ ID NO: 14685 - DNA, 666 bp, Diabrotica virgifera
  misc_feature (8)..(64): n is a, c, g, or t
ccctcccnnnnnnnnnnnnnnnnnnnnnnnnnnnnnnnnnnnnnnnnnnnnnnnnnnnnnnnnntatggctccgatagtcgctgcataataaatagagggtgctattgtaaaatatacgagtggcatgttttaactatgattttcattgcacattattgcgtaaataaaacagctttacaatgtgtctaatattttagtagcagagagactgcatggcaaaatatagaggcaactaaaaatgaacgagaaacttttttttacaatacagcttaaataatgtggaggagagcatggttcttttatgttagcattatgttgttttttcttcagatgatttccttagctcagattttggttatagtgcaatatttactgtaattgttttagagtatatttttgaagatgtaatataggtcaattttaagtctttttttccatcattagcttcttctatacctataatatcgattagtgaattttgattatcatgttggctgttaaaattttattcaccgcagttctgaaaattgacgacgaagactgataaaccactcaagtacatgttacgaagctatgatgtttgtcttagatcggcacctccctttccacatattttgcctcgaataacaagatggaggaaaccatgttgttatgggtgtcgcaag

SEQ ID NO: 14686 - DNA, 846 bp, Diabrotica virgifera
  misc_feature (496)..(585): n is a, c, g, or t
  misc_feature (752)..(752): n is a, c, g, or t
ggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttanagcaggccaaaacttcgcctgaatactgtgtgcatggaataatggaataggacctcggttctattttgttggttttcggaaccccgaggtaatg

SEQ ID NO: 14687 - DNA, 219 bp, Diabrotica virgifera
  misc_feature (2)..(176): n is a, c, g, or t
  misc_feature (178)..(218): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnng

SEQ ID NO: 14688 - DNA, 919 bp, Diabrotica virgifera
  misc_feature (2)..(685): n is a, c, g, or t
  misc_feature (692)..(729): n is a, c, g, or t
  misc_feature (764)..(781): n is a, c, g, or t
  misc_feature (800)..(800): n is a, c, g, or t
  misc_feature (838)..(838): n is a, c, g, or t
  misc_feature (844)..(844): n is a, c, g, or t
  misc_feature (850)..(850): n is a, c, g, or t
  misc_feature (857)..(857): n is a, c, g, or t
  misc_feature (882)..(913): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataattggnnnnnnnnnnnnnnnnnnacgtctgttcgacttttanaatttacatgatctgagttaaaactgtgtgagccaggntggttnctatcnttatttnattatatattttagtacgaaaggannnnnnnnnnnnnnnnnnnnnnnnnnnnnnnntattat

SEQ ID NO: 14689 - DNA, 589 bp, Diabrotica virgifera
  misc_feature (3)..(18): n is a, c, g, or t
  misc_feature (39)..(84): n is a, c, g, or t
ctnnnnnnnnnnnnnnnnattctttccttttttcttgtnnnnnnnnnnnnnnnnnnnnnnnnnnnnnnnnnnnnnnnnnnnnnncctgtctaaagaaaaaaatcatttttcttactggggcctttcggcctgaaacaacctattaaatcaacaagagaacccggccgggctccccccggttcaaacccaaacactcggaattttacaaagccgagccgccctaatatctaagcggccaccccaataataatcttacagccgacgacaggggcccgctcttttgaaacaattggaacccccccaaaaaataccccggacctccctgaggaaattatctcttgtaatgagaacacattggaccacaaaatggttgatgtctatgcatatttgacaactgctactgttattttttactcgccccatttaatataactttgttttaaatgaccaaaactttaccccgctacgacccgtgaatccaagatcctgactggcgcacgaggaaccccgacaataaatagacttcgaaccgggggcgaaatggctaacacaaggaagggccgattctagcccgtgaaaactgcatctg

SEQ ID NO: 14690 - DNA, 719 bp, Diabrotica virgifera
  misc_feature (178)..(194): n is a, c, g, or t
catgactgaaaatacgaaatttcgttggctgtgtagtttgttagtgttggtgatactcgtggggaaagttgtgccacagggatttcagtttaccaacccgattaggtttccctattctaatacaggaaatccttatattgggatgtttgtggccattgcggtaccaattgatctaagnnnnnnnnnnnnnnnnntcttttctgcaaattttgaaagttcctacggtctaccatcaaaccaaagtttgcttagttatccaccgatatatgcttcgactcgacaactaatataccagttgctcgaatcaaaaataaaaggatatggatatcctggaaagaagtgcttgcaaagagcaatatgtgaggcagctgaatacactacagagaattatggtgttcttggagacatattacatgtattgttaacgccatccacatcccgcaacgatactaatgtagaagattatgcaaaatccgaggaatatggtagaactaaaggaaattgcaaaaaatataagaaaaattgtggattgagtatattgaacttatttagtgtggtcaaagatacatatgcgatgtacaatcctaataccttaaagaaagaaatatctatgctctagtgtttgacttattaattaatacgtttaatgataataataataacctgttcaatgtttaactggaaatattagttgcatttttaatacataattttcgtgc

SEQ ID NO: 14691 - DNA, 889 bp, Diabrotica virgifera
  misc_feature (30)..(56): n is a, c, g, or t
  misc_feature (334)..(353): n is a, c, g, or t
  misc_feature (787)..(787): n is a, c, g, or t
  misc_feature (803)..(803): n is a, c, g, or t
  misc_feature (815)..(815): n is a, c, g, or t
  misc_feature (819)..(819): n is a, c, g, or t
ctacagtaccatgtgtcactagcataatannnnnnnnnnnnnnnnnnnnnnnnnnnaacttagttaacatcattttgaaaaatgcggtacactttgagttacatcggtgctaccctagcgtccactgtaacactgatttttgccctctactactgcctcacgggaaaaggagagcaagttagtttagcatggttattgttgaatgtgtctccccacatgtgggcaggtctaggaattggccttgctgtatcattatcagttgtaggagctgctgcaggaattcacactacaggagtcagtatcgtaggagctggtgttaaagcccccagaatcnnnnnnnnnnnnnnnnnnnntattattttctgtgaagctgtggctatctatgggttaattatggctatagtactctgtggaagttggaagaatttcgatgtagacctattcaacctcaaaactcataactttgctcaaaaccattatggatcacatgttatttttggatccggtttaactgttggattttgtgttggagtagttggttctggtgcagccatttctgatgcagccaattcatcattattcgtcaaaattttgattattgagatttttggaagtgccattggtctcttcggtctgattgttggagtatacttgacgtcaagaggctctatggtttaaatgttcagtaaatgaacatgaaaaataaaatgaataatttgttacaagtgtgtgtgatgaagatacaactattttcactagtttacgccccaaatatttcatttgtggnttttgaacatatttanaatccattctanatanaattctttcaataattgttgaaacagatttcaggggtctttatcagtgtatataatagtattaaataaat

SEQ ID NO: 14692 - DNA, 168 bp, Diabrotica virgifera
  misc_feature (2)..(53): n is a, c, g, or t
  misc_feature (70)..(90): n is a, c, g, or t
  misc_feature (111)..(134): n is a, c, g, or t
cnnnnnnnnnnnnnnnnnnnnnnnnnnnnnnnnnnnnnnnnnnnnnnnnnnnngcttacatttttttacnnnnnnnnnnnnnnnnnnnnngttatacattattcataagtnnnnnnnnnnnnnnnnnnnnnnnncataacttattcactcgcggtgattaaaaatcac

SEQ ID NO: 14693 - DNA, 273 bp, Diabrotica virgifera
  misc_feature (7)..(44): n is a, c, g, or t
  misc_feature (79)..(96): n is a, c, g, or t
  misc_feature (162)..(192): n is a, c, g, or t
  misc_feature (202)..(256): n is a, c, g, or t
taacagnnnnnnnnnnnnnnnnnnnnnnnnnnnnnnnnnnnnnntgcgacctcgatgttggattaagtttataattggnnnnnnnnnnnnnnnnnntagtctgttcgacttttaaattttacttgatctgaagttaaaacccgggggagccagggtgggttnnnnnnnnnnnnnnnnnnnnnnnnnnnnnnncaaaggaacnnnnnnnnnnnnnnnnnnnnnnnnnnnnnnnnnnnnnnnnnnnnnnnnnnnnnnngcttctaaaaggatccc

SEQ ID NO: 14694 - DNA, 62 bp, Diabrotica virgifera
  misc_feature (4)..(61): n is a, c, g, or t
cgannnnnnnnnnnnnnnnnnnnnnnnnnnnnnnnnnnnnnnnnnnnnnnnnnnnnnnnnnc

SEQ ID NO: 14695 - DNA, 890 bp, Diabrotica virgifera
gaaccgttcttccgactgaaatttttttttcgttcagtttaatttgtgagggtttcctttaagagaattttatgtttaaattatgtaaattgcgtatatcgtgatgatgtgggggtggaccatcttatttgctggcttgtttgtgcgtacatttccgcagattattcctgaccagaatgaatatgagacttttccaattcctacttttataataaatcagatgggcaactcccaaatccgccaggcattcaacattggcagctgcagaatagtttacaatcccgtgtgtccagatcccgatgtaacatttttcctgtttacgaaagaaaaacctgagtatccagttccgatattagttggctcacagaggctaaataccaatttaaatactacgtattttgatcccaagaaacccacaaaaattattatacatggatacaactccaacatgaacattagtgcattggtagaaatcagaaaagaatacttgagtacaaaagactacaatatttttgccgtggactggagtccactaaatcaagcaccttgttacttgggggctcttatgaacatccgccatgttggaacctgttcagctcagttagttcaaagacttctagatttaggaaataccgatattcatgtcattggtttcagtttaggagctcacataactaattatatggctgtagcccttcgaccttatcggctgccgcgaataactgggctagatcctgccatgcccggattcattacatgggatttagattcaaaactcgacaaaacagatgcagacttcgtcgatgtatatcacacaaatgctttcattcagggaaaagtagaagagagtggacatgtcgacttttacattaatggtggagtaatccagc

SEQ ID NO: 14696 - DNA, 902 bp, Diabrotica virgifera
  misc_feature (786)..(786): n is a, c, g, or t
  misc_feature (818)..(818): n is a, c, g, or t
  misc_feature (848)..(849): n is a, c, g, or t
gaacatttcctagcagtgatacgagcaccgagccgaaaacgtcgtgcagtgcagtgcagtgcacacgtgatttcccacataacgcatcgcataataaagcagttctacattctactgaagtgtatgcatgtcatgaactaaaagaaagtaaaaaccagaacttcaaatggcttcaagatttaaaaagatcgcagtaagcggcataacaggaactataggagctggaattgccacttattatcttctgcgagatgacggcaaacaaccatggcctacagctgtcagcgccaaagaagccagtttgaagccaaaacgtgtgctgccgacgagagctgatcaaataaaatcacttcaatccgaaaaatttgatgtcgttattattggtggtggagccactggtgcaggatgtgccctagatgctgctactagaggtctcaaaactgctctaattgaagccgatgactttgctagtggtacatccagtcgaagtacaaaactcatccacggaggagtacgatacctacaaaaagctatcatgcagttggactacgaacagtacagaatggtacaagaagccttacacgaaagagccgtcatgttacatcaagctcctcatcttgcccatcctttgcctattatgttacctgtttatagatggtggcaagttccttactactgggctggcataaaaatgtatgatctcatagctggtcgacaaacagttaaatcatcctactttctctctaagaaaaatgctctagaactgtttccgatgttgagaggtgnataattggttggtggattagtttattacgacnggtcacaagacgacgctagaatgaattagnncgtagcagttaccgcaacagtccatggcgctacatcgcgaatcacgtgagtgc

SEQ ID NO: 14697 - DNA, 618 bp, Diabrotica virgifera
  misc_feature (283)..(297): n is a, c, g, or t
gggtagttggtacaagtacaacgatacaagagttggtactcttgtagattccagacagcaacactatttcttcaaaatttcaacgagacgaaagatttctcaatctaaaaggaaataaggcaaggctactttatttcttcaatgttgtttaacttataaaagaagcaatggcagactctaataagggtattaaagtaaacggcatatttttaacaacattaggtatgccaataatacagcgatggtggcagataccatagaagatattcaattcattttaaannnnnnnnnnnnnnncaagaaaggctttgggattgaagatattacgaagacaaaaacatcgattaggtataagtacctaaaaataatgatccgaacgcaaagatctactacagcatcttggtaatcagggggaaatttaacttgcactcagtcagaaatgtactaagtttcaaaaaagcattactggtttagtttgctctttatttcagtctcaaggggccaattatcggttatgggactgcccaggattttgatctgcttggcccattggaatttgtgatattcagaatgtatctgtaggatcagtataggtaatgagggtacatataggccagc

SEQ ID NO: 14698 - DNA, 284 bp, Diabrotica virgifera
  misc_feature (2)..(23): n is a, c, g, or t
  misc_feature (58)..(91): n is a, c, g, or t
  misc_feature (95)..(110): n is a, c, g, or t
  misc_feature (112)..(151): n is a, c, g, or t
  misc_feature (155)..(172): n is a, c, g, or t
  misc_feature (191)..(218): n is a, c, g, or t
  misc_feature (225)..(257): n is a, c, g, or t
  misc_feature (265)..(283): n is a, c, g, or t
cnnnnnnnnnnnnnnnnnnnnnngcccgggattttgaccgcgcttagggaacataatnnnnnnnnnnnnnnnnnnnnnnnnnnnnnnnnnngtgnnnnnnnnnnnnnnnncnnnnnnnnnnnnnnnnnnnnnnnnnnnnnnnnnnnnnnnnagcnnnnnnnnnnnnnnnnnncgagaaaaacccccaaagnnnnnnnnnnnnnnnnnnnnnnnnnnnntcggatnnnnnnnnnnnnnnnnnnnnnnnnnnnnnnnnngggggggnnnnnnnnnnnnnnnnnnnc

SEQ ID NO: 14699 - DNA, 238 bp, Diabrotica virgifera
  misc_feature (7)..(43): n is a, c, g, or t
  misc_feature (63)..(76): n is a, c, g, or t
  misc_feature (79)..(101): n is a, c, g, or t
  misc_feature (109)..(131): n is a, c, g, or t
  misc_feature (169)..(191): n is a, c, g, or t
  misc_feature (206)..(236): n is a, c, g, or t
taacagnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaaccggtgtgagcccaggttggtttctatcnnnnnnnnnnnnnnnnnnnnnnngtacgaaagggaccnnnnnnnnnnnnnnnnnnnnnnnnnnnnnnnat

SEQ ID NO: 14700 - DNA, 78 bp, Diabrotica virgifera
  misc_feature (2)..(62): n is a, c, g, or t
gnnnnnnnnnnnnnnnnnnnnnnnnnnnnnnnnnnnnnnnnnnnnnnnnnnnnnnnnnnnnngatccaaatttttttt

SEQ ID NO: 14701 - DNA, 830 bp, Diabrotica virgifera
  misc_feature (14)..(37): n is a, c, g, or t
  misc_feature (106)..(128): n is a, c, g, or t
  misc_feature (247)..(279): n is a, c, g, or t
  misc_feature (307)..(370): n is a, c, g, or t
  misc_feature (414)..(453): n is a, c, g, or t
  misc_feature (455)..(476): n is a, c, g, or t
  misc_feature (487)..(509): n is a, c, g, or t
  misc_feature (529)..(552): n is a, c, g, or t
  misc_feature (603)..(620): n is a, c, g, or t
  misc_feature (648)..(665): n is a, c, g, or t
  misc_feature (691)..(716): n is a, c, g, or t
  misc_feature (722)..(757): n is a, c, g, or t
  misc_feature (760)..(785): n is a, c, g, or t
gggggccctccggnnnnnnnnnnnnnnnnnnnnnnnngagggaaccccccgggggccccccggggtaaaccccgaggcggggaaaattttaaggggggaacggacnnnnnnnnnnnnnnnnnnnnnnnattaaaaactttaacccccccggggggggggaattttttttacgggtgggacccccccaaaaaaaaaccggggggccccccgggggagttttttcttaaaaccaaaaaaagggggcccnnnnnnnnnnnnnnnnnnnnnnnnnnnnnnnnngggtgatttttgtttttacccccccccnnnnnnnnnnnnnnnnnnnnnnnnnnnnnnnnnnnnnnnnnnnnnnnnnnnnnnnnnnnnnnnnccctagggggggcccccgcctttaaaaaaaatttaggctttttnnnnnnnnnnnnnnnnnnnnnnnnnnnnnnnnnnnnnnnngnnnnnnnnnnnnnnnnnnnnnngccgcgcttcnnnnnnnnnnnnnnnnnnnnnnncggccaggggggaccgaggnnnnnnnnnnnnnnnnnnnnnnnnaaaagcctacagggggggccaaaattaaacgccggggggggcggttgaacnnnnnnnnnnnnnnnnnnccgggggggaccccccaatagcgccgcnnnnnnnnnnnnnnnnnnccccgggtggggaaaaagggagaggnnnnnnnnnnnnnnnnnnnnnnnnnngggggnnnnnnnnnnnnnnnnnnnnnnnnnnnnnnnnnnnncannnnnnnnnnnnnnnnnnnnnnnnnnccccgccgggggggccgtaactttggggggggggcccggggggcc

SEQ ID NO: 14702 - DNA, 546 bp, Diabrotica virgifera
  misc_feature (10)..(10): n is a, c, g, or t
  misc_feature (16)..(17): n is a, c, g, or t
  misc_feature (27)..(27): n is a, c, g, or t
  misc_feature (31)..(31): n is a, c, g, or t
  misc_feature (36)..(37): n is a, c, g, or t
  misc_feature (52)..(53): n is a, c, g, or t
  misc_feature (56)..(56): n is a, c, g, or t
  misc_feature (66)..(66): n is a, c, g, or t
  misc_feature (71)..(71): n is a, c, g, or t
  misc_feature (76)..(76): n is a, c, g, or t
  misc_feature (79)..(79): n is a, c, g, or t
  misc_feature (81)..(81): n is a, c, g, or t
  misc_feature (86)..(86): n is a, c, g, or t
  misc_feature (105)..(105): n is a, c, g, or t
  misc_feature (120)..(120): n is a, c, g, or t
  misc_feature (129)..(129): n is a, c, g, or t
  misc_feature (131)..(131): n is a, c, g, or t
  misc_feature (157)..(157): n is a, c, g, or t
  misc_feature (170)..(170): n is a, c, g, or t
  misc_feature (173)..(173): n is a, c, g, or t
  misc_feature (177)..(177): n is a, c, g, or t
  misc_feature (180)..(180): n is a, c, g, or t
  misc_feature (229)..(229): n is a, c, g, or t
  misc_feature (260)..(260): n is a, c, g, or t
  misc_feature (266)..(266): n is a, c, g, or t
  misc_feature (269)..(269): n is a, c, g, or t
  misc_feature (271)..(271): n is a, c, g, or t
  misc_feature (275)..(275): n is a, c, g, or t
  misc_feature (279)..(279): n is a, c, g, or t
  misc_feature (281)..(281): n is a, c, g, or t
  misc_feature (288)..(288): n is a, c, g, or t
  misc_feature (297)..(297): n is a, c, g, or t
  misc_feature (303)..(304): n is a, c, g, or t
  misc_feature (322)..(323): n is a, c, g, or t
  misc_feature (328)..(328): n is a, c, g, or t
  misc_feature (348)..(348): n is a, c, g, or t
  misc_feature (353)..(353): n is a, c, g, or t
  misc_feature (381)..(381): n is a, c, g, or t
  misc_feature (392)..(392): n is a, c, g, or t
  misc_feature (400)..(400): n is a, c, g, or t
  misc_feature (410)..(410): n is a, c, g, or t
  misc_feature (419)..(419): n is a, c, g, or t
  misc_feature (428)..(428): n is a, c, g, or t
  misc_feature (431)..(431): n is a, c, g, or t
  misc_feature (462)..(462): n is a, c, g, or t
  misc_feature (491)..(491): n is a, c, g, or t
  misc_feature (508)..(508): n is a, c, g, or t
  misc_feature (512)..(512): n is a, c, g, or t
  misc_feature (514)..(514): n is a, c, g, or t
  misc_feature (517)..(517): n is a, c, g, or t
  misc_feature (535)..(539): n is a, c, g, or t
cttcaggcgnccggannggagaaaagngggnaaaannggctttaaggcgagnngcnacccaacggnccacngagancgnancagcnaccacaaccagaggggggngccaacatggaacangggcacgananagaaacggaaaagggccgcaccaacncacggacacaccnacnccancangcacccacccaaccccacagcccagcggaacaacggcgacgggagaaangggccccacagacacacaacgggacaagganacaaanaancnaaanaaancnacgggcncgaaaacancaaacnncaaaccaaagacccccgnngccancggaggcaggaacgaaggancagcnaaaaacacaacgcaggcggcagcagcancacacagaagnacagccanacaaaaggcnacacaacanagacaaaancancaaacagagggacacgagcccgaaggggaanaaccagcacaacggggaggagccgcagcngacaaggaaaacaacanaacncnacnaaaagaaaccaaagcagnnnnngaagcaa

SEQ ID NO: 14703 - DNA, 130 bp, Diabrotica virgifera
  misc_feature (24)..(24): n is a, c, g, or t
  misc_feature (57)..(57): n is a, c, g, or t
  misc_feature (70)..(71): n is a, c, g, or t
  misc_feature (77)..(95): n is a, c, g, or t
  misc_feature (98)..(98): n is a, c, g, or t
  misc_feature (108)..(129): n is a, c, g, or t
taacagcgtaattttattggagangtcaaatcgataataaagattgcgacctcgatngtggattaagttnnatatgnnnnnnnnnnnnnnnnnnnaangtctgtcgannnnnnnnnnnnnnnnnnnnnna

SEQ ID NO: 14704 - DNA, 948 bp, Diabrotica virgifera
  misc_feature (865)..(865): n is a, c, g, or t
  misc_feature (892)..(892): n is a, c, g, or t
  misc_feature (905)..(905): n is a, c, g, or t
  misc_feature (919)..(919): n is a, c, g, or t
gttgtgtttaatggtaccataatgatgaattaattggaacgtacacaaaagtttgggagggtttaagggaacaaaacccccttaaaatttttatggggtggacaaatttcactataattttgtttaaagatggttctgccatgagaatgatacatgtccattttcaataaaaaatatctaatagttttcgatatattgaaaaaaatcgattttcattttgtaacttcaaagggctgtaacttttatgatgagcacatttgtaccaaggtaagttagattcaatcaaactatttttgaccccagaatgtgtggtataatttgtgaccaatcttttcgggacaccctgtatacaatatatgttccctatgtccagctgaacgatttacgtaggttaaatcgactaatatagtaaacgacaattataatacgttttgtcgacaattataatacgttttgtcgttcatattttaaaagactcacattttaatgactgacgttaaatatacacacttctccatcaattcgataccatgatgttgaaatacgatatcaaaatgtaaaagaggcacaaactgaatgcagacattcagtgacgtcgtatcaggctggttgctgttcatgggtaatcaactttgtatttatacgccccctgtcacgcataataatgataaaataacgaatggcaattattaactgtgtaaaaagattaatagggtgcgtaacgttaagtttttatagatatcgagctaagatagaaacggcagctgttacgagatagtagacaatttatagtaatgttgtaacattccaaaagacatttaatgagagagcagagtaagaaaagataagtatttttaaatttggnctatattattgttgtttgaaatacttngtacattttattngaaaaaatgtttangaatttaccttttggtcttttttaatcta

SEQ ID NO: 14705 - DNA, 139 bp, Diabrotica virgifera
  misc_feature (7)..(30): n is a, c, g, or t
  misc_feature (65)..(65): n is a, c, g, or t
  misc_feature (76)..(76): n is a, c, g, or t
  misc_feature (79)..(101): n is a, c, g, or t
  misc_feature (103)..(103): n is a, c, g, or t
  misc_feature (109)..(130): n is a, c, g, or t
taacagnnnnnnnnnnnnnnnnnnnnnnnntcgataatacagattgcgaccctcgatgtggatanagtttatattnggnnnnnnnnnnnnnnnnnnnnnnntngtcgannnnnnnnnnnnnnnnnnnnnnagtttaaac

SEQ ID NO: 14706 - DNA, 123 bp, Diabrotica virgifera
  misc_feature (3)..(18): n is a, c, g, or t
  misc_feature (35)..(120): n is a, c, g, or t
ccnnnnnnnnnnnnnnnngcttacatttttttacnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 14707 - DNA, 199 bp, Diabrotica virgifera
  misc_feature (7)..(44): n is a, c, g, or t
  misc_feature (79)..(101): n is a, c, g, or t
  misc_feature (109)..(130): n is a, c, g, or t
  misc_feature (154)..(154): n is a, c, g, or t
  misc_feature (169)..(191): n is a, c, g, or t
taacagnnnnnnnnnnnnnnnnnnnnnnnnnnnnnnnnnnnnnntgcgacctcgatcgtggattaagtttataattggnnnnnnnnnnnnnnnnnnnnnnntgttcgannnnnnnnnnnnnnnnnnnnnnagttaaaaccggtgtgagccaggntgggttctatctttnnnnnnnnnnnnnnnnnnnnnnngaaaggga

SEQ ID NO: 14708 - DNA, 901 bp, Diabrotica virgifera
  misc_feature (291)..(328): n is a, c, g, or t
cggacgcgtgggcatgaatttcgtaatgatagtctattcaaagaaacgatttaaatcaaaaacaaaactcaaaagttgtattatcctcttacgggattggtcaaaatctgactcaagtcttacctgtgtaatcaccacaaccttgtttatcattgaaaaaccggaaacgggccgtggccattatcgtaagttggcaacgccgcgatattaagattcaatgtgaatgactgatgttaacctcaaactagtagcgtgctgcaacgtgtgttggatcattggcagagtgtagannnnnnnnnnnnnnnnnnnnnnnnnnnnnnnnnnnnnnagaagatcgctggcttaatttaaaaagggtttttagtgaagttttagtaaaggtgttgcccattattggtcaatatttcagttcctttctcaacaagatagtattctgataattgcagattagccatgaagcgtggagctgacggtgacatggggtccccgcaaaaaagatcacgtagaggcgatgaggaagttcgtttacttattcccagtatggttgccggttcaattattggcaagggaggatcaaacatcaccaaactgagaagccagtacaaagcatccattactgtccctgattgcccaggccccgaacggattttaaccctatcttcagacatggactccgtctgcaacatcgtccaagacgtaatacccaaacttgaagcgcatggcgcaactaccaacggaaatgaactggatttgcgaatgatgattcatcagagccaggcgggatgcgttattggcaaaggcggatcgaaaatcaaagaaatccgagagaaaactggtgcccgcgtacaaatttacgccaatgttgccccctcaagtaccgacagagtaattcaatcacagg

SEQ ID NO: 14709 - DNA, 525 bp, Diabrotica virgifera
  misc_feature (287)..(307): n is a, c, g, or t
cgattttctcaaaaacaagtgaaaaaatgtctgaaggtgacgtagttaatacttcagaagaagtccaagagaatcaagaagttgtagaagaatctatcgctccagtcaagagcgtaaaaaacgtcgaggctgcaccaccaaacctattcgacatcttcaaacccaaagatgcagcaaacgcagacaaggatggagcaaaaccagaagacaagcccgcagatggtaccaaacccgcagatgaaaccaaacctgcagacggaaccacagaggctaagcccaacatcttnnnnnnnnnnnnnnnnnnnnncgaagcagtaactaaaccagaagagcccaagcctttgttccctgccaatgatccatttaactttaagaaaaatgcagaagaagcccaaaaggcgttcaaagagaagggacttggaggttggattgctacagtgcaaaaaaatgttcagaatcaaatgactgaactctccgtagcgccagaaatcaatcggctaaaagataaagaatggcctgaactgt

SEQ ID NO: 14710 - DNA, 854 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(461): n is a, c, g, or t
  misc_feature (476)..(496): n is a, c, g, or t
  misc_feature (634)..(683): n is a, c, g, or t
  misc_feature (688)..(796): n is a, c, g, or t
  misc_feature (799)..(844): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatcccta

SEQ ID NO: 14711 - DNA, 971 bp, Diabrotica virgifera
  misc_feature (132)..(157): n is a, c, g, or t
  misc_feature (204)..(221): n is a, c, g, or t
  misc_feature (877)..(877): n is a, c, g, or t
cttgttctgaagctatttccttgtggcatttttgtaatcaactattctaaaatagaaataagccacaatttgactaaaaaatgattttattgacgtttcgacgcccaaattggatgtcgttttcaaaatacnnnnnnnnnnnnnnnnnnnnnnnnnngttgttacttagtgaaaaatttcttctaataatttatttaatctgannnnnnnnnnnnnnnnnnacaacgatatccgatttggacgtcgaaacgttgataaaaccattttttttggttaaattatggctattaattacttcccattagaatagttgattaacttacgtacgaataattaacttacgtacaaaaattattttaacaatattttgtacatgtcatgtcaactaaatacatatttattttgctaacctgaatatatacttttaggcccggtcttttcacctccgaataaatatgctcttatctggcagttagctatctggaggataaatatttattcgccagataaaatgtacccgtcttttcacgtcaatttatgttccagtttagttatccggtagataagcttaaaactttaacttaacctaacataattagattcaaagtatttcaaagatgattttatcgattttatttccattttggaagaaggaatgaaggaaataaggaaaacattgattatgattatgctgaaatagtttactagagagcttgaacaagaggtaaatccattttaaattagaggaaaactgttgatttgtatgtaaaatagaagacaaagacaagtttaaataaagacaagctagctaatgaaacagatgcagtggttgacaaaacatgatttaaactttcaaaatgccctcccctgaaaatangctagatggacatatcaatcatttgtcaaacgctacagatttataatccatccaactggtatatttgatagtaaactagggataaaccaactat

SEQ ID NO: 14712 - DNA, 798 bp, Diabrotica virgifera
gtgaggttaaattttgtacttcatttaaactttgtctttaaaaatttgttagagaaaaatgtctataaagtcctgtattcgagtaattcctttattaaggaatgctataaactcacataattcgtgtctgtcacgaacaattaatttcactaaaagtaacattcacagatctacgttttctttatataacaaactggatataagattatattcaacagaaaataaatcagaatcaaaagaaatctactatggatcccttaccccacaaataaaagcagttaaaatattttcattatcatcaagtgtagttggaattatagcccaaccttttttatataatgaaatagcctcgactggaaatgtacctgttattgtagctgcttacactgctattggcttttttacagtcgttactcctatattgttacacttaattacgaagaagtatgtcacacatctgtactacaaaccaagcaccaatagctatatcgcaaataatgttaatttcttctgtttaaccaaagagactgaattcacaccagaagatgtagtggtatctgaagtacctggcatgttcacaacatttgaagccaaaggaaaagccttgtttgttgatcccaggctcttcgaagatcctgagcactatgcaaaaataatgggcttcgacaaaccacttgatttcaaattgtaccagactacagacaatatacctagcagtagcaataaaaaagattagcaaatgactttttaaattattgtatttattaagattttacttttaccattgtgataacagtt

SEQ ID NO: 14713 - DNA, 309 bp, Diabrotica virgifera
ggggatagggatgaagaaagtgagtttgatccttttgatagaaggggtgatagttggggaaagagggaatattttggggatttttgtggtttttgggagaagtaaatgagttttgggggagaggtgggtatgggaaatggggagaagaggatatagtgttatagtattggtagagagagtagttaaagaaaaagatgaaaattggtatgtaagttaatgttaagttgatggaggaaggggagtgggagttggtgtggagggaaacttagatgggatgtgagaatgagataggtttaattgagaaatgat

SEQ ID NO: 14714 - DNA, 85 bp, Diabrotica virgifera
  misc_feature (18)..(18): n is a, c, g, or t
  misc_feature (25)..(79): n is a, c, g, or t
gttacaaagcttacattnttttacnnnnnnnnnnnnnnnnnnnnnnnnnnnnnnnnnnnnnnnnnnnnnnnnnnnnnnncattac

SEQ ID NO: 14715 - DNA, 59 bp, Diabrotica virgifera
  misc_feature (9)..(44): n is a, c, g, or t
  misc_feature (49)..(49): n is a, c, g, or t
  misc_feature (58)..(58): n is a, c, g, or t
aaagcttannnnnnnnnnnnnnnnnnnnnnnnnnnnnnnnnnnnataanattattaant

SEQ ID NO: 14716 - DNA, 864 bp, Diabrotica virgifera
  misc_feature (221)..(247): n is a, c, g, or t
  misc_feature (753)..(753): n is a, c, g, or t
  misc_feature (789)..(811): n is a, c, g, or t
cagatagtgctgaactgtacgacatttataaagaatatattaaagaagttaaagatacatcaaccgtattatgtttgtatgaaagggcgatactccccttatgtctaacacctcttttgtgggaagattatattaaatattgttttaaattaaaggaagttgtcttgaaggttggaactagagctattagaaattgcacttggagtgagcctttgtggatnnnnnnnnnnnnnnnnnnnnnnnnnnntaaatcggatgaaaaagaaattatggaatgttttgaacaaggtgtgattaatataagcccgtcaccaccgttggagttttggttttcgttcttggagtattatcacagaaattcagatgaccagaaaaagcttgataagcttttctctcagactgtacagcaaattgggcatgaaaacgatccaacatataaagtaagcagatggcacgctcgtttgctagccaaacgcggagatatggagtctgctaggaaagtatggaataatattatcaatgaccaacaaaataaaggttcggtgaatgcatggttagaatatgcaaatttggaaaaacaatacggtgaagtaaaccaagtgagaaatatttttaaaagagctctgttcgcatgtaaggattggccccaatatattgcagatgaatggttaatgttagagcgtgaatctggtacgttagaagatatcatgaaatgcgaagaaaaatgtaagatagttttaagaactgccagtncatatacacagaaaaatttagatgttcaatataaannnnnnnnnnnnnnnnnnnnnnntagaaaaaggaagtctgaggaggaaccgtcccgaatgggttcaaacgccgata

SEQ ID NO: 14717 - DNA, 904 bp, Diabrotica virgifera
  misc_feature (14)..(895): n is a, c, g, or t
cccttaacgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatataa

SEQ ID NO: 14718 - DNA, 776 bp, Diabrotica virgifera
  misc_feature (5)..(107): n is a, c, g, or t
  misc_feature (114)..(132): n is a, c, g, or t
  misc_feature (134)..(159): n is a, c, g, or t
  misc_feature (161)..(310): n is a, c, g, or t
  misc_feature (312)..(418): n is a, c, g, or t
  misc_feature (420)..(689): n is a, c, g, or t
  misc_feature (734)..(761): n is a, c, g, or t
ctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttnnnnnnnnnnnnnnnnnnncnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacaaactgtcttcatttaatttatacagcattttattgtgtnnnnnnnnnnnnnnnnnnnnnnnnnnnnacgagcagaccctat

SEQ ID NO: 14719 - DNA, 474 bp, Diabrotica virgifera
  misc_feature (163)..(186): n is a, c, g, or t
  misc_feature (194)..(219): n is a, c, g, or t
  misc_feature (262)..(295): n is a, c, g, or t
ctcctaccacgcttgctcactccatttgatttggctttggattccttcttttcagccttctttgatgatctcctcctgactacccaagacaagttaaataatactgatatggtgctatttagggttattgtttaagatttaagaataaattcgttacaagctnnnnnnnnnnnnnnnnnnnnnnnngctattgnnnnnnnnnnnnnnnnnnnnnnnnnngtggaaagaaatgtttttcaggtattttctgtggactatgtannnnnnnnnnnnnnnnnnnnnnnnnnnnnnnnnncacatatgtaggtatgtgtatatagtaggcatatagattatacctccgagacttactaagaattttctttctgtagggatgaagttctaaatataaattatgattagaaatcgtcgtagtgatttatatgtgaatacttacgttaataccaaattatatgtatgtttcctcaattgagt

SEQ ID NO: 14720 - DNA, 500 bp, Diabrotica virgifera
ctttacgcgtccgccctttttccgttaacagaaccatcatctttaaccctaagaacatataacagaacctcaattagtaatgcaggtgcaaacagaattagtaatgactttgaatgtatcttgggatgcccgcgcatacaatgttagcgttacggaatagatgcatatatgaatatttgagttatattctttccaagaatagaagctgttttggtgaatatgaaatgtagacattataatcggagagctcaatagcacgttgtcacaggtgaatcatatctcgcattgagatcggttccgcctgctctaccaatgttctaatcaagaaagttattacactttgatataaccaataatatcaagcattagacacggagctgaaaagaaaaagacccctaggatatacactcgaattaccaagaaaaataatcataatatcaaatctggtaatacatcaatacgatggcatcaacacgatcaaaggatgattggtgttagaa

SEQ ID NO: 14721 - DNA, 477 bp, Diabrotica virgifera
cccacgcgtccggaaataaaggaactggtcaccggtgtcatctggaacatgtcatcgtgtgaagatctcaagagaaacataatagacgacggagtaataaccattgttacttttattataattccacattccggctgggattcacaaggaaatcacggcgagacttgttggtccacagtattcagaaacgcatctggtgtgctaagaaatgtcagttctgctggagaatatgctagaaaaaaattaagagagtgtgaaggtttagttgatgcattactttttgttgtacgctgtgccatagataagtcaaatataggcaataaaattgtagagaattctgtgtgcattctacgtaatctgtcgtatcgatgtcaagaggttgaggatccaaactatgataagaatcctttaccaactcaaactagggtggccgctacctcatctaaaggtgaaaatttgggctgcttcggtggaagt

SEQ ID NO: 14722 - DNA, 567 bp, Diabrotica virgifera
gtactgatagaatcaacagaatcaactaaactgatagcatcacatttatgtttgcctcccagccgtcatcttgatttaattttgacagcatgttggaatatggttggaatgccctattgacttcatagtttaaaccgatgaaaaaatgaacaattgcgtaaaaagaagaagatataaactactactctgtttctgtcatttgcatctgtttcactgtttctctgtatttgttttgaattttttgtgttatttttatgctaaaaagactgtacataataatgaaaagcactacacttattttaaaccacttgtcctgtgtggataggatatcaaatggacatcaatcaaattttttcagcttcctaaaacatccagttagaaattatcattttataccactactatctataaaaagactggtcagtactacacaagttgatagaaataataacagtgatgtatcgacaatagctgcaggatattttaaaaatacatgctgtaaaagtccataccattagtgacaaaataaaacactctttttcaaagacgtctccagaagacatagat

SEQ ID NO: 14723 - DNA, 967 bp, Diabrotica virgifera
  misc_feature (371)..(388): n is a, c, g, or t
  misc_feature (695)..(714): n is a, c, g, or t
  misc_feature (762)..(785): n is a, c, g, or t
  misc_feature (923)..(923): n is a, c, g, or t
  misc_feature (946)..(946): n is a, c, g, or t
  misc_feature (961)..(961): n is a, c, g, or t
catcaggcagaagactatagatggaacaaaaaagtgctgcactggagaacctaggaattaaaacgacacaaaggaagaccacagatgaggagggcagaagatttaatgagacatgctggtccaagatggataaaaattgcaatggacagagaataaaatgaaagtcagagggggaggcctatatccgaatttggatataataagtgctttagataaatgtagattacctcactgaagacagtatcctgcattttcttttattgtatacagtaactgttgaaattggtatttatatgagcaagtaaaaatgttgttcgtgtcttgtgcagttcttgcatataatttaaatgaaacagattaaacattaacgnnnnnnnnnnnnnnnnnnaagcgaagagaaaaatagcctttttataaggaaaatacttttgaggaaaatgattatatttacctaagttttcgtttcaaaagttcattgtatcaattactgcgttcagtgtggtgggtataacgctaaatatagcaactgcagacattctacgctccataaacaaaatcaaattgaagcatggtaggtatatctcatcctggacattcgacagtagtactgattaccttttttttacaagattaacaattagagcataataagaatatatgaaaataatacaactttcttttatttagagactatnnnnnnnnnnnnnnnnnnnngtttattgtttatgaaacaaaaacagatggtttacttttagttcactnnnnnnnnnnnnnnnnnnnnnnnngccacagtaaccaatataagggtaataatgaagacaacttagaatatgtgtagggtttttttatgacttgcaatttacaacgattcttcatataaaaatttattcttattaaacaaatcttcatctcatttgaatggncttagctgccagggctatccggncagctctagtaaacnaattgg

SEQ ID NO: 14724 - DNA, 218 bp, Diabrotica virgifera; identical to SEQ ID NO: 7300
  misc_feature (6)..(28): n is a, c, g, or t

SEQ ID NO: 14725 - DNA, 99 bp, Diabrotica virgifera
  misc_feature (3)..(21): n is a, c, g, or t
ttnnnnnnnnnnnnnnnnnnngcttaacatatattaaatgtcaaagtttcctctttatttttattgatacaataataatgttaagaaaattattattgt

SEQ ID NO: 14726 - DNA, 625 bp, Diabrotica virgifera
  misc_feature (2)..(2): n is a, c, g, or t
  misc_feature (6)..(6): n is a, c, g, or t
  misc_feature (9)..(9): n is a, c, g, or t
  misc_feature (17)..(18): n is a, c, g, or t
  misc_feature (39)..(39): n is a, c, g, or t
  misc_feature (44)..(47): n is a, c, g, or t
  misc_feature (54)..(54): n is a, c, g, or t
  misc_feature (56)..(56): n is a, c, g, or t
  misc_feature (60)..(60): n is a, c, g, or t
  misc_feature (62)..(62): n is a, c, g, or t
  misc_feature (72)..(72): n is a, c, g, or t
  misc_feature (81)..(82): n is a, c, g, or t
  misc_feature (85)..(87): n is a, c, g, or t
  misc_feature (94)..(94): n is a, c, g, or t
  misc_feature (113)..(113): n is a, c, g, or t
  misc_feature (116)..(116): n is a, c, g, or t
  misc_feature (126)..(127): n is a, c, g, or t
  misc_feature (131)..(131): n is a, c, g, or t
  misc_feature (133)..(133): n is a, c, g, or t
  misc_feature (135)..(135): n is a, c, g, or t
  misc_feature (140)..(140): n is a, c, g, or t
  misc_feature (143)..(147): n is a, c, g, or t
  misc_feature (151)..(152): n is a, c, g, or t
  misc_feature (161)..(195): n is a, c, g, or t
  misc_feature (199)..(201): n is a, c, g, or t
  misc_feature (205)..(207): n is a, c, g, or t
  misc_feature (209)..(209): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (219)..(219): n is a, c, g, or t
  misc_feature (223)..(223): n is a, c, g, or t
  misc_feature (226)..(226): n is a, c, g, or t
  misc_feature (228)..(229): n is a, c, g, or t
  misc_feature (231)..(231): n is a, c, g, or t
  misc_feature (234)..(235): n is a, c, g, or t
  misc_feature (237)..(241): n is a, c, g, or t
  misc_feature (243)..(243): n is a, c, g, or t
  misc_feature (248)..(249): n is a, c, g, or t
  misc_feature (251)..(253): n is a, c, g, or t
  misc_feature (257)..(259): n is a, c, g, or t
  misc_feature (262)..(282): n is a, c, g, or t
  misc_feature (284)..(314): n is a, c, g, or t
  misc_feature (317)..(319): n is a, c, g, or t
  misc_feature (322)..(323): n is a, c, g, or t
  misc_feature (325)..(327): n is a, c, g, or t
  misc_feature (330)..(330): n is a, c, g, or t
  misc_feature (333)..(333): n is a, c, g, or t
  misc_feature (338)..(340): n is a, c, g, or t
  misc_feature (343)..(346): n is a, c, g, or t
  misc_feature (352)..(352): n is a, c, g, or t
  misc_feature (358)..(358): n is a, c, g, or t
  misc_feature (364)..(364): n is a, c, g, or t
  misc_feature (372)..(373): n is a, c, g, or t
  misc_feature (376)..(376): n is a, c, g, or t
  misc_feature (378)..(378): n is a, c, g, or t
  misc_feature (385)..(385): n is a, c, g, or t
  misc_feature (388)..(389): n is a, c, g, or t
  misc_feature (399)..(399): n is a, c, g, or t
  misc_feature (433)..(433): n is a, c, g, or t
  misc_feature (459)..(459): n is a, c, g, or t
  misc_feature (465)..(465): n is a, c, g, or t
  misc_feature (516)..(516): n is a, c, g, or t
  misc_feature (570)..(570): n is a, c, g, or t
  misc_feature (601)..(601): n is a, c, g, or t
anagcnacnacaccaannagaaagcctctttcaagtggnaaaannnnacatgancngagngnaaaccggggngagccaggnnggnnnctatcantaattctccaagatatggnagnacgaaaggannaaanananaaaanaannnnngaanngagaaaaannnnnnnnnnnnnnnnnnnnnnnnnnnnnnnnnnnggannnaagnnnangnangngggnaggngangnnanagnncnnnnnanagggnnannnaaannnaannnnnnnnnnnnnnnnnnnnnannnnnnnnnnnnnnnnnnnnnnnnnnnnnnnaannnaanngnnnagnagnaaaannnccnnnngccagngggagnaaaagngaagaggnncgnancgaacgnccnncccaacagangcgcagccggaagggcgaaggggacgcgcccggnagcggcgcaacaagcgcggcgggggngggggngacgcgcagcgagaccgccacacaggccagcgccccagcgcccgcccccancgcagaccaccccgcccaacccgccacggacgccggcgaaccccgaccagcccnaaaacgggggcgccccccagggggccgaccnagggcccaacggcaccgcgacccc

SEQ ID NO: 14727 - DNA, 914 bp, Diabrotica virgifera
  misc_feature (140)..(176): n is a, c, g, or t
  misc_feature (319)..(338): n is a, c, g, or t
  misc_feature (353)..(376): n is a, c, g, or t
  misc_feature (389)..(404): n is a, c, g, or t
  misc_feature (406)..(421): n is a, c, g, or t
  misc_feature (425)..(442): n is a, c, g, or t
  misc_feature (527)..(548): n is a, c, g, or t
  misc_feature (817)..(817): n is a, c, g, or t
  misc_feature (868)..(869): n is a, c, g, or t
gggctcgataacacggaaagagtcccaccagagctcaatccttttgataccgtaggtatctgggaagagtcaattttccccttagagggagtgtgagccgtatggctaaatctggataataataagacgtttattgttcnnnnnnnnnnnnnnnnnnnnnnnnnnnnnnnnnnnnnagatttgaaatgtggtaggaacaatgcgttttgatatcagcatctgtactttaccagaaaatacagggctgttgaacgccaactatctaaataaaaaattgttacattataataataattaacctaataacttaacctaaacnnnnnnnnnnnnnnnnnnnnttctaaattcacatnnnnnnnnnnnnnnnnnnnnnnnnaaaggaaaagtannnnnnnnnnnnnnnngnnnnnnnnnnnnnnnnaacnnnnnnnnnnnnnnnnnnagctgtttacccattttttactgataatttaatagtagagctttaattttctttttgaaagtaataggagataaattacaattcnnnnnnnnnnnnnnnnnnnnnngtgatggagcgatataagaaaatattttcttaaagatttgcctattatgctggggagttctaagtaaggttgtaggtctcaagtttcttcggtgcatttcattactgaattttaatttattgtacagatacttgggtgtttttgttttaatgatcttgtatgtaaagtttagcgagtgcaaagttcgcctgttgaacatgtttacttcactgtataccaaaggcaatactttatatacatctaattttcgtttacaatgaactatcatncattaaggctcgttttgactgtatttgtaacgatgtagtaccaaagcttanngtacgtctcgatatgtgtcagttcttatatttatgcccccctaca

SEQ ID NO: 14728 - DNA, 1108 bp, Diabrotica virgifera
  misc_feature (180)..(222): n is a, c, g, or t
  misc_feature (846)..(863): n is a, c, g, or t
  misc_feature (964)..(982): n is a, c, g, or t
  misc_feature (1061)..(1079): n is a, c, g, or t
atcgaatatggttaaataatgtctttccaacctcctggagtgattcaataattatacctattctcaaacctaacaatgcacgaactaaaatttcctcatatagacccatctctctcaccaatgtaatgtgcaaagtcatggaaaaaatagttaataaaatattgctatggatattagaannnnnnnnnnnnnnnnnnnnnnnnnnnnnnnnnnnnnnnnnnnatcgaactactactgataacctcattgatttagaatctgaaattcttgaatctttcgcaaacaaacaggaaactattgcagtattcatagacattacaaaagcatttgacacagcatggcgttacgatattatcagatcattacacacttggaatattagaggtaatatcattaatttcatttcaaatttccttaaacaacgcaattttcaagtaagagtcaatcactgcacatcttcaataagacttcaagcaaatggcacccctcaggggtctgtaataagcgcaacgttatttttaattgccattaataatattatagcatcaaactccagcttagttcatggcagattatatgcggatgatctggtattagtatcttcaggaaaaaacatctcatcagtacagcgtcacttacaaacctcacttcatgaactcgaaaactggtcgaagaaaacaggattcagttttcactcagcaaatcgaagtgtttgttatttttcaagaaacgtgattcgaataaaccgcaactacaataatgtaaaccaatcctgaattatgccgatgacattaaggttttttagggatgatttttgaaacaaaactcccatgaaaaaacaaattnnnnnnnnnnnnnnnnnnggaaaaatgggaattattcttattaaaaatttcccctaaaaaaaaatattggagctggataataattggccaaaccaaattttataaaacccccaataaannnnnnnnnnnnnnnnnnnggggcccaaaggaaaatggatttcgccaaaaaaacctttatttacccccccccttggccgcaatcccaaaaaacggggnnnnnnnnnnnnnnnnnnngggaagaatttttgcggcccccccccccc

SEQ ID NO: 14729 - DNA, 951 bp, Diabrotica virgifera
  misc_feature (696)..(696): n is a, c, g, or t
  misc_feature (847)..(847): n is a, c, g, or t
  misc_feature (854)..(854): n is a, c, g, or t
  misc_feature (891)..(891): n is a, c, g, or t
  misc_feature (906)..(906): n is a, c, g, or t
  misc_feature (929)..(929): n is a, c, g, or t
aaaaaatattactcgttaattttacgaaatttagtaaaagtgaagtgtgacggataaattgttggactcgtttatcgtgagaaaaatgtgcaaacaaaaactgaatgtgtaaaaatcgttattttcgagtaattttgttcagcaataaccagctgatggcgggtgaaaatacgggaatggcttggcagttgagtgatcatacattggaagatttttagagtgatttttatcacgataattgtatatattagccactgagggagaatacaatcgatttaagattaacgaaataatttctttagaatcgaaccagttgataattgggcgtgctctgaagtataagtataagcacacaccttgtggcttgtcattgatatttagcaaccattcataaattctggactataaataccctcaaatgatgcgtttgaaattctgtacaatttgacgaaaattcgaagtagtgaaatgcagagtgatcttatactaacccctttgtaaatagtgtgtttgcttgtcttgttatttttgttactactgaaggtttctattagccacaatgtcggcgacgacattcgtcgatagaattgatccttttgccaaaagatcactcaaaaagaagaccaaaaagtcacaaggcagttccagatacaggaactcccaagatgttgaacttcaacccctacctcttcttanagatgtaccagcatctgaacaagaagaactgttcatacgtaaacttagacagtgctgtgtagcatttgattttatggatccagtggcggatctaaagggcaaagaggtgaaaagatgtaccttgaaatgattggtggattatataactggnagacggngtgttcttactgagcctgtttatccagaaattattanaatgatatctgcaanccctattcgaacattaccctccnagtgaaatcctgactttgatcc

SEQ ID NO: 14730 - DNA, 924 bp, Diabrotica virgifera
ctactagacagccacgaagactaaagtgtttatagtgaatccactttccgtttcttgcgttggattggattgttgtgccgttgttaagctgcattatattgaatcatgatattctttaactggaataccttattcctcttcggacttgtcgtctaccttctctacaagtacctaaccagaaaccataactactggaaagaaaaaggtgtaccctacgaagaaccatactttttggcgggaaacttttgggacgttttttcaggcaaacgccaaatcgggaagcatctaggctatttgtacagcaaatacaatactccttactttggaatatacatattaggaaagccttatttagtgttaaggaacccggagattattaaaaacatcaccataagagatttcaaaaattttgatgatcgaaccttcgcttgtgacaaaaatgctgacgatatggcggctaatagtctcttcatcatgaggaaccctgactggaagtacatacgagcaaaattaacgcctattttcacttctggaaagctgaagcttatgctgggcattatgaaagacgcagcaaaagaaatgcaaaactatttatcccagtgcgacaataagatagtagaaattaaagacgtctcatcaaaattcttgactgacatcgtagcttcatgtttctttggctacgaagtaaaatgcttcagaaacgaccaatcagatttcgtccatttcactaaaaacttattttctcataaagtagcgctgttgccgttcttccgtttgttctcgtatttttttgttcctacttttgtgtcgctgttcaagttgaactttctggacaacgcgttgttgaagaaaattattatagatactcttttatatagagagacgaataatatcaaagagacatgatttttatcgattttactg

SEQ ID NO: 14731 - DNA, 99 bp, Diabrotica virgifera
cacaatttacgtgacgattagaaagaaatgataaattcaaaactgtctgattattgtatgaacattgtacaattgttttaaatagattgtatttttctg

SEQ ID NO: 14732 - DNA, 436 bp, Diabrotica virgifera
  misc_feature (10)..(59): n is a, c, g, or t
  misc_feature (74)..(126): n is a, c, g, or t
  misc_feature (148)..(162): n is a, c, g, or t
  misc_feature (164)..(176): n is a, c, g, or t
  misc_feature (194)..(218): n is a, c, g, or t
  misc_feature (405)..(425): n is a, c, g, or t
atgtaattgnnnnnnnnnnnnnnnnnnnnnnnnnnnnnnnnnnnnnnnnnnnnnnnnnnctagattgaatatcnnnnnnnnnnnnnnnnnnnnnnnnnnnnnnnnnnnnnnnnnnnnnnnnnnnnngtgaagaatatataagaggtgnnnnnnnnnnnnnnngnnnnnnnnnnnnngttgtaatatttgttatnnnnnnnnnnnnnnnnnnnnnnnnncctaatttaatttcaattttattatgttgagatggattaggtttagattcttatggtttagaaattaattatcaatatttgacaagagtaaatgaatggtatattatctgctttatctaatcgaagagtagatgtagatttattgatatgtatatgcatgaatatgaagttttgtgaagtagatatnnnnnnnnnnnnnnnnnnnnnccacgatatga

SEQ ID NO: 14733 - DNA, 849 bp, Diabrotica virgifera
  misc_feature (269)..(291): n is a, c, g, or t
  misc_feature (459)..(478): n is a, c, g, or t
gaaaacgttcttagactatggaattacttattggaattgcttaaagcacgtagaattcgtctagatatatcacttcaactacaacagaacttccaagaaatgctacatattctagatgccatggaggaattgaaacaacgtctccttactgacgattacggcaaacatctgatgggcgtggaagacttacttcaaaagcacaatctacttgaagctgacattaacattctcggcgacagagtaaaagcagtcgctagtcagtcacagannnnnnnnnnnnnnnnnnnnnnngaaggatatagaccatgcgatcctgccttagtattagaacgtgtccaacaattagaagaagcttacgctcagttagtaagacttgccgttgaaagaagaacccgccttgaagaaagcaagagattgtggcagttctattgggatatggctgatgaagataactggatnnnnnnnnnnnnnnnnnnnntttctacatcagatattggtcacgaccttaccacagtcaacctgttgcttagcaaacataagatccttgaaaacgaactatcttctcatgagtcgcagttagaggcggccctcggggttggtgaagaactcatcaacggaggccactttggtgcggaaaagatccaagaaaggctaaatgaaatccgtgacgcatggaagcaccttctagatttagcagcctaccgtagaaagcgattagaagaagctgtagactaccaccaactgttcgctgatgctgatgatattgatatttggatgttagataccttaagactggtatctagtgaagacgttggacaaaatgaggggtacgcacaatctctgctcaag

SEQ ID NO: 14734 - DNA, 286 bp, Diabrotica virgifera
  misc_feature (19)..(62): n is a, c, g, or t
  misc_feature (68)..(227): n is a, c, g, or t
  misc_feature (242)..(267): n is a, c, g, or t
ggggttggatgaagaaagnnnnnnnnnnnnnnnnnnnnnnnnnnnnnnnnnnnnnnnnnnnngaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccaatttttttgnnnnnnnnnnnnnnnnnnnnnnnnnnaaacagcgaaatttttttg

SEQ ID NO: 14735 - DNA, 453 bp, Diabrotica virgifera
  misc_feature (114)..(148): n is a, c, g, or t
cgatttcactataggacacacctttggcgccgcagtatactgaagaaaatttggacttgcttcgtaaaggacttcctaatattctcaaacacgtaagcaacgcggtgaaatatnnnnnnnnnnnnnnnnnnnnnnnnnnnnnnnnnnnaaccgacactgaagctgaactggaactcttgagacaggcatgcaaaaactctggtgcattcgacgcagtagtttcaaaacactggacacaaggtggtcaaggtgctctcgatttggctaaagctgtcgtggaagctacttctcaacccagaaacttcaaatttttgtatcatcttaaccgaccgattaaggataagattgccattatcggtgaagaaatgcacggggctgcaggagggtgctatattgtgtgggctgcagacataaaagaacacgatgagaccgtatattgatggagtaagaaga

SEQ ID NO: 14736 - DNA, 727 bp, Diabrotica virgifera
atcttgatttagtaaaatatcattttagtacaacgaaggaaaaatttaacttaatggtatccaattatgattgtgagagaatatttgagtttaatacaagacaattttatgaatgtgtaccttgtgaaacttggattatcagggaataattatatgatttattaatatccattatcttagagctctcaagatacaccttttaatgtgaattaactaactaaaacacttttctttgaaatgcatgtgtcactccaatgttaaatctctctactcttttagagcatctcctataaacctcaattcattagcaatatgtatataatgacatatggttatataatgaacaataactatttttaagtatgaccatataacaactactctactacaaagttaataaaatcatagatctgaagacaaaaaagcctcatattattttatatgacctcatgtatttgtatctgttcttatgtgtatttacttcaatttattactacaagatataatgtaatctaatgatacctagtcttgatgatataaatggtattgaacaacatgtatgtagaggcagaatatgatgagagaggatagagagatgttcaggaccattttcgtcacgtgaatgtcagcgacatgtcttcatatgatgaatatgaagatcgtccctcgcccactcgatgaatgatgatgttcgagagatagatcgaccgtgctgagtgagcatgat

SEQ ID NO: 14737 - DNA, 674 bp, Diabrotica virgifera
  misc_feature (7)..(29): n is a, c, g, or t
  misc_feature (31)..(49): n is a, c, g, or t
  misc_feature (137)..(154): n is a, c, g, or t
  misc_feature (260)..(296): n is a, c, g, or t
  misc_feature (378)..(398): n is a, c, g, or t
  misc_feature (496)..(518): n is a, c, g, or t
gtatctnnnnnnnnnnnnnnnnnnnnnnngnnnnnnnnnnnnnnnnnnncattgttttaacaagaataatcaaacatcaacttaatcataagtaggacaatctaaaaatagtttaggggagagatgcctgagacgtnnnnnnnnnnnnnnnnnnatttgtaatctatcatcgatagagatatacatgtaataaaaatcttagtgcagagctaggaacatttacataaatataagattagttttgtatctacattataacnnnnnnnnnnnnnnnnnnnnnnnnnnnnnnnnnnnnnagtaatacatgtgccaactcacccacatatatgtgtgattaatagtatatacttttagggaggaacttatctcgaaaaatgnnnnnnnnnnnnnnnnnnnnnataaattgtataatcaggaattttcataatatgaaatatgtgatcatttatgtttacatattattatttctctttaatataatgttgttattaggagnnnnnnnnnnnnnnnnnnnnnnncttactgatgatttgattaacattgacaaaatgcatatttgggagacagatatagggttaataaaggcataagggaacctttttttgacctgcctatgaaaaacatgctctattggaatgtaatcataacggtgcgtctgcccagtgatgaatttg

SEQ ID NO: 14738 - DNA, 201 bp, Diabrotica virgifera
  misc_feature (2)..(72): n is a, c, g, or t
  misc_feature (94)..(150): n is a, c, g, or t
  misc_feature (152)..(173): n is a, c, g, or t
gnnnnnnnnnnnnnnnnnnnnnnnnnnnnnnnnnnnnnnnnnnnnnnnnnnnnnnnnnnnnnnnnnnnnnnncaaagcttacatttttttaccnnnnnnnnnnnnnnnnnnnnnnnnnnnnnnnnnnnnnnnnnnnnnnnnnnnnnnnnncnnnnnnnnnnnnnnnnnnnnnnctaactcgcggtgattacaaaataaatc

SEQ ID NO: 14739 - DNA, 218 bp, Diabrotica virgifera; identical to SEQ ID NO: 7300
  misc_feature (6)..(28): n is a, c, g, or t

SEQ ID NO: 14740 - DNA, 888 bp, Diabrotica virgifera
  misc_feature (636)..(661): n is a, c, g, or t
  misc_feature (858)..(882): n is a, c, g, or t
catataagtgttcgacatacaagttcgttaagttagatgttttattctcaatggcagcaaataaagattctgcggaacatgttccgtctcctgttactgaagctcccataatcaagaaatcagttcgtcaaaaaaaagtgatggataatttcgatgatatggtcaaagatagtacgaaaccaataaaaaatgtggacgatagaaataatcaaactacagattctgcggagcatgttacgtcttctgatattaatgctcccataacccagcaaccagttcgtcaagaaaaagtgatggataataccgacgatatggctaaagaaagtaagaaacaagtaaaaagtgtggacgatagaaacaacccaactgcatgtcctgcggagcataatccgtcttctgatattgaagctcccattatccatcaaccagttcatcaagaaaaagtgatggataattccgatgatatggtcaaagatagtgccaaacaaacaaaaagggtggacgatagaaacgagcaaactatgaacaatcaatcagtgatatatgtgcgaataggacaatccaggtgtgaacaaactttaatattgggtgctctttttttggagtgtggtcttctaacgtgtatgctttgcggtnnnnnnnnnnnnnnnnnnnnnnnnnnaaatcattgttgatttttataaatatgtactacgttttattttataaacgtttgtaatattttaagtgttttttttatttagctattttgatcgttctttatcgtagtttataaattaatatactaccatatatggggattgtcaagaaatatcaacataaaattgatatttttcgacgagctgcgtcaaaatttannnnnnnnnnnnnnnnnnnnnnnnntatctg

SEQ ID NO: 14741 - DNA, 74 bp, Diabrotica virgifera
  misc_feature (4)..(52): n is a, c, g, or t
  misc_feature (59)..(73): n is a, c, g, or t
ctcnnnnnnnnnnnnnnnnnnnnnnnnnnnnnnnnnnnnnnnnnnnnnnnnncactcannnnnnnnnnnnnnnc

SEQ ID NO: 14742 - DNA, 158 bp, Diabrotica virgifera
  misc_feature (8)..(43): n is a, c, g, or t
  misc_feature (45)..(67): n is a, c, g, or t
  misc_feature (69)..(99): n is a, c, g, or t
  misc_feature (105)..(148): n is a, c, g, or t
agctcacnnnnnnnnnnnnnnnnnnnnnnnnnnnnnnnnnnnncnnnnnnnnnnnnnnnnnnnnnnngnnnnnnnnnnnnnnnnnnnnnnnnnnnnnnngcggtnnnnnnnnnnnnnnnnnnnnnnnnnnnnnnnnnnnnnnnnnnnntttttgatcc

SEQ ID NO: 14743 - DNA, 840 bp, Diabrotica virgifera
  misc_feature (11)..(50): n is a, c, g, or t
  misc_feature (58)..(58): n is a, c, g, or t
  misc_feature (68)..(69): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (81)..(82): n is a, c, g, or t
  misc_feature (88)..(88): n is a, c, g, or t
  misc_feature (97)..(97): n is a, c, g, or t
  misc_feature (105)..(105): n is a, c, g, or t
  misc_feature (107)..(107): n is a, c, g, or t
  misc_feature (109)..(143): n is a, c, g, or t
  misc_feature (153)..(189): n is a, c, g, or t
  misc_feature (191)..(203): n is a, c, g, or t
  misc_feature (205)..(270): n is a, c, g, or t
  misc_feature (272)..(381): n is a, c, g, or t
  misc_feature (383)..(608): n is a, c, g, or t
  misc_feature (614)..(626): n is a, c, g, or t
  misc_feature (628)..(641): n is a, c, g, or t
  misc_feature (672)..(672): n is a, c, g, or t
  misc_feature (753)..(824): n is a, c, g, or t
ttaactggggnnnnnnnnnnnnnnnnnnnnnnnnnnnnnnnnnnnnnnnnggaaaagnaaagaaaaanngnangnaaggannaggaangaggagggngagagaanangnnnnnnnnnnnnnnnnnnnnnnnnnnnnnnnnnnnttgtgtattnnnnnnnnnnnnnnnnnnnnnnnnnnnnnnnnnnnnngnnnnnnnnnnnnngnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaannnnnnnnnnnnngnnnnnnnnnnnnnnatgtgtttgtgtattaaatataaagtatagngtggggaatgattaatttgaatggagggggtattttgatggtggtaaggtaggataataattagtttttttatggaaagannnnnnnnnnnnnnnnnnnnnnnnnnnnnnnnnnnnnnnnnnnnnnnnnnnnnnnnnnnnnnnnnnnnnnnnaaggttaaattttttt

SEQ ID NO: 14744 - DNA, 520 bp, Diabrotica virgifera
  misc_feature (15)..(36): n is a, c, g, or t
  misc_feature (126)..(147): n is a, c, g, or t
  misc_feature (195)..(226): n is a, c, g, or t
  misc_feature (228)..(241): n is a, c, g, or t
  misc_feature (243)..(259): n is a, c, g, or t
  misc_feature (281)..(318): n is a, c, g, or t
  misc_feature (329)..(355): n is a, c, g, or t
  misc_feature (359)..(379): n is a, c, g, or t
  misc_feature (394)..(424): n is a, c, g, or t
ataattatatgttcnnnnnnnnnnnnnnnnnnnnnncaccctttaacttgtggtttaatattattaatacaaacaattttcacatcagttattacaggattaataaattataattactgattttcnnnnnnnnnnnnnnnnnnnnnngtaggaggaatattaattctttttatttatataaccagaattgcttcnnnnnnnnnnnnnnnnnnnnnnnnnnnnnnnncnnnnnnnnnnnnnngnnnnnnnnnnnnnnnnnctatattaagatttattttagnnnnnnnnnnnnnnnnnnnnnnnnnnnnnnnnnnnnnnatgaataaccnnnnnnnnnnnnnnnnnnnnnnnnnnncttnnnnnnnnnnnnnnnnnnnnncaaataatttaatcnnnnnnnnnnnnnnnnnnnnnnnnnnnnnnnctttaattgcaggagtgaaaattacaaaatttttatatgggccattacgacagaaatgttacgaaaaaggtatatgttaagaaaaaagaacaagaa

SEQ ID NO: 14745 - DNA, 753 bp, Diabrotica virgifera
  misc_feature (7)..(50): n is a, c, g, or t
  misc_feature (66)..(133): n is a, c, g, or t
  misc_feature (135)..(168): n is a, c, g, or t
  misc_feature (180)..(448): n is a, c, g, or t
  misc_feature (466)..(536): n is a, c, g, or t
  misc_feature (584)..(608): n is a, c, g, or t
  misc_feature (641)..(653): n is a, c, g, or t
  misc_feature (656)..(668): n is a, c, g, or t
  misc_feature (678)..(694): n is a, c, g, or t
  misc_feature (697)..(712): n is a, c, g, or t
  misc_feature (714)..(735): n is a, c, g, or t
aatgggnnnnnnnnnnnnnnnnnnnnnnnnnnnnnnnnnnnnnnnnnnnncctggggaatcagggnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnngaaaggtaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaggataatattannnnnnnnnnnnnnnnnnnnnnnnnnnnnnnnnnnnnnnnnnnnnnnnnnnnnnnnnnnnnnnnnnnnnnnggttaattaaaaacatgcctttttgaattaaatataaagcctcgccgnnnnnnnnnnnnnnnnnnnnnnnnncggaatttggaccgtgctaaggaagcataatcnnnnnnnnnnnnntgnnnnnnnnnnnnngaagggtggnnnnnnnnnnnnnnnnnccnnnnnnnnnnnnnnnngnnnnnnnnnnnnnnnnnnnnnnagctaaaatttttttaaa

SEQ ID NO: 14746 - DNA, 570 bp, Diabrotica virgifera
  misc_feature (15)..(15): n is a, c, g, or t
  misc_feature (17)..(18): n is a, c, g, or t
  misc_feature (21)..(22): n is a, c, g, or t
  misc_feature (24)..(25): n is a, c, g, or t
  misc_feature (27)..(27): n is a, c, g, or t
  misc_feature (31)..(31): n is a, c, g, or t
  misc_feature (41)..(58): n is a, c, g, or t
  misc_feature (61)..(62): n is a, c, g, or t
  misc_feature (66)..(67): n is a, c, g, or t
  misc_feature (91)..(91): n is a, c, g, or t
  misc_feature (93)..(93): n is a, c, g, or t
  misc_feature (106)..(106): n is a, c, g, or t
  misc_feature (108)..(108): n is a, c, g, or t
  misc_feature (111)..(111): n is a, c, g, or t
  misc_feature (118)..(118): n is a, c, g, or t
  misc_feature (124)..(124): n is a, c, g, or t
  misc_feature (130)..(130): n is a, c, g, or t
  misc_feature (136)..(136): n is a, c, g, or t
  misc_feature (186)..(186): n is a, c, g, or t
  misc_feature (188)..(188): n is a, c, g, or t
  misc_feature (192)..(192): n is a, c, g, or t
  misc_feature (199)..(199): n is a, c, g, or t
  misc_feature (204)..(204): n is a, c, g, or t
  misc_feature (206)..(206): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (225)..(225): n is a, c, g, or t
  misc_feature (252)..(252): n is a, c, g, or t
  misc_feature (299)..(300): n is a, c, g, or t
  misc_feature (325)..(325): n is a, c, g, or t
  misc_feature (351)..(351): n is a, c, g, or t
  misc_feature (380)..(380): n is a, c, g, or t
  misc_feature (411)..(411): n is a, c, g, or t
  misc_feature (428)..(428): n is a, c, g, or t
  misc_feature (481)..(481): n is a, c, g, or t
cattaagcggccggngnnaannannanaaangaggggccannnnnnnnnnnnnnnnnnggnncagnnaccaaaaggaccagacacgggcgngngcaagaaaacggnanggnccatganaaagangcagangagacngagcaacggccagaggcccgcaaaccaagaagccgaaacaagagaagcancngcanaacaaanacgcnangagangncncggcccacancgcgaagaagcaggaggacagcggagngccagccgcgggcaggaacgcgacgccacggcaaacaagccagagannaacacgcgggaacaaacccagaaanccagaacacggagaaaaccagcaaancccagccaacaggaacagagaagccagangcaacgagacaaaggaagaaggcagaaagcngcccggaggcaggcacnaaccccccgcaaagcgagcagaagaagaacgaaaagacaaggcgacggacaanaaccacgacgaaaccgcacacaacagaaaggacaggggacggcgcaagagccacggaactggggaagagagaacggacagcgaaagaaa

SEQ ID NO: 14747 - DNA, 904 bp, Diabrotica virgifera
  misc_feature (766)..(766): n is a, c, g, or t
atcaaatttgagctgtaaacatttgtactttagttaacaataatgatggaagaactcaagaggaacatttctgagcttaagaaaatgttcgtatgtttgtttttggccgagatatcgatgtttttatggcgcgctctgaggcgcgaggttggctcaccgcgtaaaggttcacgcgctaacttcccgatgcaaattataatttctatgttatcttcatttgtcatttttgaagatcctaataaaatgttatcatataattcttataattaaatgatcatactatacctcgtgtcacctttctttctatttactttgtcttctattttttgtactaaatgagaaaaaacattaaaaactaatatttcagaaatataactaaaaagtgacttgatattatttactaatactatttttacaaacattatctttcatgcatctgcatcgagatatacagagaatctcagcttttttacatctgcataagttcttagagcaatttttacaggtacatggtggtactaaatctgttcttgtaggcagtaaaactaaaactttctggggcttgttatgcctgtttagcttgttgctaaatgctcgttttatatgcaatgacgatgctgtaaaagaactcgatccatttttatatggatatcatatattggctcatttacatgcgtagaagccgagttacaatcgataaagcgtcgaaaaatacttacatacttgactgtgagccgattttgcgcctcatagcgcgccattaaangtgtcgatgtctcgacgaaaaatagacttacgaacattttaaaacgctcaaaaaggctcttttgagttcttctaaaacgctcttttgagttcttctgtcattgttgttgattaaagtatgaatggtgacagctcgaat

SEQ ID NO: 14748 - DNA, 931 bp, Diabrotica virgifera
  misc_feature (194)..(212): n is a, c, g, or t
  misc_feature (417)..(436): n is a, c, g, or t
  misc_feature (544)..(572): n is a, c, g, or t
  misc_feature (809)..(809): n is a, c, g, or t
  misc_feature (830)..(848): n is a, c, g, or t
  misc_feature (855)..(855): n is a, c, g, or t
  misc_feature (862)..(862): n is a, c, g, or t
  misc_feature (895)..(895): n is a, c, g, or t
cttagtaatcttattattttatatataggatggtcttatatttcggagttcaagaaatgaaaatttgtttcttactattttatacaacgtcaaatatgtatatcactactattaggatcccattaaaaaaatcgaagctccatataactaaacaaaaaccattgtcatttacccattatttattgtcaaaacgnnnnnnnnnnnnnnnnnnngaataagccacaattttattttaaattcagtttatttgacgtttcgattgccattttggaaatggttctcaaaatacaaaacattagtaatcatttttaatatgtactagtttttttgagacattttaaaattcattttagatttaaaatttagataacatgttcaattacataaattggcaaatatgtatgcttgagataatcnnnnnnnnnnnnnnnnnnnngtacattataatcgtatttttccaaaatgtcactttttgctcaaatatattgtcttttaaatatttttgacaacgtcagattcaaaataaccttactttatcataaannnnnnnnnnnnnnnnnnnnnnnnnnnnncattttcatacatactttaaaggaaaatacactgaatatgacattgaatataaatatatacacatgcttgttataaccttttttggattattcttttgcagattttttttgtttggtagaagtcaactttagcatgagtctatccctaaatctttgagatatttttaccatctgaaataactacaattaggtttttttaagaaggtcctaagttgaaataatttgtagataattggngttcaaaattaaaaaagttcnnnnnnnnnnnnnnnnnnnctgacancactcanaaaaatactataacgcattttaaacataacttncatttcattacgagactgacacaactcaaataatgc

SEQ ID NO: 14749 - DNA, 859 bp, Diabrotica virgifera
  misc_feature (2)..(783): n is a, c, g, or t
  misc_feature (785)..(798): n is a, c, g, or t
  misc_feature (800)..(817): n is a, c, g, or t
  misc_feature (819)..(850): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnncnnnnnnnnnnnnnnnnnncnnnnnnnnnnnnnnnnnnnnnnnnnnnnnnnngggggtgat

SEQ ID NO: 14750 - DNA, 880 bp, Diabrotica virgifera
  misc_feature (10)..(10): n is a, c, g, or t
ataatttggnattcctttttaatttctatttttatgtgaacataaatgggaagacaacttgtgaaacttctaaaggtcggtaaaataaaatatggttgcggactccacttacaacaacactttgttcagcttcataaaaccacaacagaaaatcaaaatactctgattattgtggagcaccctcatgtgtatacaacaggaatccgtgataaaaactattcacaaagtgaagaagaaaatctaaagcacaaaggagctgaattttatagaaccaacagaggcggtctaataacataccatggccctggacaactagtggcatatcctattttaaacttacataatttcaatccaaggattcactggtatattgataagattgaaaagaccatcctcaatttgtgcaaaaaatttaaattggaggctgaacttcttggggacagaggagtgtggataaaagacaaaaagatttgttctgttggacttcatggttcccgttacattacctcccatggttttgctctaaattgcaaccctgatctctcctggtttgaccatatagtgccatgtggaattgaaggaaagggtgttacaagtctcagccaagaactgggtagagaagtaacagttgcagagactataccagtcttgttagaaagttttaaggaaatctttgaagtggatctcattgattatcctgaagaagaggctgattgtctccagaagacttttgttaaataagaaacaaatatgtgtgcatacttcatttatgttttatttgttattaggcaatctttgccttttatatagctgatatgagatttttatagacaaatatgtattccatatttctttttgataataaagaatatatattccc

SEQ ID NO: 14751 - DNA, 754 bp, Diabrotica virgifera
  misc_feature (7)..(24): n is a, c, g, or t
  misc_feature (32)..(52): n is a, c, g, or t
  misc_feature (82)..(149): n is a, c, g, or t
  misc_feature (151)..(163): n is a, c, g, or t
  misc_feature (214)..(233): n is a, c, g, or t
  misc_feature (244)..(275): n is a, c, g, or t
  misc_feature (278)..(306): n is a, c, g, or t
  misc_feature (314)..(354): n is a, c, g, or t
  misc_feature (362)..(375): n is a, c, g, or t
  misc_feature (377)..(407): n is a, c, g, or t
  misc_feature (445)..(463): n is a, c, g, or t
  misc_feature (491)..(542): n is a, c, g, or t
  misc_feature (552)..(591): n is a, c, g, or t
  misc_feature (655)..(682): n is a, c, g, or t
  misc_feature (695)..(741): n is a, c, g, or t
gggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggatatcaaccagaacggttagaggctgnnnnnnnnnnnnnnnnnnnnnnnnnnnnaatatcattaccnnnnnnnnnnnnnnnnnnnnnnnnnnnnnnnnnnnnnnnnnnnnnnncttctttatttat

SEQ ID NO: 14752 - DNA, 153 bp, Diabrotica virgifera
taacagcgtaattttattggagagatcaaatcgataataaagattgcgacctcgatgttggattaaagttgataattggtgtagaagctatattattaagtctgttagactgttaaaattttaaatgatctgagtgtagcccgctgtcgagcc

SEQ ID NO: 14753 - DNA, 146 bp, Diabrotica virgifera
  misc_feature (2)..(27): n is a, c, g, or t
  misc_feature (30)..(58): n is a, c, g, or t
  misc_feature (60)..(73): n is a, c, g, or t
  misc_feature (75)..(87): n is a, c, g, or t
  misc_feature (90)..(127): n is a, c, g, or t
gnnnnnnnnnnnnnnnnnnnnnnnnnngtnnnnnnnnnnnnnnnnnnnnnnnnnnnnncnnnnnnnnnnnnnncnnnnnnnnnnnnnagnnnnnnnnnnnnnnnnnnnnnnnnnnnnnnnnnnnnnncaatcaataattttttgat

SEQ ID NO: 14754 - DNA, 638 bp, Diabrotica virgifera
  misc_feature (54)..(68): n is a, c, g, or t
  misc_feature (480)..(495): n is a, c, g, or t
caaactttaggctggtcatatcttctatttcaagtaattatatattatttaagnnnnnnnnnnnnnnnttggaacatcgctccttaaaaatggcaaaagaatctgctggcaaaatagggaatggtgctgtcactacatatgtcctactttataatggaatacagactttatcgtaatctcattatagatcccagataatcgtaaagtatatatggtaaagtagattgaacactactgtgtacatatagagtaatgatcctggtgctgttatataatgtcgtgtaaacccaaatactaatatcctatatttaccatctaaattcataatctaacacctaacgaacaaatactatcaaatattcttgagcatgaggacaaataaacactattctaagattacttctaagttaactgtaattgtctgaatgataacgactactctacctcccacttgttagtatacctacttcatatcgccannnnnnnnnnnnnnnncaatttcgttataggtgactgtgatgttgattatgctgatttgattaaatgagtagcaataacttcaaagctgactgccttgtatagataatatcatgtaaattagcagtatcatgaaatagtataattatctactctgccgc

SEQ ID NO: 14755 - DNA, 813 bp, Diabrotica virgifera
  misc_feature (29)..(63): n is a, c, g, or t
  misc_feature (580)..(636): n is a, c, g, or t
cattatgaattccagaaaacgatgaccannnnnnnnnnnnnnnnnnnnnnnnnnnnnnnnnnntccggagaacgttcggcaggtgaatttcactctttcgacttttccttggtctctgttgtttaccattggatacatgtttcgtcgacggccacgaaacgacacagaaatttctccagattgcgcttaaacaccgttaaactgctctgaattggtctcacggttgggctggttgtccagagtgagcaaatgcggcacctattacgttctcttgctcaaaattaaatcaggatataaacaaaactacgagtccgctttggctgaaattttgacagtaaccgtctatgaaaatgtactacacgatagtagatttctcttgcgatagtggcgccatctactaggccactaagcgaatgctgagttctcgatcgtttcgtaggtgcgggtgtcatgtcactcgaggtgcaggtacgtcgtttgcaccacttcatcatgaatggcgatatctatgtttctaacaagtttcagattaaattatacagggtgtccagaggctcttctgacaggcgaggaccggagnnnnnnnnnnnnnnnnnnnnnnnnnnnnnnnnnnnnnnnnnnnnnnnnnnnnnnnnntaagggagctggagctctttgaagatggcccctgtaatcggtttttttttaaatatctccagaacacgggcgcctatataaaaatttttaggggtggggcagacgtgaagatgttgcacatttactctgggctaattagcaaaattcatggaaaagttatttaccggcaattttgtt

SEQ ID NO: 14756 - DNA, 896 bp, Diabrotica virgifera
  misc_feature (10)..(10): n is a, c, g, or t
  misc_feature (15)..(15): n is a, c, g, or t
  misc_feature (24)..(24): n is a, c, g, or t
  misc_feature (27)..(27): n is a, c, g, or t
  misc_feature (51)..(52): n is a, c, g, or t
  misc_feature (57)..(57): n is a, c, g, or t
  misc_feature (64)..(64): n is a, c, g, or t
  misc_feature (90)..(90): n is a, c, g, or t
  misc_feature (142)..(142): n is a, c, g, or t
catcaagcgnccggngaaagagancgnccccaaaggccacactgccgggannatganatgcagnactcccgaagagaacaggaacacganaaggggcacaaagaaaagaatattcaggacaacaaaaaacaagatgaccaancacatcgttctagtaacgaagactggagtgaaagaccggagaaagttcgtgaagaaaaagtggttgataaatacgaaaaagaacgtgaaagagatcgtccccaaaggccagacagccgggattcacgcgattcgcgctcaacgcgtcattctagagattctgaaccacgcgagtacaacatgggctcatggtcagaatcgatgtatgaacatccatacgaggacaaaagaaaagattacagtagagaggaacgacgttctgttcctggtcctatcactaaagatcgcatggaagccgatgatatgcgaaacgaaaaaaggaacttgacgcagctgaagcgcggtcaagtggtagaagtgaaatcggagattaaaaaagaacttcccacaaaagttattccgttgaaaatggaatttgctagcgcatgggcagatgctcaacctcttgcactggaagaagctgaatcgaaaatgaccgaagacaaaagacagtctgagtcaaaagtggagattaagtcaccagagcagtccaagaaatctgataaaaccgatgactataaccaaaatcgtaatagatcgtatggtcaaaagaaaggttggaacacgaacgataatcattcttcacgagggcctccctggccgagaaggccttctagtcgtggtcagaaaccaggaggaaggaaccaagactaccacacagcagattctgacggctctctcgatgaccactcaggggattttaaaagcggacgacg

SEQ ID NO: 14757 - DNA, 113 bp, Diabrotica virgifera
  misc_feature (2)..(21): n is a, c, g, or t
  misc_feature (23)..(78): n is a, c, g, or t
  misc_feature (80)..(95): n is a, c, g, or t
tnnnnnnnnnnnnnnnnnnnnannnnnnnnnnnnnnnnnnnnnnnnnnnnnnnnnnnnnnnnnnnnnnnnnnnnnnnncnnnnnnnnnnnnnnnnagcgcgggattttgaccg

SEQ ID NO: 14758 - DNA, 917 bp, Diabrotica virgifera
  misc_feature (12)..(264): n is a, c, g, or t
  misc_feature (266)..(299): n is a, c, g, or t
  misc_feature (301)..(332): n is a, c, g, or t
  misc_feature (777)..(798): n is a, c, g, or t
aaattcgaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnngnnnnnnnnnnnnnnnnnnnnnnnnnnnnnnnngtatttatcaatagtttagtcaaaaataaacttcatttagttaaattatattaatgatgatcccattatgcattaataaagtgtatatattagaagaaagatatagagattgataatggtgatcaggaccctgtagatccttgtagtgttgcttcaacatcgcatgatagttacattatttctggatccgcaagcactactgcctatagtggataagcgccgaactgtgcacgctcttgagctcgatgaaaattactttaagcctacttatagtccacatgaaaaatacatagaagcgaaccattgcatgattattatataatttgatgtagcacccaacaactggtgcacacattaaaatgtcatgctatggccatccgttctctttgcttttccccctgactccaataatagctacaggactgaagaagggattagaactttnnnnnnnnnnnnnnnnnnnnnntttataagaacttttaaggcctgcttcttggggtctttacggcaaattttcctctgatggcaaaactttggttcgggcaattccataaaccggaaaaagattggggaaggccctcccca

SEQ ID NO: 14759 - DNA, 100 bp, Diabrotica virgifera
  misc_feature (2)..(70): n is a, c, g, or t
cnnnnnnnnnnnnnnnnnnnnnnnnnnnnnnnnnnnnnnnnnnnnnnnnnnnnnnnnnnnnnnnnnnnnncccttagggataacagccgaatttttattg

SEQ ID NO: 14760 - DNA, 667 bp, Diabrotica virgifera
aggtgaaattcatcgtgggttttaatggctactgatacattccggtcctgttaccgaaccaccggtgaatacaccccttattagatgtcaaggtctactgatgatatttgtgttattgatttcctgattgtctgttcccatcgtaatatatacaaacttctatatgctatatactttgtgaattattatgattatagaggatctgtatcaatgatttcctgccatgctttgaatgatgcaaatgagagacaactttcgataccctaccccagatatccacatgtataaaattgccctgaccgcttaaattccatcttctattatgaacattaaataccttccttcaaactatttaaagattaccgatcttcaagattgaattatattatatctctctggaatggactcttacacaactcatattctcccattattgaacatacaacaaaacattcgttgtatatgaatatgaatatcttatatctggtattgtttcatttcttatattacccaatctgaattccagggcgttcgctctatatatatcgaggttacaaactcgtgcatgcaaatttgtatctcatctatagagtgacctaaaatcaattcactgcgcatctgtttacatcaaactgtatgataataccacttctccatccgacttaat

SEQ ID NO: 14761 - DNA, 251 bp, Diabrotica virgifera
  misc_feature (2)..(243): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttt

SEQ ID NO: 14762 - DNA, 167 bp, Diabrotica virgifera
  misc_feature (2)..(92): n is a, c, g, or t
  misc_feature (126)..(152): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaaaattaggactcaaaattttcatatctgnnnnnnnnnnnnnnnnnnnnnnnnnnnattattattgttatt

SEQ ID NO: 14763 - DNA, 397 bp, Diabrotica virgifera
  misc_feature (234)..(249): n is a, c, g, or t
ctttacccttccgggggtgtgtcacttttatatgtaattctttctcaatcttatgatattctttaggtaaaagtaaccattgagaatctcgcaggatatgcaaatagtgtgtcagacataaaagtggacttactgtgaacgagagacgatgctcgaggaacttgtgtatcctggcaaactaaagaagtagttctgcaataatcattttcagatttaatacagcaacgacatgannnnnnnnnnnnnnnnctggaaactgccaagaacaacttgtgtggtgaactgtcgttcacggatgcatatatggataatatttcggggcccacacttaatttctctattaccaatgatgaccaaagtacaatatatttttacgcaggaccttgacaaataagta

SEQ ID NO: 14764 - DNA, 902 bp, Diabrotica virgifera
  misc_feature (212)..(231): n is a, c, g, or t
  misc_feature (317)..(336): n is a, c, g, or t
  misc_feature (838)..(838): n is a, c, g, or t
  misc_feature (879)..(879): n is a, c, g, or t
gtacctcttaaaaataagcatttatttacctcacctaaatatttttataacataaggatataaatatggaagttaaaaccgaagtaaaggaagagtttatagaatgtgacaaaagattggtggttctgctgtccacagaaatagaccttggagaattaaaatatgaactcccaaataattcagaagagacaagtgtttcccacaaggacaannnnnnnnnnnnnnnnnnnncatatgtggaatcatctaatacagaaaaacacatgaatgcacaaactcattctggaagaaaaatatacaaatgtgaaatatgtgannnnnnnnnnnnnnnnnnnnagagtttaaattaccacatgtgtattcacaccggacaaaaaccttttaaatgtgaaatatgtcctaaacaatttactagaaaacaacttttgggataccatatgacagttcactctggagaaaagcagcatcaatgtgaaatttgttataaacgatttaatcgaaaaactgatttaaatgtgcatgtgagagttcatactggagaaaggcctcataaatgtaaaatgtgtcttaagcagtttgcccaaggaattactttaaagaaacatatgagagttcatactggagaaatgccttataaatgtgaaatttgtcttaagcagtttgcacgaaaagattctgtaaaagagcatatgaaagttcatactggagaaaggccttataaatgtgaaatttgccttaaacagttttccataaagaaaactttaaatgagcatatgagagttcatactggagaaaagcctcataaatgtgaaatttgtcttaaacagtttgccgtaanaaaacaattaactaggcatataagagttcacactgaggaanaaccatataaatgtgaattttgt

SEQ ID NO: 14765 - DNA, 816 bp, Diabrotica virgifera
cccactcactagctgcattactagctagtctgaacgtctgtccaaattttgtgtcatttgtggagcacaacatacaactcgtcaacctgaatgtcagaatgtatctcacaccatgttaggccaaatcggaaacgacagctgtaatgcctgctgccagtagaactgcctgcaacctgacatccaaactgactcacacatgacagcagacaaaactgatgaaagaggagatgacttcttcaacacattcgtcaccgaaactgatgcccctaaacatgtacctatagaattatttgcaaatttagaacctacagtactaaacgaaacacacaccgaaacgtaccgcccattgctcctcccaaaacaactcatcaatgccaacaaaaatgacgccaataactatgatacaggtcactatacaataggtaactagatattggacttaatattgaacataatccataaatggactgatctatgtactgtactgctaggcctcttgatcttccactccttcggagctggtactgcatctgtgttcacttctctgctaacggaacaccaatctgatgactatgaaatgaaatccaaacatgtaattcgccatctacccatctactcatgtatctactgctgaagaataaccatacacctccatcttgactacccacaccactcatgaacactctaactgagactatatggtcgacaatgacatcagctatgacatccgaaaactcaatctacacatctaccgcacaacctacaccatctctgaccgactcactgccccaatcacatcctcactcacatcttctc

SEQ ID NO: 14766 - DNA, 649 bp, Diabrotica virgifera
acgcatccgggtttggatctcttgtaacgtagattaataatgtagaacattacaacggacattatcctatataggagctctttaatccttacctggtaatagcagtcacatccgtataagaaattgcgtaaaagttctagatatttgttatattacaaccatcaatgaggcctttcatatatcatgacttagtctcctccagtatacctactacttgctcaagcaagtctgacgctggatcggatggagagctggtctttactcattgtgttcaacgatgttttcacttgttatcacaactctcttctgatatcagctgatcctgataggctgatatgatatctgctactaaatatgattagagtatgcggggaaactggattacgtgcctcataactacgttatccagaatccccagaaatgagaatacccccacggctctcctacgtcaaaagtgaagtgtacattctccttctctatattcatagtgaaggtcctgttgaaaagactgatatgattatgttattgtaatgacgttggggaaatattgaatgttgcttaatagtttcttaaatattaaagataatgcttttatagatagagatgttgatactatattaccttacgataacgatataatagcaaattt

SEQ ID NO: 14767 - DNA, 518 bp, Diabrotica virgifera
  misc_feature (246)..(265): n is a, c, g, or t
  misc_feature (409)..(456): n is a, c, g, or t
ctatggggataatacgaacatctaatgaggaaaaatagcgtaacgctgagcagttcgggtcggtggtctagctatctttgtctgtcgtgcgagtgtgagcgtatctaccaagaggtgggagtaatggaacgacacaaacactgaggcggcggccatcatatgctagagagagaaagctaagcaccggttgagaaatatagagagatccccgactagaaatatttgaatgtgttaggagatcactcnnnnnnnnnnnnnnnnnnnncacccatagtcagatatatttatattactgatattaagtatctatagggttgagcttataaataaaattttgttacattgttattataagctattaatgtaggatataaaattataacctcaaaacttaagatattatttaccnnnnnnnnnnnnnnnnnnnnnnnnnnnnnnnnnnnnnnnnnnnnnnnnccaatttaaactaataaaattctagtctggtgataatgacagcaccaaaaaattgtttatct

SEQ ID NO: 14768 - DNA, 910 bp, Diabrotica virgifera
  misc_feature (39)..(57): n is a, c, g, or t
  misc_feature (60)..(73): n is a, c, g, or t
  misc_feature (858)..(858): n is a, c, g, or t
aataaaattagttattaaaatgtagtactgcaagcaaannnnnnnnnnnnnnnnnnnccnnnnnnnnnnnnnngcatatcatatcaatattgtgaagcaacatataatttttcttcttaaatgacagtagatatgaaatgtacgtcaatttgacaatatgaattatttaagaaagttgcaatatttctccgctattcgcgcacgatcgtttgtcaattcccttccaagtacttgcacaccgcgaatagtcatcaatagtgctttcaatgggaaggttaggaaattgaatgtatgaacgaaagaggaaattgtcagatataaatttaagggaagtataaaagttaactgtttttacttattgaacaatttgtctggctaaataggtctttaatctaagaccaaaaatactatttgtcttcctccagtggccagggctatttcatgaccgaccaaagtccactgactattagggccggtatttccaacctcacttaagccaaagcttactttaagcctttgcttaagcttagatgcctgtatttccacttcaatttgaggcttaagcctaggcttaaaccaaataattttaagctcgcgcaggagttggtttaagcctttgcttaaaatttgttttctgtttttgaggttatttctatagattattaattagagagttattttgaaaaccaactttagagtaataatgctattattagattattaaataatctattaatctattaatttattaatcgtaataacgattattaaaattcttactacttttggaaggtgtaggcacatgaaaattatttatttctacaatgcttggtaggtatatttattttacaaaaatanacttacattcgaatttgacattttaaggaatatatcccaatcacaaaattac

SEQ ID NO: 14769 - DNA, 895 bp, Diabrotica virgifera
  misc_feature (17)..(35): n is a, c, g, or t
  misc_feature (102)..(799): n is a, c, g, or t
  misc_feature (802)..(894): n is a, c, g, or t
gtacgaaaggaccaaannnnnnnnnnnnnnnnnnngatagaaaccaacctggctcacaccggtttaaactcagatcatgtaaaattttaaaagtcgaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 14770 - DNA, 895 bp, Diabrotica virgifera
  misc_feature (281)..(303): n is a, c, g, or t
  misc_feature (750)..(750): n is a, c, g, or t
  misc_feature (838)..(838): n is a, c, g, or t
ccaccccacaactttaagcttcttgtcagctttcttgcttttaaataaaaggtgtagttgacggatttggattcaggttatttcattcatagtaaactttcagtttatctagtgctcttcaaagtttgctctccaccaaacaataggatttttttggttttctgacaggagagctagcacactactctgggttctccactcgccgttttaactttttttaaactgaaaataatcttataacttcattacattcaaaatcaccataattagagtaggtttgnnnnnnnnnnnnnnnnnnnnnnnactataatttacattaaaaaatttccacaggttgattcagaattattgctgttatctttacaagactcgtaaaaatatcaattacaataatgttatagttctatatagtcatacgagttttttatcaactaatcaatatttttactgctcagaacactatttatgtcaaactgtttagatttatcattcaaattatttaaaacaagttttgtgtttaataaaatggctccagatatattttgagatggtcctatgaggattcgaatgtttgcgatgacttttatgaatcttaaagattttataatttaggtaattttattagatctcttttcatactgagtgttctaaaattgacgttcttttgcgcaataaacaatcccaatttgatttcaccaggacatgtacttaaatatgtaactgaactacacaatgtagtttttgaattanagtatttacaagaacaaagccacaaatgaataatagatataactggcgaattacttaatagtagtagtagatcaagacattaactgcngaattaatagatacaaaatatacgctaaatttactctacttatcttttttgacaatg

SEQ ID NO: 14771 - DNA, 840 bp, Diabrotica virgifera
ctatgttggaatctgacaagagatctttgatttcgctttgggatgaaagacgaattttgtatgagcagtgcatggacttacaagtcttctacagagacacagaacaggctgacacctggatggcgaaacaagaagccttcttagccaacgaagaccttggcgattctttggactctgttgaagctcttatcaagaaacacgaagatttcgaaaagtctttggcagcacaagaagagaagattaaagccttagatgaatttgctaccaagttgatagatggcgaacattatgcggctgatgatgtagctcaaagacgagctatgcttttggaacgccgcaaggctctcaaagaaaaatctagtattcgcagagaaacgctggaggacgcttacaaactacaacagtttgaaagagattgtgacgaaaccaaagggtggattaacgaaaaacttaaattcgcaaccgacgagagttatttggaccctactaatttgggaggcaaagtacagaaacatcaaaatttcgaacaagaactcaatgccaacaaatcaagaatggaagatattacatcaactgcccaagaactcatcgaggctgaccattatgctgcacctcgtatttcaatcaagaatgaaagagatcgtggaacctttggaaaatttgacccaatcaacaaacaatcagactcccatttttcaagattcccgtcactccacactcccaacatacctatcgaatttatcttgcttttccccctttaaattacatcccctctaatctcccccattctcctcccacccacctcccttccccaaacaccccattccaccaccccccccc

SEQ ID NO: 14772 - DNA, 382 bp, Diabrotica virgifera
  misc_feature (4)..(32): n is a, c, g, or t
  misc_feature (69)..(96): n is a, c, g, or t
  misc_feature (113)..(248): n is a, c, g, or t
  misc_feature (251)..(373): n is a, c, g, or t
gagnnnnnnnnnnnnnnnnnnnnnnnnnnnnngaagagagaaaaaaaagggggaagaaggagaaggggnnnnnnnnnnnnnnnnnnnnnnnnnnnnaaaggaaagaggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggaag

SEQ ID NO: 14773 - DNA, 91 bp, Diabrotica virgifera
  misc_feature (2)..(3): n is a, c, g, or t
  misc_feature (8)..(8): n is a, c, g, or t
  misc_feature (10)..(10): n is a, c, g, or t
gnnaacgngnggacaacggggaacccccttaaaaccgggcggagaaaaaggcggacgccgcacgcccacggcggggccaccaccagccaac

SEQ ID NO: 14774 - DNA, 512 bp, Diabrotica virgifera
  misc_feature (73)..(91): n is a, c, g, or t
  misc_feature (246)..(271): n is a, c, g, or t
cttcacgcgtccgcctaacctaagtcctaacttaaacattcttttttaaaatataacagaaacatggaaaacnnnnnnnnnnnnnnnnnnnatcacgtaataagaaaatatttattactttccaattcataagagctaccgactgaacacccgtattgtaaaataaacatcttaacgaactctcctagaacgacatgttattcccgctgaaatagatctgatcttcgtaaaaaataactcaaacgnnnnnnnnnnnnnnnnnnnnnnnnnncaaagacacctatattattaatagtagttatttgtaggtatgacgtcaaacacaacacgccatgccaacctaatttttacatcgcattcacgatctaaagattgtcatattgtagaccatgcaataattaatgtctatgcaatatcactctcattttctaaaagttttgtattaagatacagatttcaatcatttaaattgagtaatgaagagactattgaacaactaataaccgtatgtt

SEQ ID NO: 14775 - DNA, 159 bp, Diabrotica virgifera
  misc_feature (118)..(143): n is a, c, g, or t
ccccttttgcgcccgagatataacgagagtaaaaatagagcccctttaagaatcgacgcagcaagatcgtcgttttcttaagtattagtttctcctgtatgatgacgaagatgtcttnnnnnnnnnnnnnnnnnnnnnnnnnnacagtactttataata

SEQ ID NO: 14776 - DNA, 637 bp, Diabrotica virgifera
  misc_feature (13)..(137): n is a, c, g, or t
  misc_feature (140)..(229): n is a, c, g, or t
  misc_feature (235)..(403): n is a, c, g, or t
  misc_feature (411)..(447): n is a, c, g, or t
  misc_feature (450)..(592): n is a, c, g, or t
  misc_feature (595)..(630): n is a, c, g, or t
gaggtagaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagagnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnnnnnnnnnnnnnnnnnnnnnnnnngagaaaa

SEQ ID NO: 14777 - DNA, 168 bp, Diabrotica virgifera
gttaatcaaattttggtaaatttcttccattaaattcttgtttttatataatgagaatggtattatatcgcataagcaacttaccaacattcaacatattctctaaacaggttgtaacgtggacggcgcaccacacaaccttctaagaccactaagaccatcctgact

SEQ ID NO: 14778 - DNA, 397 bp, Diabrotica virgifera
catcgagatgtttggctgtcatgaaatatattataaaaaaggtttatttgttattataattgtagcagcgaatatttgtagatgaacacggaagtatcttttacttgacacatccttcacgagatgaacactacatcacacgataggacttaatttcgaaaacaaaagaacgtctggccccgttccgactatgccattggaatcgccagcgccatcacgcataatagttcaacgcgagacacgatcaattacaagaaagtcgaacacatctgatctgtagacaagctcttatcgtcaccttcgctgtccattgaaaacccgccctgcccacccctaaacccttgtcttgaccagcaaagactctctatctgaggctatcgtaccaaatcatgtcttt

SEQ ID NO: 14779 - DNA, 505 bp, Diabrotica virgifera
  misc_feature (7)..(25): n is a, c, g, or t
ccctttnnnnnnnnnnnnnnnnnnnggtagcttgttattattgatgtgtgactatttgaaggtgacaaagattactttagggatgaatctggctctgagacgtgaaggagctgaggatttaggtaaaaaatattaaactagaaatcgaagataattatattcatgtatgctgagaagtagaaagatgaacatattgatgatgtagaaaagaggtatatggagattttcaaattataggcaatattttcctagcacggataagaaagatcgggtactttttgtactgtttataaagactcgcctgcacgccgagtattgagaatgaccggggtaaatctaacgtgctaacacttccatatttcaagatgcccattatacgaatgctgtattgaaccttaccaaagctatagaaactggctgagtagatagtatctagaaatttagtgctttcgctaaaacactcattttttttctactgacgagattcccctttctagttcgtact

SEQ ID NO: 14780 - DNA, 1229 bp, Diabrotica virgifera
  misc_feature (108)..(109): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (121)..(136): n is a, c, g, or t
  misc_feature (138)..(180): n is a, c, g, or t
  misc_feature (182)..(198): n is a, c, g, or t
  misc_feature (201)..(213): n is a, c, g, or t
  misc_feature (215)..(281): n is a, c, g, or t
  misc_feature (283)..(384): n is a, c, g, or t
  misc_feature (489)..(529): n is a, c, g, or t
  misc_feature (536)..(594): n is a, c, g, or t
  misc_feature (596)..(670): n is a, c, g, or t
  misc_feature (747)..(772): n is a, c, g, or t
  misc_feature (784)..(805): n is a, c, g, or t
  misc_feature (818)..(840): n is a, c, g, or t
  misc_feature (843)..(861): n is a, c, g, or t
  misc_feature (887)..(887): n is a, c, g, or t
  misc_feature (902)..(923): n is a, c, g, or t
  misc_feature (956)..(985): n is a, c, g, or t
  misc_feature (1031)..(1049): n is a, c, g, or t
  misc_feature (1061)..(1080): n is a, c, g, or t
  misc_feature (1155)..(1177): n is a, c, g, or t
  misc_feature (1179)..(1202): n is a, c, g, or t
aagaaatgtaaaatgaaaatgtaatacccttataatgtaaagtaaaaatgtaatgtaatgttgtttgttgttgtcctcccccaccattttatcctcttccctcctacnncnttnccncctnnnnnnnnnnnnnnnnannnnnnnnnnnnnnnnnnnnnnnnnnnnnnnnnnnnnnnnnnnannnnnnnnnnnnnnnnnttnnnnnnnnnnnnnannnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccttctccccccctttcccaacaacaactctctctttcccaccctaccacccaccccacaacctcccatacccccccctcacaatttaaactcccccctctnnnnnnnnnnnnnnnnnnnnnnnnnnnnnnnnnnnnnnnnnacccccnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnntcctcccctccttcccccccctcctctacctcccacaccccccctcctccctttccccccctcctcccctctcctcnnnnnnnnnnnnnnnnnnnnnnnnnntcccctcctcannnnnnnnnnnnnnnnnnnnnnacaccaccccctnnnnnnnnnnnnnnnnnnnnnnnctnnnnnnnnnnnnnnnnnnncccctccctcccctcaaccacatccnctcctcttacccctnnnnnnnnnnnnnnnnnnnnnntctctcccccctccttcccctccccttctcctnnnnnnnnnnnnnnnnnnnnnnnnnnnnnntccctcccatacccccatcccaccctcccctccctttcctcctcannnnnnnnnnnnnnnnnnntcctcctacctnnnnnnnnnnnnnnnnnnnntccctcccaccctctcctctccccctaccctccctccctcccccaccctccttcctccccttccccctctccctnnnnnnnnnnnnnnnnnnnnnnnannnnnnnnnnnnnnnnnnnnnnnntccctctccttccccccctccctccct

SEQ ID NO: 14781 - DNA, 80 bp, Diabrotica virgifera
  misc_feature (4)..(29): n is a, c, g, or t
  misc_feature (31)..(31): n is a, c, g, or t
cccnnnnnnnnnnnnnnnnnnnnnnnnnngnaaaaaagacccccctctttaccgcacaccacaccaaacgacacactgat

SEQ ID NO: 14782 - DNA, 374 bp, Diabrotica virgifera
tcggactaaaatatattaatagattaaagacagtaaaccaacctggctcacaccgtttttttatcttatcaggtaagactttagaactcgaacagacttaataatatagctgctacaccatataaatactttaatccaacatcgcggcagaaatctaaaatatcgattagaattatccaaaaaagatacacagatatccctcaggtagtgcattcttatagacccaaaagtaggagcaaggacaagctgtcaactagtttcttaaacagggacttgcaatattcaaatcatgggtctgcattttataaaaagcggaatgcacacaccctggggatagaaaagtcagacgccgtgcatcctgtaccactttcaac

SEQ ID NO: 14783 - DNA, 299 bp, Diabrotica virgifera
gtcaattgtcacaaatctaaatcggcattttgatcatcaattttgtggtttttactggtcccttgagcggtagggatcactacctaacaacaataaaactattactttcccaattcaagacagcaaccgtcttaacactcttattgcataataaacatcttaacgaactctccttgtaccggtctgttcttccccttgacataggctcccgcttttctcacgaaacaactcccacccagttactaacaataaagttacagctaaacctctttatattactaatagtacatatttttacg

SEQ ID NO: 14784 - DNA, 973 bp, Diabrotica virgifera
gtagcccgattaagtgaaattaaatgggtcgaatgaactttttcacaatcgtaccgtaatgcaactgcaatcaattgcgaaaaaactagttcacaattgtataatttacgctattaataacattaaagtgatttaagtgataacgttatattatagctgcatgctttaaatatccggctaagtcaacggaaaccgttaacatgaaatatctcaacattattgtggtgtttatatacatcgggctgattgtgacggatatttgtgctatggtcgtgagagatagactgaataataacgtgaatagacccaaaggagaatcatttaggattcagaagttatatagatattattttttgacttactggaatttcatgctccaaatcttcttcatttcgctagccgtcctagatgaactctcaaaacttctgagcttaccatcaaaagtccagaatctcctcagcaaagtcagggcctacatattcaacagcctcgtgtttccatgcagcacattagtagtttttacgttttggtctatctgggctgtggatagagaactgatattcccgaaagttatggacacattctttccatcgtggttgaatcatgtgttacatactttcatagctattcctttagttatagagatattgctgccaaagaaagataattttgtgcaattcaagaatgcagctcctattttattattttatgctggattataccagacattgtatttttccatatacctcagggatggagtatggctatatccaatatataaagttcttagcataccccaaatggtgttatttaatatagtacaaatgttattgatattaggattccagtatgtaagtataagctcccaaatagtaaaatgaagaaaccggaagaaggaaaaagaaagtcaagtgattcttttatattaatttattgcaataaacgcactaccaaaataaaattgttcagtttt

SEQ ID NO: 14785 - DNA, 978 bp, Diabrotica virgifera
ataaaaatcagttgtttttagaactctttagcaatgtattagtataatataaggtttgttccatcatcaccgaacaccgatatggatgaatcattaaatggttattattgaaatataaattggacagatatttttgattggaggatattaaaagaatattctcctacatataaaaacttgttgatgtccccaattagtttaagaataattttggctctgctttatcaaggctccagcggcctaactaaaagagaatttgaatctgtgatgcattttacagaccaacaatctgcgagagaggaatttaggaatatccttaacaaattacaggttgccgaatctccagaatatactcttaatttaggaacacgagtttttctagacatcccagtcgcacctcagcagaaatttgcaagtattgccaaagacttctttaaaaccgagctcgtattaacaaattttactaataaagaagaagcgggacataccattaactcgtgggcagaacaacagacaaatggaaggatacacaaactaatcgatccagctgatcttgcagatgctttaatggtaatagccaacgctgtgtattttaaagggacttggaaatatcaatttcccttccagactgtagataaattttacgttccagatggaaacaatttcttttccatttcagctcggtttatggctgtagaagataaattttattttcatgaatctcccctattggacgctaaaattttaagactgccttataagggcggggcgcttactccatggttatataattaccgaactccgaaggaagttttaccaagtttaatttaagcaataaaacataattaacttaaaagtttggtggatttgatggatcaacgttttggttaatgtcccgttcccccaagttttcgctttcattttcaagcgagggttaagacaaccctttataaaagttgggttatttttattgttttc

SEQ ID NO: 14786 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14787 - DNA, 794 bp, Diabrotica virgifera
catcattatttactggttcaatacgggtttattagaaccagatatacaattacacgttatgtaagagcctcctgcgttctctctattatcggtacatgtagctgttgcgtaactacaagcattactagagcacttttcgcagtatcgtctgcgaaccggtttttcatttgactatttctgtcttatcaccgattgtaaatatgatgtgtgttatgccttacatatttggatagatgctgaatcatatgagatagagcttcgcatatatcgagaattgaatacttcaaacctgtgccttatcctaaacctcaacacgattctgtctactcatccgactcttactttatactattatcctgatctacttaccggggagccttatgacatgatcttcttttttgaatacgagctgaatctagacagactaaacaacaaacatgtgacatatcttgagaaccgtatgaggataatctgtgcggaaccactcattgacttcgtgacttccaaatactcaaatctcgagtggtcttatcttacttcagaagcgcagtgattactgaatgcttactgaagccgcctcatctgacttttcccgtgtgcactattatgattactccctccgagtctgctcattgaattgctcgagacatatatttatttagccagctctttgatcaatcccctccatgatcactggtgtctgcttaatcttaagacccagaagagatatttgtgtctatattacatacttacactgaaagtgtgaatatctcaagaacatctacgatatcttg

SEQ ID NO: 14788 - DNA, 780 bp, Diabrotica virgifera
  misc_feature (745)..(762): n is a, c, g, or t
gaacaatctagtaaaagacgattaccgcaactccaccctatgcttttgagaaattccttaaagaatatgaagaagtggctctcgctgatcccatagcctttatcaaagatttactcacaggacgtgtttcagcccctatttcaaaaacgtgagaacctccagatcgaacacgaaaaaccgatttagcaagtacaacacatttccaaaagaatcgctctctttcagagatataactgtattctatactgcttcataagtatcacacatcaacagtttgttcgtgtataatgtggaggaaacaccattaacgactttcgctatttcccaacccaagcccttatgttcgacttcaaagataaaaacaagcagatcttcttgaacatagtagacaaaaaaatacaattctggcgttacttcttaagtaacttgcactctgcagcagacgccgtattatacctccctctgctgttgtatacccacatgatttcgacaaaaccgggttgaccaccgacgtcaataaaggagtgcaccttaggtgaattctcggaaatgtgtaactgcttatgcaaaatcttataagctgtacgccttgatacgattatatctgtcggacttgtgtgtatcagtacaagctatcattatctaccgatggcgctttcttcaacttctacgatactgtcaagtgtattttgcccgatcctatgaacactcctcttgtacattcatcgcacattgctacagactnnnnnnnnnnnnnnnnnntcatctcatgatcccttc

SEQ ID NO: 14789 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (168)..(192): n is a, c, g, or t
  misc_feature (199)..(233): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttaaaccggtgtgagccaggttggtttctatcnnnnnnnnnnnnnnnnnnnnnnnnngaaaggnnnnnnnnnnnnnnnnnnnnnnnnnnnnnnnnnnnatatt

SEQ ID NO: 14790 - DNA, 726 bp, Diabrotica virgifera
  misc_feature (44)..(64): n is a, c, g, or t
  misc_feature (143)..(179): n is a, c, g, or t
  misc_feature (303)..(358): n is a, c, g, or t
  misc_feature (435)..(478): n is a, c, g, or t
  misc_feature (537)..(554): n is a, c, g, or t
cccgacctatttgaaaagaataaaatattttccctttaaagtannnnnnnnnnnnnnnnnnnnnctaccaagtagtgattgtccgagtccattttattatgatacacacttccactcgttttttgtaccttgtggatcaggcnnnnnnnnnnnnnnnnnnnnnnnnnnnnnnnnnnnnngttaaaagagataacaaattatcatttttattgtataataaagattttacacagcttttttgttatgaagtgttattcgcctttaaatatctctaactttttaagaaataagttaaatttatgnnnnnnnnnnnnnnnnnnnnnnnnnnnnnnnnnnnnnnnnnnnnnnnnnnnnnnnnaggactgagcttgaaaaacaaaattttattaccatctaacttttacgtaacaattagggttactccattttcctacnnnnnnnnnnnnnnnnnnnnnnnnnnnnnnnnnnnnnnnnnnnncttttataaattctttattataatacgaacttacagtatttacattgaggattgctgtnnnnnnnnnnnnnnnnnnccctgctacttactccactcacatccggttatcaataggaaccccgcaacctctttcttcccctgtcccatctagaaccttgtctgttcgttttaaaaagaatgtctcgcctgcccaccgtttaagttgaatgcccgaggtatttttgacccgcctcaccctcgccctcccc

SEQ ID NO: 14791 - DNA, 157 bp, Diabrotica virgifera
  misc_feature (2)..(85): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnntataccgacaacatttttttgcacctgattattagaaacgtgcctttttgaatttattagatggtctcccct

SEQ ID NO: 14792 - DNA, 363 bp, Diabrotica virgifera
  misc_feature (29)..(50): n is a, c, g, or t
  misc_feature (181)..(198): n is a, c, g, or t
ataaatgtgatatataactgaaaataggnnnnnnnnnnnnnnnnnnnnnnaagttaatgtatatgtgttaggtcatatgtaaaattatgaaaagttgtatgacagtagatattataaagagaaaaaataaagtgatttttacttgttatataataagaatgttcaattttattgtagtgcnnnnnnnnnnnnnnnnnnctaaattgtgaggactattgtttgtatctaaaattaaaaaagtgaaaaaaatttaattttgtcatatgaagattcagagacgaatgggttaattagtcaaagaatagatattttattagaaagatggaatagagtgagatatttatcaaatagattcaatttgtt

SEQ ID NO: 14793 - DNA, 144 bp, Diabrotica virgifera
ctataccttaagcggtgatgatagcctgcattctacccgccatgcaaaacaagcgagctctattcatggagtgacagttgattcacatctaagcatactgaacagagtattgctgatcaccattgtgtaaggaggtgaacgaac

SEQ ID NO: 14794 - DNA, 69 bp, Diabrotica virgifera
  misc_feature (13)..(13): n is a, c, g, or t
aagtgtttttggnccaaagaaaaccccctttagaccaaatatgggcgtaaaaggactggaagacagaaa

SEQ ID NO: 14795 - DNA, 425 bp, Diabrotica virgifera
ctaattaggattgagagacaagattatatgtttaccttctcacgcacctcaaacctatcctgatacatcactgacaggagcaaccaacaataaacataactaaaagttaatgtccatgtgctcactcacatctaatatcacccaaagacgaatcacactaactaccataaacagcccaaataccctgctttttacctgccacacacacggcgagctccattttattgcaccgctagttaaatacacctcatccaacctgcgacgactattccttctctccaacattatccaagcgacgaacatttattctcgacatatgcccccccccagcccaacgcgccaccccctcacccaacatctaatttattaccaagacgaactacagcgcgacatttatctaacagctcccacccgctctgcttttt

SEQ ID NO: 14796 - DNA, 836 bp, Diabrotica virgifera
  misc_feature (451)..(478): n is a, c, g, or t
  misc_feature (596)..(621): n is a, c, g, or t
  misc_feature (639)..(676): n is a, c, g, or t
  misc_feature (690)..(718): n is a, c, g, or t
atcaataggaagaagaatcgtactaactaattgccaaatttctatgcagtactattgtaagcacagtttgttttaaattcttataaaaaaatggtcttagcttttaatgtatagtgtgtgttaactgcaagtttgttcatgtgtaattaattcccagaatcgtttcaatattaatttatatatccttattcatcctcatttgtattgtggaatcttgcattgacacacacttacctaatttttaaagagacaaacgataatttcttctttgtccgtcaactcctatattttttgaacatcttcaataccatatttactcgttggaaaatggactgcaagaagttatgtttgtctccttatttttattctagagtacctatatgtaacctaagatatctatatcgaaagtgatgtgagtgtaaattatatgtttttatgtaaagagtttacnnnnnnnnnnnnnnnnnnnnnnnnnnnnctagtgatattaaatataagctgtgagtctctattgagcgccattttttgacttgctacaaaaacttgcgttctggtaaattttgcatgataagctacaccacatcacaaaaatttgnnnnnnnnnnnnnnnnnnnnnnnnnncataattgcaaaatatgnnnnnnnnnnnnnnnnnnnnnnnnnnnnnnnnnnnnnncttggttaaaatgnnnnnnnnnnnnnnnnnnnnnnnnnnnnngattttgattgattataaatgtgcttactcattgtctgttctgtcctgaaactagtccttctgatttgttaccatgtaatggcatatcttttgaatacgctaatatacatctccacag

SEQ ID NO: 14797 - DNA, 121 bp, Diabrotica virgifera
agatttagctgcgagtgtggaattgcccttgagatggctcaaaactcaaccacatcttccagaaggcgcaaggagtaaaaaaatggaactctacgtattttcttgaagcctcgaactagaa

SEQ ID NO: 14798 - DNA, 68 bp, Diabrotica virgifera
  misc_feature (3)..(15): n is a, c, g, or t
aannnnnnnnnnnnncaataactttaatttatttcactttaccaatgatgataagattagtatcaaaa

SEQ ID NO: 14799 - DNA, 540 bp, Diabrotica virgifera
  misc_feature (382)..(401): n is a, c, g, or t
cgccatcgttggcgtatcgtaattttcccttgagcaggaaaaaagcatctaatatcctgaacgttgaacatcagtgtcgaagaatatattagcaatgattccttaccacattaacttgcgaacgagcaactatccctaaccatacagtaattaagaaattaccatcacttaaaacaaaaagtcacgttgagtgtactattctatggagggacaattatcggaaccagtctcatctcggccagcaaagaccttcgctcactctctaccctgacccggagaaattgacccatcaaccttgacacgccccgcaacgacagaaaccccacgacctagacccgctccccctcaaacacgatacatcgaaacctcctcaacagcgtcnnnnnnnnnnnnnnnnnnnntcgtagaccctgaagctgacaaagaaacctgatgtcggtccagcaatcgcagaagccgagttcagacaacgatactcacgaggacggataccataataaataaatagataacctaccttctatcaccccatccgccacc

SEQ ID NO: 14800 - DNA, 130 bp, Diabrotica virgifera
  misc_feature (4)..(28): n is a, c, g, or t
  misc_feature (78)..(102): n is a, c, g, or t
aagnnnnnnnnnnnnnnnnnnnnnnnnncttatataatataaaaaattaacattaaacaattatattatataagtatnnnnnnnnnnnnnnnnnnnnnnnnngaattttgaataaaatatataatttaac

SEQ ID NO: 14801 - DNA, 203 bp, Diabrotica virgifera
gaattattatattattaatggagatccccttttaggaggaaagaagatttttatatagtgaaattgtattaattgcgaggggagagctatattatgatgaatagttacagctttaatgtgtagtacgaggggtagtcggtgattatactagtaatataacaaatttacgtatcactcataataatcctagtaaataatgggtg

SEQ ID NO: 14802 - DNA, 594 bp, Diabrotica virgifera
  misc_feature (4)..(65): n is a, c, g, or t
cggnnnnnnnnnnnnnnnnnnnnnnnnnnnnnnnnnnnnnnnnnnnnnnnnnnnnnnnnnnnnnntcgtagatgataacttgtattatattgcgatgtagtagtattatagtgatgactgatataccgcttatcagttaatctctgagcgtcagtgataatataatagtagttacaaatgttcgcttactataaaaaccaaataataatgcgtgaattcacagatggcatgatgattcatcgttagcagttgtattggcgcgttaactgatccgtttgtttctgtctgtacttatgtaaagaaacgatccaactttagagaacttttatcgatataaaatcgaacagcttaatccgccctgagagatgcaattcttagacacagcagaaacagaacatttcactagaatgcaccccctctacacaaagaatgaacagcattttgcagaagcgaagagatgaacgaaccatcttacataccataacatccgccccttgaatcacatcattaacaaagacaaaggcacccattatttccccatcctcctagatcgctaaaacggtgtacccgtatcagcatagtgaatcggatcta

SEQ ID NO: 14803 - DNA, 500 bp, Diabrotica virgifera
  misc_feature (102)..(119): n is a, c, g, or t
  misc_feature (122)..(145): n is a, c, g, or t
ccccccttccgggcccggtattttaggagaatagaagataatttcccctatttaggacagaatatatttttataatagatagctaattatgattgagagagnnnnnnnnnnnnnnnnnnggnnnnnnnnnnnnnnnnnnnnnnnncttcaggggtgactaattagaaaattagaaaatcaacataatcggtaaaaaaggaatcaaaagtattaatttttacagcaagattattatctaagcgcaaactcatttggactagaaaggtgttcagattttaataaatatgacttatttaacaaaaagaataagcttgatttttaaatgtcccaataaaaaacatattgttttaagtcactatgaatcaatattttactaggacacctttattgaagtacctgcccataaaattaatattacaagataaatacctggtacctcattttatatctgtgctgatatgattgtatcttatgatataggggaatatgtatcagtacat

SEQ ID NO: 14804 - DNA, 864 bp, Diabrotica virgifera
  misc_feature (623)..(639): n is a, c, g, or t
aatttttatttgggcaggtctagaactccaaattccagtttgccacattttttatcaataattgttactaaatgatgtgattaagtttagaaatattcacctagttttctttttagttttgtattatagttatttgtagtgataacaatttttaaagttgtgaatatgtcgataattttaagtgaagttgcgttcctgaaatcatggaaatttcctgctaaacaattattgcacacaagaacttttgcatccagtacacttacacaaagccaagattcgaataattatgacatcgctattgtcggaggaggaattgttggagttgccacagctagggaaattagtaataggaactcaaaattgcgcatggcaatacttgaaaaagaaaaaacacttgcaaatcatcaaaccggccacaatagcggagttgtacatgctggaatatattacaaacctggttctctgaaagcgaagttatgtgtagaaggtttacagttatcctacaaatacttcgactctaaaaatattccctataagaaatgcggaaaactgatagttgcaacagataaatcacaagttgaaaaactacaagaacttcataaacgaggtatagaaaacaaagnnnnnnnnnnnnnnnnnttaaaaggagaaaaggcaattcaagaaaaagagccactttgtaaaggtttagaagcattatggtctccggaaactggaattgtagattggggtttggttactcagtattttgcgaaaagatttcttaatcaaaaaggagagatatataatgattttcaggtaaatggattccaagaaatcagagatccaaactatccgatttaagtaactgaaaacgatcaaaaa

SEQ ID NO: 14805 - DNA, 217 bp, Diabrotica virgifera
ttttaatagtagctaattacgatctgagagagaatattttactcttatagccgtatagtttatttattagtaccttgtgcaatcagccgtcattaattaggagttatatcatttagcattttcggctcaaaaagacactcagacgtcaggtccttcacagcacgaaaccccctttctagcgattcttttgggcgggaaaggtgttccgtttctctaa

SEQ ID NO: 14806 - DNA, 297 bp, Diabrotica virgifera
  misc_feature (82)..(101): n is a, c, g, or t
  misc_feature (109)..(135): n is a, c, g, or t
attgtgtgataattattggagataatttttttggagagatatgtgttttgtttgtatatgtttgtaattggtaaagaattgnnnnnnnnnnnnnnnnnnnngatagatnnnnnnnnnnnnnnnnnnnnnnnnnnngtaggaattaatttttggggagggttaaaaaagaatatttttttagcacgcacgttgtaattagaaatgatgtaaagaaatttgtggatgtgaagatatggtagtagttgtttttatttatgattatgtgtatgatgtataagatttttattaagagataaa

SEQ ID NO: 14807 - DNA, 116 bp, Diabrotica virgifera
  misc_feature (2)..(38): n is a, c, g, or t
  misc_feature (40)..(62): n is a, c, g, or t
  misc_feature (64)..(109): n is a, c, g, or t
gnnnnnnnnnnnnnnnnnnnnnnnnnnnnnnnnnnnnncnnnnnnnnnnnnnnnnnnnnnnncnnnnnnnnnnnnnnnnnnnnnnnnnnnnnnnnnnnnnnnnnnnnnnatttttt

SEQ ID NO: 14808 - DNA, 973 bp, Diabrotica virgifera
gtgattccttaaaatgaaatgtaaatatgtacaggtggaatattgtacagtttttatatagtaaaagacttctatgcaaaatgttgtaaataaactaagtgaactatataacgatgttagaatgttgtaacgatattttttcatatcacagctaaatagttgttttcatgttattgaaaataataatgtgtatttttcttcattgtattggatgtctcaacaaaaatttacatctagacaatcgacatatcttagtaatctctataaatcgaacctattatatggcaaatttgaagtttcttcttgtgatgtatttatgttagtcaaaattcttctaatgcatatcatgtttacatttttgcgagcacatcgcatctcttctgccatcaggtgttcaaaatacgatgcttttctaaattttacataagcatttttactcttttcatatttatccaggattgttttattcatgtcatacataggtccaaggtaccctaagcatataatgagagcattatattttgagggtttttaaatggttaactcattcgctactacaccactttttgattttcgtcagacatgtgtcaagtgaaagaattagtgtgaaagagtttgtgtcaccaatgcgcgccatgacctctttgctaagagtaagtcagtaattcgtgacatgcgcactaaaaggtttaaaggcctaatgtttttggtataaaacaatattcctgttctccttgttcttgtttactataagaatgtgtgtcttcttacagttgtccctccaggtaggccttcagttgaatcagctaaaagagggttgaatcttcatatggaaagaatgttgatctctgtttttttaaacagggggagggggaaaaggaatacaaaccctgccccgaatcctctccttgcggaatttttttgaaatctgctaatcccaattcaaatttcggattgcctatcaccttttttc

SEQ ID NO: 14809 - DNA, 575 bp, Diabrotica virgifera
  misc_feature (488)..(514): n is a, c, g, or t
  misc_feature (516)..(531): n is a, c, g, or t
  misc_feature (541)..(560): n is a, c, g, or t
aaatggtgtagttatacgccggcgatgggtttggcccaattcattttggggtacatgtttacgtctttcggttatcctattgctgttacgttgctacagacaatattttctaaattattaggatccaaacctcagggcgtctggatgggattcatggtaggcgctggctgtctctccagagtgatgggacccatttttgtaacttacatctacgaagaatacggaacagtttggactttcggatttaccaccgtcatgatgattgtgtgccaaatatggctactgtggattcagaaaagtctaaatcccgatttaaaaaaagacgaagcaacaaccgatcaagaacttcaagaaacttctaaatttgcgtccgtcgatctagaagtagaaaacggaatacaaagaaattgtgataatgtacaatgaatagtacaaaacattttaaagatgttggcagtacgatatatatgctggtgtccagtgactgnnnnnnnnnnnnnnnnnnnnnnnnnnncnnnnnnnnnnnnnnnngtgtcatacnnnnnnnnnnnnnnnnnnnngagtactaacttttt

SEQ ID NO: 14810 - DNA, 336 bp, Diabrotica virgifera
ccccgcgggtcccggcccgaaattccccgcccccccttcggccccgaattttactcgccagagtatatcccctattagtgcacaataaacgtatttaatagattaactggtacgacttgatagggaatacttgattttgatgaactattgtttaatgtttgtacctcgagcatcagccatccccaactaggaactatacaaccagtaatttctgatctaaaagaactctaacctcacaatctacattgcatgacaaatatttgtagccaattttttaggtgagaaaagttttccgtttttatatatccccaatatttaaacaaatgatttaccttg

SEQ ID NO: 14811 - DNA, 661 bp, Diabrotica virgifera
  misc_feature (2)..(2): n is a, c, g, or t
  misc_feature (9)..(9): n is a, c, g, or t
  misc_feature (44)..(44): n is a, c, g, or t
  misc_feature (46)..(49): n is a, c, g, or t
  misc_feature (55)..(56): n is a, c, g, or t
  misc_feature (58)..(59): n is a, c, g, or t
  misc_feature (70)..(70): n is a, c, g, or t
  misc_feature (72)..(72): n is a, c, g, or t
  misc_feature (80)..(80): n is a, c, g, or t
  misc_feature (113)..(114): n is a, c, g, or t
  misc_feature (121)..(121): n is a, c, g, or t
  misc_feature (137)..(137): n is a, c, g, or t
  misc_feature (142)..(142): n is a, c, g, or t
  misc_feature (189)..(189): n is a, c, g, or t
  misc_feature (196)..(196): n is a, c, g, or t
  misc_feature (208)..(208): n is a, c, g, or t
  misc_feature (220)..(220): n is a, c, g, or t
  misc_feature (227)..(227): n is a, c, g, or t
  misc_feature (234)..(234): n is a, c, g, or t
  misc_feature (250)..(250): n is a, c, g, or t
  misc_feature (253)..(253): n is a, c, g, or t
  misc_feature (255)..(255): n is a, c, g, or t
  misc_feature (260)..(260): n is a, c, g, or t
  misc_feature (275)..(275): n is a, c, g, or t
  misc_feature (278)..(278): n is a, c, g, or t
  misc_feature (284)..(285): n is a, c, g, or t
  misc_feature (289)..(289): n is a, c, g, or t
  misc_feature (293)..(293): n is a, c, g, or t
  misc_feature (303)..(303): n is a, c, g, or t
  misc_feature (305)..(305): n is a, c, g, or t
  misc_feature (311)..(311): n is a, c, g, or t
  misc_feature (315)..(315): n is a, c, g, or t
  misc_feature (321)..(321): n is a, c, g, or t
  misc_feature (333)..(333): n is a, c, g, or t
  misc_feature (337)..(339): n is a, c, g, or t
  misc_feature (347)..(347): n is a, c, g, or t
  misc_feature (407)..(408): n is a, c, g, or t
  misc_feature (411)..(411): n is a, c, g, or t
  misc_feature (414)..(414): n is a, c, g, or t
  misc_feature (417)..(418): n is a, c, g, or t
  misc_feature (423)..(423): n is a, c, g, or t
  misc_feature (432)..(432): n is a, c, g, or t
  misc_feature (439)..(440): n is a, c, g, or t
  misc_feature (456)..(457): n is a, c, g, or t
  misc_feature (474)..(474): n is a, c, g, or t
  misc_feature (513)..(513): n is a, c, g, or t
  misc_feature (517)..(517): n is a, c, g, or t
  misc_feature (520)..(520): n is a, c, g, or t
  misc_feature (531)..(532): n is a, c, g, or t
  misc_feature (543)..(543): n is a, c, g, or t
  misc_feature (547)..(548): n is a, c, g, or t
  misc_feature (550)..(552): n is a, c, g, or t
  misc_feature (558)..(558): n is a, c, g, or t
  misc_feature (560)..(560): n is a, c, g, or t
  misc_feature (565)..(565): n is a, c, g, or t
  misc_feature (585)..(585): n is a, c, g, or t
  misc_feature (614)..(614): n is a, c, g, or t
gncggccanaacaatcgaaggaccgactttccaagaccaaaaangnnnnccgccnncnncaacaaggccncncgccaggnccaacccgaaaaccaaactttaccacaaccagnngacgacncaccaagggcagaagnaaaancacgggcagccggaagacagaccgcagcagccgccgccgccgaaggngacagcngcgaacccggancagcacaccacnccgcccncggaggncaaggaggcacccgcncangnggcancacccacacagccgnagnaccacnngacngagnaaaacgccgnanccaagnagancccgcnaaacacaagagngcannnaacggccncaaagcaacccgcgcagaagaaggcacaagaggcccagccaaaggacgggccccaacccnnccnggnaanncagcncaaggacgncgcaaanncggaccagaggaaggnnccaaagcaacgcacggngacacgagcggcgaggaaaacgcccaccccaacagaacncggncgnacgaagcagcnncagccacggcngaanncnnngccganancgccncaccacccacggaagccgcnaaagacaaaacccaaaccacacccggacncgccaacaccccccgcgaagcacgcccaagaaaacacagggaagaag

SEQ ID NO: 14812 - DNA, 103 bp, Diabrotica virgifera
  misc_feature (11)..(12): n is a, c, g, or t
  misc_feature (15)..(15): n is a, c, g, or t
  misc_feature (17)..(17): n is a, c, g, or t
  misc_feature (19)..(19): n is a, c, g, or t
  misc_feature (21)..(22): n is a, c, g, or t
  misc_feature (24)..(24): n is a, c, g, or t
  misc_feature (26)..(28): n is a, c, g, or t
  misc_feature (41)..(58): n is a, c, g, or t
  misc_feature (70)..(70): n is a, c, g, or t
  misc_feature (76)..(76): n is a, c, g, or t
tattaaagcgnncgnangnannanannngggggctttcccnnnnnnnnnnnnnnnnnnggaatgttggtntgaagntattttcttgtggggtttttagaggtt

SEQ ID NO: 14813 - DNA, 527 bp, Diabrotica virgifera
  misc_feature (8)..(25): n is a, c, g, or t
  misc_feature (30)..(30): n is a, c, g, or t
  misc_feature (32)..(32): n is a, c, g, or t
  misc_feature (137)..(156): n is a, c, g, or t
ccccctcnnnnnnnnnnnnnnnnnnagagngngggggaaaccctttttgataagagagggagaggagggagaagaaaaagccgccaagagagaagaaaaggaggaagacgaacatttttaccagactaagaaagacnnnnnnnnnnnnnnnnnnnnaaacactaagatcaaataaaaatcgcacacgacaccgaaccagcagaagaagaacgaccactactagatcgacttcttagcacttggataaatttcactgccaaaggctttttatgttacctgcctgacgcacttccagagcttaatgcgcccaccagagagaaagagcgcctcggcagcacaggactctgccaccgagacctcctcgagcgataatgactcctgcgaagaactcgacccactaccgatacttgccaaccctctcctggtgatcgcatagccatgtgcgcaggaagcagaggccgatcgctcaacttcctggatagaaaccaactgtcccctcccaacccgcagactgacctcgagcaacc

SEQ ID NO: 14814 - DNA, 936 bp, Diabrotica virgifera
  misc_feature (737)..(737): n is a, c, g, or t
ggtcacagtacccaaatggcggaatctttctcttaagtactaagcctttattgggaaataaagttctctaggatgtacatggtgttcacagtgttttcccagaatccacccagtgttttataaaggaaaacagtaatgaagaactgagagatccgccttttggggaaataatacactactacatgggaagtcatagaccctcatccacccgagaggaacctattccggctccagtcagtcaacctgggagcaagcaggagcgtttcagcttcattttcattttttttacacctggacctacaggaggttcagttttgcactaccaaggtgctcattttccggtatgcggtagcaaccttttgagaagtcagttgggattgtttgggaacaatgagtgtttgtgataataactttttgtatatggtgtttcatattacagacatttggttaatgtattacgtttattaattattttctcaagatttagcttgaatttatttgctgtttaatataggtacatataaggttagtaggttcccaaactgttgtatctacggtaacttcttgtgcacaggaataagcctagaaaattaggtttttatacgttattggttattggtacaatagctgacatctagtttctttttcttttccttacttttgttggagtttatggacgctgtttttctgcgccataactgtccattgtgccttcttcacctaaacatttctctctncagtccccgcgacacactccttccatcttctcctcggtttttgtctacctccccttccatcaacttctaacaactttatccttagtcttacatagttttcatttatacatcaaacgttaccaaaccattgcagtcttccttgattcttcttttagactgtattcaccctggctcttttcctagtccagtcattcctgat

SEQ ID NO: 14815 - DNA, 169 bp, Diabrotica virgifera
cagagtactacaggaagttccctccgcctaaactggaacagctggtgaagagacgggtggaaaaagagttggaacaacgaaagcgagatgagcagctgtctcccttagagactgaacagaaaccaaaacatcaggcacaggaaaacccgggaaccccgcccgcctcaag

SEQ ID NO: 14816 - DNA, 91 bp, Diabrotica virgifera
  misc_feature (42)..(59): n is a, c, g, or t
cattgctggaacttgtaggaagccctcttttcgccggcattnnnnnnnnnnnnnnnnnnccagagtgataagcgcaagataggataaaaag

SEQ ID NO: 14817 - DNA, 98 bp, Diabrotica virgifera
aaaaaatatgtacgaaattagaattcacctagatttggcaatgggagaaatatttgtgatagactgtaaaaatcttaaactagacattggattaaaaa

SEQ ID NO: 14818 - DNA, 841 bp, Diabrotica virgifera
  misc_feature (10)..(38): n is a, c, g, or t
  misc_feature (70)..(205): n is a, c, g, or t
  misc_feature (212)..(293): n is a, c, g, or t
  misc_feature (296)..(323): n is a, c, g, or t
  misc_feature (332)..(415): n is a, c, g, or t
  misc_feature (417)..(436): n is a, c, g, or t
  misc_feature (459)..(515): n is a, c, g, or t
  misc_feature (527)..(616): n is a, c, g, or t
  misc_feature (621)..(666): n is a, c, g, or t
  misc_feature (680)..(818): n is a, c, g, or t
aaagaccgcnnnnnnnnnnnnnnnnnnnnnnnnnnnnngacagacaaagacaaaaacacaaagagacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccgnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnngaagaaggnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnncgaaaacacacacaaaaaacacnnnnnnnnnnnnnnnnnnnnnnnnnnnnnnnnnnnnnnnnnnnnnnnnnnnnnnnnncaagcgcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccnnnnnnnnnnnnnnnnnnnnnnnnnnnnnnnnnnnnnnnnnnnnnnaaccacaagcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaccacaccaaaaaaacaccaa

SEQ ID NO: 14819 - DNA, 104 bp, Diabrotica virgifera
caggcgcccggagtagacactatttaacactacaagctttttatagctgatctttataaaggaaagaatgttttcatgaccgcgagggacggtaataatggtac

SEQ ID NO: 14820 - DNA, 184 bp, Diabrotica virgifera; identical to SEQ ID NO: 9239
  misc_feature (2)..(29): n is a, c, g, or t
  misc_feature (49)..(62): n is a, c, g, or t
  misc_feature (65)..(87): n is a, c, g, or t
  misc_feature (95)..(117): n is a, c, g, or t
  misc_feature (147)..(178): n is a, c, g, or t

SEQ ID NO: 14821 - DNA, 1061 bp, Diabrotica virgifera
  misc_feature (5)..(23): n is a, c, g, or t
  misc_feature (73)..(96): n is a, c, g, or t
  misc_feature (162)..(198): n is a, c, g, or t
  misc_feature (204)..(223): n is a, c, g, or t
  misc_feature (270)..(305): n is a, c, g, or t
  misc_feature (395)..(416): n is a, c, g, or t
  misc_feature (426)..(446): n is a, c, g, or t
  misc_feature (551)..(568): n is a, c, g, or t
  misc_feature (582)..(609): n is a, c, g, or t
  misc_feature (638)..(665): n is a, c, g, or t
  misc_feature (681)..(704): n is a, c, g, or t
  misc_feature (787)..(816): n is a, c, g, or t
  misc_feature (818)..(834): n is a, c, g, or t
  misc_feature (891)..(922): n is a, c, g, or t
  misc_feature (936)..(963): n is a, c, g, or t
  misc_feature (995)..(1018): n is a, c, g, or t
  misc_feature (1028)..(1048): n is a, c, g, or t
ggtgnnnnnnnnnnnnnnnnnnnctaaaaagtgttttttggtttttgggttttgggtgtggttgtttgggagnnnnnnnnnnnnnnnnnnnnnnnnggagggggattttaggtgaggttttttagttgatgagtgttatttgttgtgtttgtgttgggtggnnnnnnnnnnnnnnnnnnnnnnnnnnnnnnnnnnnnnggaagnnnnnnnnnnnnnnnnnnnnattgtttgtggaggattttttttttttaggagggagggtaagggggnnnnnnnnnnnnnnnnnnnnnnnnnnnnnnnnnnnntgttatggttgtgtgggtagttttggttgtgtgttttgtagttgttttttggtggtagtgggtgtttttgtaattgtttttttgttgttnnnnnnnnnnnnnnnnnnnnnnttgggtggannnnnnnnnnnnnnnnnnnnngatagttttgatgttggtttttttggggtttgtgtagtgggaaggttttagttgtggttgagtggtttgtttagaatgttttttagtgtttttttatgtttgttnnnnnnnnnnnnnnnnnnagaggtgagggggnnnnnnnnnnnnnnnnnnnnnnnnnnnnatgttttttttgatttttgggattttttnnnnnnnnnnnnnnnnnnnnnnnnnnnngtttggttttgttgtnnnnnnnnnnnnnnnnnnnnnnnngggttttttgtgttagtatattattttatagtgggtgttttggtttatttttagtgggtgtggtttggtttggtggggtgttnnnnnnnnnnnnnnnnnnnnnnnnnnnnnngnnnnnnnnnnnnnnnnnggtgtgtgtggtgtgttgttgttttttttgtgtgttttattgtgtgtggtttttggnnnnnnnnnnnnnnnnnnnnnnnnnnnnnnnngttggtattgaaannnnnnnnnnnnnnnnnnnnnnnnnnnngttgttttattagattttttttggagttgtgnnnnnnnnnnnnnnnnnnnnnnnntgattgattnnnnnnnnnnnnnnnnnnnnngtgtatttttttg

SEQ ID NO: 14822 - DNA, 161 bp, Diabrotica virgifera
  misc_feature (2)..(49): n is a, c, g, or t
  misc_feature (51)..(107): n is a, c, g, or t
  misc_feature (110)..(151): n is a, c, g, or t
gnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnntcnnnnnnnnnnnnnnnnnnnnnnnnnnnnnnnnnnnnnnnnnncttaaggaaa

SEQ ID NO: 14823 - DNA, 252 bp, Diabrotica virgifera
ggcccccggggggacccgggcgggaattcccgggcccccctttggcccggtagatttcatttgcgcgagtgtgagtgcccctctgcaatgcatttagtttgattaggaatcgctggtacgtaagcgatatagtccgtctaatagatactgctcatgatgagtaaaggagaaacacataaacgcaaaactgactttgtggaacatcaagatagtatctagccgactctcaaaagggatagatagccaaggatc

SEQ ID NO: 14824 - DNA, 525 bp, Diabrotica virgifera
gtctagtgagcagtgatcaaccacaaaatataacatgtgtgacgacgatgttgcggttcttgtctttcacaagggaaaccgacagaaccagaacaatcgttttcctcaaactattaaatctctaacaaggaaccaaaaactaacattataccaaacaggaatctctccagaaacttatccttcttttgattcattactattactcaatcaaattcttagaaatcgagataatacccctgccacaagcaatacatcatacatatctgacgcaactcctagaaaaaaacccctattgatagaacgagcgattctataaacaatcactctgcatacagtcctcctcgagcccacaaaaaccaccgagaacactttaccaacaaaagatagatgctaaacctctcctggttatcgcacagccatttgcgatggaagtgaggtggatcgactaacttcctgatttgaaacccatctagaaccattctcaacctcgataattaacctgcgacaacctaaatcgacttactg

SEQ ID NO: 14825 - DNA, 220 bp, Diabrotica virgifera
cgatttaggttcacgtgtagtggtacccttttatgtgagaagtagtatggcttattgtgaataatggtgcgcaaggatgtgagtatcagaccataaggattattcagcatccatatactgaacatttatgggtgactgtgagctattggaagactaatccaccacatagggtgaccccgacacgactaccaagagagagttacaatacatcggcctcaac

SEQ ID NO: 14826 - DNA, 399 bp, Diabrotica virgifera
ctaaaaaatttataattttcagggtttctcgctctgatatattttgaaatgtttttctattaaaaatttggtacagtgtttgttttagatttttttaccatgttacagaatactagtaaagttagaaatctgagtgtctacagtacaaggttgaagactttccaaactatctaatcattactttgctataatgtctactagactatataaaacctagaaacaggaataatacgtctgcgcttcatgcctttcataatggtaccagcttataacctccaacagcggacatctctgcctacagcatacaatgacgccccactgaataattgcgacccatggcgaaagcgccacgtgccgaaagcctcattatctcattcgtatataacatttagacctata

SEQ ID NO: 14827 - DNA, 425 bp, Diabrotica virgifera
  misc_feature (11)..(48): n is a, c, g, or t
  misc_feature (52)..(68): n is a, c, g, or t
  misc_feature (70)..(117): n is a, c, g, or t
  misc_feature (129)..(149): n is a, c, g, or t
gtaaaatcacnnnnnnnnnnnnnnnnnnnnnnnnnnnnnnnnnnnnnntgcnnnnnnnnnnnnnnnnngnnnnnnnnnnnnnnnnnnnnnnnnnnnnnnnnnnnnnnnnnnnnnnnncactacttttannnnnnnnnnnnnnnnnnnnnctatatgacacgatacacaaagcctggtactatacatccaaatcttcaacaacacaatatcattaatctatcactcttctatttcaaagacaatgttttcttctcaacctactaaattacttccgaacttgatacatcgacaatataaatcactctctacataacacaaagattgaagaatatgcagaactgtcgtactactgcacaagcccacaaccatatgcaatcacttgccatatctaagttagttataccattcgcacccaggttgtccac

SEQ ID NO: 14828 - DNA, 912 bp, Diabrotica virgifera
  misc_feature (757)..(779): n is a, c, g, or t
  misc_feature (811)..(830): n is a, c, g, or t
ttgatattattttgattattgttcaagttttaatgagttggatttaatttgattaagtattgagtatacctatctaatagtcttcctataatatatccaaatgataaggtgaggaaaagcataaaaacggtatacatagttcacaatacataaaaagagtcccaagccgaagttcaaagtgaagcaaaggcatctatctgtttactattcctgcttcttttaagcattaaactgtgttagttatattatatagtatttggttatatcatacttaaaatcaaattaatatggaaataaatcaagaagctagtgaggaaacttgtaaaataaaggtagaggacacatgtgttggtagttcctttgatgtctgcaaaattgaaattaatgaagaacccaagagagaacctgtatatgatgcatttattgattatttagactcgaatgaattttccatagacactaaagtagaacaagatgaatataaattttcactggttgaagaaaagcaaacaacaaatgaagaaagtttctcccagaagaaattcttagaaatggaatatatagaaacattacctgacctttcatgcaataaagaacaacaaattagtccaaactctcgaaaaacaacattaaacaattattattctataatttgttttaaacattgctctcaaaaaaataattcaaataagcatacagaaattcatactgaaaaacgactttacaagtgtgtaatttgttttaagcagttttctcnnnnnnnnnnnnnnnnnnnnnnnatgagagtgcacattggagaaagattttaccnnnnnnnnnnnnnnnnnnnnaggtttcctattctcattaggtaatatgaacaacatatgagagtgacactggagaaagcctcacacgtgtgaaatttgtttt

SEQ ID NO: 14829 - DNA, 186 bp, Diabrotica virgifera
  misc_feature (2)..(14): n is a, c, g, or t
  misc_feature (67)..(100): n is a, c, g, or t
gnnnnnnnnnnnnnattatccaaaaacccaattattaaataaataagttacacttagttttttaacnnnnnnnnnnnnnnnnnnnnnnnnnnnnnnnnnngctactacctatgttaatggcttacttttgcacgacaagatactctatatattaaagttcttgtctaaaaatacttcttatccact

SEQ ID NO: 14830 - DNA, 737 bp, Diabrotica virgifera
  misc_feature (50)..(74): n is a, c, g, or t
ggtgcatggcgattacaagtactctaccatattcttttgagaaaagattnnnnnnnnnnnnnnnnnnnnnnnnncgctgatcccgatgcctttatgaaggatttcctcgttggaggcagtaccgccgccgaaacgaagaacatgagaaagaaaaagagagatagatcataagctaataattttgtatcgaattatagacaaagatattgacaagtaaggtatatagcacaggaacatatactgaggaaatgcgtagataagaagactctaaaactctgcaacgaaccagaaaatatttacataggaatggattacatatataatattttctataatatacttctcatgctcatacttaataaatcagcctatattttggagaagtaatacgattagatgaaagatattgtcaaaaatacttcttattaactccaatagatggaatcttcagtgacaactgataacagataaaagacccgtatcatacgatagatcactgaacacatatcttcacgagccgtttgtggctactgagtattgagaaaccaacagagaataccgaaagagaatgtatagagcactgatctgattgcgatcgtacagtcatgtagtagcaccctgccgaaaagatgaggagtagaaattatagcgtaagtattaaaaagagtcgttaaactctcacatgtttgactccgaattacctacctcaggacaattaacatcagcaccagtttctg

SEQ ID NO: 14831 - DNA, 557 bp, Diabrotica virgifera
  misc_feature (384)..(407): n is a, c, g, or t
gattttttgatacaaaaattaagagtgatttattagacaatagatctataagtaaaaacatatgaattgttaaaaccacatctttaagaggatggacgtgacgatcaactcttctctttccatcaaggcgatcagaaccgcattctaaaaggcgtgatgcgtgtaggacatcttgctaaaggacgtctccttcaaggcgatacaaatgttgaattggtgatactatgtgctgataagcccaccctcactcttctcaagaaagtcgacgaaatccttccgtcagctctgaagcaagtggtcccagagagcgcctacaccgtgaccatcaacgcttccgaggcaggcttgatcatcgctggagacagtttgacggtgttggtacannnnnnnnnnnnnnnnnnnnnnnnacaaccagaagctgcaggcgcggggttcgaaccgtgatgggctgtcacgcgtcaagtgtctccaggcgctggcagccctctgacataccaaaatggttccaggcagagggtcttggactgcattcctgtgtcatcatcattccgatactg

SEQ ID NO: 14832 - DNA, 863 bp, Diabrotica virgifera
  misc_feature (23)..(853): n is a, c, g, or t
aaaatttattttttcgtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataatttt

SEQ ID NO: 14833 - DNA, 457 bp, Diabrotica virgifera
  misc_feature (332)..(349): n is a, c, g, or t
cctctcctttctctcctacattttaatctatctataataaacattcaattaaaaaactttctctaatttatcccaaaaacataaatctacaaaacatccaacacatcatttcccatacacacaatacactcaaatatgtatcacatcaaaaaaattactttaataataaacctccataattaaaaccatattttttttcacaaccacaacaaaaacataatatacatcacaatcaactcttctctttccaacaaaaatatcaaaaccacattctaaaaaccattattcaataactacatctttctaaaaatcttctccttcaactccatacnnnnnnnnnnnnnnnnnnactatatactaataaacccaccctcactcttctcaaaaatatctacaaaatacttccatcaactctaaaacaatatttcccaaaaaactcctacaccaataccatcaa

SEQ ID NO: 14834 - DNA, 626 bp, Diabrotica virgifera
  misc_feature (168)..(193): n is a, c, g, or t
acttggagaaactaacatcggtggcaacccttttgtagtaacagaagatcttcatgatatttcatatgaaaaacgagcgctaaattatcccacgatcggtctgcaaaacaaacagatacatatgaacacgaaatgagaaaggacatgtgaacagctgtcctcctgttnnnnnnnnnnnnnnnnnnnnnnnnnnagagaggactccagaagctcatctgcaaaaaatgaaagaaaaatgtccgaattattgaataagaaattcaacaccactctccctctagacgttaactatatgggcgaagaagataagggaaaatgtcctgacttgagataaaagttgacgatatttccgttaaaagtgaaaaatgcgtcgacgatgacgatgttgaatcagaaactttttggtctctcgagcagagcaagatggctagatgtttcataccagacatcgatctaattgcctcctgtttaccagaggaatccaaagagcttcctgtattggtttcccggatagggacaaaattaagaggctctcacagtaagtttctgagaaggatgtttaggaaacaaaagcattcacgagtcatatcaattcttatggttataattaatggttttattaataa

SEQ ID NO: 14835 - DNA, 728 bp, Diabrotica virgifera
  misc_feature (8)..(665): n is a, c, g, or t
  misc_feature (667)..(687): n is a, c, g, or t
  misc_feature (690)..(706): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnngcnnnnnnnnnnnnnnnnncgagagaccctatagagtttat

SEQ ID NO: 14836 - DNA, 742 bp, Diabrotica virgifera
  misc_feature (41)..(59): n is a, c, g, or t
  misc_feature (61)..(74): n is a, c, g, or t
  misc_feature (83)..(117): n is a, c, g, or t
  misc_feature (119)..(168): n is a, c, g, or t
  misc_feature (170)..(219): n is a, c, g, or t
  misc_feature (247)..(278): n is a, c, g, or t
  misc_feature (280)..(325): n is a, c, g, or t
  misc_feature (327)..(345): n is a, c, g, or t
  misc_feature (347)..(372): n is a, c, g, or t
  misc_feature (374)..(387): n is a, c, g, or t
  misc_feature (396)..(425): n is a, c, g, or t
  misc_feature (436)..(454): n is a, c, g, or t
  misc_feature (460)..(475): n is a, c, g, or t
  misc_feature (477)..(534): n is a, c, g, or t
  misc_feature (634)..(655): n is a, c, g, or t
tgataatactaatattatcatcattactaaattatttaagnnnnnnnnnnnnnnnnnnncnnnnnnnnnnnnnnttactaagnnnnnnnnnnnnnnnnnnnnnnnnnnnnnnnnnnncnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnntccgccgcattttgaccgcgctaaggannnnnnnnnnnnnnnnnnnnnnnnnnnnnnnnannnnnnnnnnnnnnnnnnnnnnnnnnnnnnnnnnnnnnnnnnnnnngnnnnnnnnnnnnnnnnnnncnnnnnnnnnnnnnnnnnnnnnnnnnnannnnnnnnnnnnnnatttatacnnnnnnnnnnnnnnnnnnnnnnnnnnnnnngtatttatacnnnnnnnnnnnnnnnnnnnccagannnnnnnnnnnnnnnngnnnnnnnnnnnnnnnnnnnnnnnnnnnnnnnnnnnnnnnnnnnnnnnnnnnnnnnnnncaataaattaccttaccgatagcagcgtaattttattgaagagctcatatcgataataaagattgcgacctcgatgctgtattaaagtttataattgacnnnnnnnnnnnnnnnnnnnnnntgttcgacttttacaattttacatgatctgagtttaatacgcagtggaacaggatgcgttctatctttacttcattgatatctttta

SEQ ID NO: 14837 - DNA, 315 bp, Diabrotica virgifera
  misc_feature (85)..(103): n is a, c, g, or t
aatattattttgttgctgtgtttaataccttttgtgaaagaaaatgtcactctatgaaccttgcgtgtcgtacgtgattaggtcnnnnnnnnnnnnnnnnnnnctccgaatttataacatctcgaaagttaacgccataattgcgaactaaaaagtcgaaataacctgtttggcaggatgtggtttttgtctctaggtatctctagtctataaagaaacaactcacctacattaattaggcaaaggtttatcatcgacatatttggctatcagtcgtataaaatatctgtaggggcgagcatattccttgtatct

SEQ ID NO: 14838 - DNA, 805 bp, Diabrotica virgifera
  misc_feature (18)..(37): n is a, c, g, or t
  misc_feature (191)..(213): n is a, c, g, or t
ccttaagcgtccggaacnnnnnnnnnnnnnnnnnnnnttccctttaaacgcgaggaggttatttaagagctttagaatatgtgagagttagtagagaactcatacaaaaaagtacaccgtatactggtgatcggatagggaaatgcccacaatgaacccgaaactgcaagcagatagaaataggagtttgnnnnnnnnnnnnnnnnnnnnnnnttagaacagctacaaacctatctggtagacgtgatttggcagcttcaatattgtcggctctgactagcaatggcactgacgatgcgcaaccgtcttgtgattcttctatatgtgtgttgacctacagactgagaacctgacgtacacctctaagcaagaaagaggatgacgatccccactatttgcccaccactcaggttaggcgaaatatataaacatttgatattgatttgggagtcctaatgacggtatggatcttattgattatcctttcttatggtctagcggaacaattagaggaaaaccgacacatgtcctcccattcttatgcctacaacttgttcaaatttggcattacaggtctaagcgaaactgcatacttttgctcctcggagatcagctcatcgcctaatcgcagaaaactggaaacttcctctgcggcaagaacttctccagtcgatcctgcacgttttgacgctcatagaggaatgtggccttcttatttttcaatgttacggaaggtatattggatctagtgtaagttcggagatgctacaagtcgttatcccttccgcaacatattaaaccgaaa

SEQ ID NO: 14839 - DNA, 196 bp, Diabrotica virgifera
  misc_feature (2)..(54): n is a, c, g, or t
  misc_feature (56)..(71): n is a, c, g, or t
  misc_feature (74)..(90): n is a, c, g, or t
gnnnnnnnnnnnnnnnnnnnnnnnnnnnnnnnnnnnnnnnnnnnnnnnnnnnnncnnnnnnnnnnnnnnnnatnnnnnnnnnnnnnnnnncttattagaaacatgcctttttgtattatatataaagactcgtctgcccgctgaataatttgaatgcttcgcggtatgttgaccgtggtaaggtactgtaatcatc

SEQ ID NO: 14840 - DNA, 611 bp, Diabrotica virgifera
  misc_feature (37)..(52): n is a, c, g, or t
  misc_feature (55)..(87): n is a, c, g, or t
  misc_feature (209)..(226): n is a, c, g, or t
  misc_feature (253)..(352): n is a, c, g, or t
  misc_feature (355)..(379): n is a, c, g, or t
  misc_feature (388)..(432): n is a, c, g, or t
  misc_feature (435)..(452): n is a, c, g, or t
  misc_feature (459)..(481): n is a, c, g, or t
  misc_feature (483)..(509): n is a, c, g, or t
  misc_feature (584)..(604): n is a, c, g, or t
cggtgcgcggtctgttaacagccgattacaagtactnnnnnnnnnnnnnnnnagnnnnnnnnnnnnnnnnnnnnnnnnnnnnnnnnncgctgatcccgttgcctttatgaaggatttcctcgctggaggaatttccgccgctatttcaaaaacaagtgtatatccactcgaacgtgaaaagtagaatattaaaatttttcttgtttacnnnnnnnnnnnnnnnnnncttttgtaaggaaatgtgatacgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnnnncaaattaannnnnnnnnnnnnnnnnnnnnnnnnnnnnnnnnnnnnnnnnnnnntgnnnnnnnnnnnnnnnnnngattatnnnnnnnnnnnnnnnnnnnnnnncnnnnnnnnnnnnnnnnnnnnnnnnnnnatactgaggaatgaggcgtattttaatattaagaaattgtaaattgtatgatacagaaatgaggtagagtaccgnnnnnnnnnnnnnnnnnnnnncagttgt

SEQ ID NO: 14841 - DNA, 414 bp, Diabrotica virgifera
cgctatagatgcatacttatgtagagctagaagctgctttagaagaatgtaaagctaacttaagacaattagaggaaaatgtcaataaagagatacctaaacaaggatctgctgaactgccaaccagcagcaagaaaatcgccaagatgatggaatgttgattacaccagtaccgaatggatataacatcttcattcctctcgtatacaaaatacacccacctccacctctgtcacgaagttttctacgctcccatacatgtctacattcttaaccaatcactcctgagctataattatcatcacactccgaatgttacatatatacatattaaatatgaacttgaccgaccaatcgccatgacatataaacgatcatcactataatattgataacaaatcactaccatataaa

SEQ ID NO: 14842 - DNA, 642 bp, Diabrotica virgifera
aaaaggattagcacactatctgcggactttgcatgtctatattgttgatatttgcaatcatgggattcgattccagccataaaattgctgaagattaactctacaatccaagtttaccctagcgtgcacggatgcgcccattccagttcacacacgtcctataaggacgaaggaaacatcataaaccctaaacgagaacccaatttatcggaagacattttagccaaaatgtagcaaagacatgatacttctccctttaaagtataaaatcgaatgcaatgctcgaacaaacggaataatatctatctatatgacatactacctgcgatagaatacttctcacactagaacagagtctgccgcgattaattatgacaagatgtatagctacacatcaatatctgagaacaaagagaattattgtgcataggctatgctcttgaatgaatgttgtatcattattgttatggtattaaggatatcttgtgagaaggtataatctatgacagtccattatgagtgttgggtaattaattagctgaccatatcgaatccttagtgaacatcagttgccacaaataaagtgtatctgcttatgtcttaacaagtatatattgcggcgttatttgctatttttgataa

SEQ ID NO: 14843 - DNA, 564 bp, Diabrotica virgifera
gcgtcctttttaaggccggggggaccgcgagaccggagggacacccccttttgagagacaccaaagcaaagccgaaacccaaacagacgcacatacagaaaaaccaaacaaacaacaaggggaaagaaaagacccaaagaagcaacgggcgagcaacgaacacgaaaaaacgaggaaagcgacgacaaccggacataaaaatgacagatgtgttgttatcgacgatggaaatatttttacgagagattataaagccttcctcatatctggacatcaacacaaactctttggtgacatttgcggagttttgaagaagtgacaacccaattcatacctatatggtttattaaagacactttcgtcagtcgtcaatagagagtgcatgctattcagtgaataaactaacgaaggcctcagtggtgataaatgttttaagactgcaccatgatgttatgattttatttgctgcattttgccgatactgaatcatggttccaatcaatccatacattctgacataagatattgcttaataaattatgaccttgtgcattggagaaaaat

SEQ ID NO: 14844 - DNA, 51 bp, Diabrotica virgifera; identical to SEQ ID NO: 9123
  misc_feature (2)..(44): n is a, c, g, or t

SEQ ID NO: 14845 - DNA, 970 bp, Diabrotica virgifera
  misc_feature (14)..(804): n is a, c, g, or t
  misc_feature (807)..(963): n is a, c, g, or t
agttctatttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaattt

SEQ ID NO: 14846 - DNA, 408 bp, Diabrotica virgifera
  misc_feature (32)..(47): n is a, c, g, or t
  misc_feature (50)..(82): n is a, c, g, or t
cattacgcgtccgcagccgattacaagtactnnnnnnnnnnnnnnnnagnnnnnnnnnnnnnnnnnnnnnnnnnnnnnnnnncgctgatcccgttgcctttatgaatagtttctatcgctgaaagtaaatttagagaacttgaggctctggaacgaatgacatatcaaaataatccctaaattcagaacgtttccagttgttcactttttattattatatccctctaaatgtatataatgttcgataaaagaatgtatatgcaaaggcacgaaaatctaatttactcaagacatagttttcggtaattatgatcaatttatataaaactaacatatggaatagataacaatgaaatacgatatttggaaggcggatttctgaaataagattgttaatgatagaaattt

SEQ ID NO: 14847 - DNA, 615 bp, Diabrotica virgifera
attgaaatcggcggtagtgttcaaaaagaaacgtgttcacttcgggattatctaaaattacagttgtatataatttttctgtgaactgttgttttatcagttgatatgtggaaaatgtttatagacagttaggtgacgttgcagatatctctttgaaacaatggatcctatttggagtgattttgtttgtactatcaaaattaaaatacaagaaagtgtgcgaaatcatcattgatcttaattctggagaaattgaatacattaataaggatgtagacaatattgatgtccttttataaagtaatttcgttaacatcatactaagtgctacgaaattaaatgactgatatgtacatattgtgttatgttgatagagtagcattagaaacagatttgccagacaatggagaaattcttgaagatgatgttcttgttttcattgttgatctaaaatcaattagtgatagctgtattcgaagtcgaataggatgagttttaatcacgtgcaacattgttctaagagagattccacatttacatgcccatgcatttagctctgatattaacatatcctatgatcgttgattaccgagccatatcctactgccatgttta

SEQ ID NO: 14848 - DNA, 492 bp, Diabrotica virgifera
  misc_feature (201)..(227): n is a, c, g, or t
attacgaagtgttctggttagtgaccgccttgtataatgccagggttgcagatcgggtggggatgtaggtcctgagacgacggatagtataccgactaagcgaattagcgcaatcagtgcaccatgcaccacaagcaaaaaatggttaataaggagatataaatgtacccccccacaatatcggggttagtgttgtttttnnnnnnnnnnnnnnnnnnnnnnnnnnnggtagtttcttgtagtcgattagcgctatttgacatattacaacatgattagtcaatgaatgttagattacgaagtgtacgacgcaaccactgcagcatgaaataataatagatgaagtaatatgcagtgcgaggcgatgtctagcacttaagttataatactttccgacctactagttagaaagaggttattagtttttaagattgtcggatatgatatggagagattttcccaatactttatattagaattttacttaaatca

SEQ ID NO: 14849 - DNA, 170 bp, Diabrotica virgifera
  misc_feature (7)..(44): n is a, c, g, or t
taacagnnnnnnnnnnnnnnnnnnnnnnnnnnnnnnnnnnnnnntgcgacctcgatgttgaattaaagtctataattgctgaaacaggtatatcattaagtctgttcgacttttagaagtttatttgatctgaggggaaactggagtggagcacgttagtgttcaaatca

SEQ ID NO: 14850 - DNA, 762 bp, Diabrotica virgifera
  misc_feature (388)..(405): n is a, c, g, or t
tacgaatactgaacccaactatttgtaccttaaacatccgataggaagatccataaacacttctgaaactagtttttgaaattcccatgttttcgtattcacaaaaatgatttatgagaccggaacaacgtcgaactccaaatctacagtgttttttaattctccatcaaaagagagagctatcaagaaatgttcgttttcctgtaagagattgtgtaatattgcacatccatgacgaacgacactgtacgaatgatataccgaaatggaaacctatattctttccttatattgatattttctgaatttatggttatattatgctatgattggtttgtgaatgtacttatggttacattaactactatatattacagtatataatatnnnnnnnnnnnnnnnnnnatcctattcaccactcctcttctattagagtgaacttcctctcttacatttcattccgacgtctctttgctgatagactttatccttgatcctagatggtctccctcgaattcaaatttctggggcggtccattcaaatacttctttgttaattctcctttcatgcattcgcctaactcgtccataccgaactatatgctcgactctctagtgcgtctatgactactctttctatgtccatacgctgtcgaatgccaacttatcctacgtgcactacatcccactttcttcgctagcttctccaaaaatccatctcaacggatagcccttcatctcagtacttgatgctgaatggcc

SEQ ID NO: 14851 - DNA, 777 bp, Diabrotica virgifera
  misc_feature (16)..(42): n is a, c, g, or t
  misc_feature (45)..(77): n is a, c, g, or t
  misc_feature (79)..(93): n is a, c, g, or t
  misc_feature (96)..(108): n is a, c, g, or t
  misc_feature (195)..(230): n is a, c, g, or t
tcatttaagcgtccgnnnnnnnnnnnnnnnnnnnnnnnnnnnccnnnnnnnnnnnnnnnnnnnnnnnnnnnnnnnnncnnnnnnnnnnnnnnntannnnnnnnnnnnntagttattttctgtgatggagaatttcgaatacaagaaaattaaaagactaatataaacttcctcctctaactaaaaaactagaaannnnnnnnnnnnnnnnnnnnnnnnnnnnnnnnnnnncaaaccgaaagtaaagccttttactattagcgtatcagaatgaggtactcaaagatcttttatattttcttcaccaccaccgaactttcactcctcctctcgaaggaatcgtccacgaaaatagcatcaactctaatctagccaagaccatagacaaatattggagaaaaaaatataactggatagaaagctagatgcacttgaatcaatatccacagttcacagtcaatatccagggcttatacttgaactacattcacattaaacccaaagtttcttatgatatcaaaatgctgtctcttttaattttacatgtgtagttcagtatccgttaaagtattttctatgaattattttcgtttgttaataacaccacaaaaggcaagaaattttgtttttgaaagtatagatccacatattccaggtttttggttttccaaaccagcattgagaccaggtctcaacccgaacaaaatagccttgcgatttaagaacatgaagcatcaattaggattcaaaaattccatgttcaaggcggtgattttgg

SEQ ID NO: 14852 - DNA, 51 bp, Diabrotica virgifera; identical to SEQ ID NO: 9123
  misc_feature (2)..(44): n is a, c, g, or t

SEQ ID NO: 14853 - DNA, 199 bp, Diabrotica virgifera
  misc_feature (6)..(45): n is a, c, g, or t
  misc_feature (47)..(59): n is a, c, g, or t
  misc_feature (95)..(119): n is a, c, g, or t
gtccannnnnnnnnnnnnnnnnnnnnnnnnnnnnnnnnnnnnnnncnnnnnnnnnnnnnggagagaaaaatgtgaggaaaggaagagggagagcnnnnnnnnnnnnnnnnnnnnnnnnntttgcgatggggaatgcagaatagaagaagataaaaggggaaaaggaagcatagacgtggaactaaaaaactaggaaaag

SEQ ID NO: 14854 - DNA, 587 bp, Diabrotica virgifera
  misc_feature (3)..(31): n is a, c, g, or t
ccnnnnnnnnnnnnnnnnnnnnnnnnnnnnngactaaacacccccttttataagcagccgatatcaaggcgcaagtcaactcagaaactgtaaggcataattgcacatctaattaacctccgcgtctgaagccacctacataccatcgagaagatcgaaaaaaaagaccgcccaacgggcaaccggtccttcggaattgcctctttactccacaacctgccaaccgagaagcggcaagacatcttcatatccaatgcttcagtggacagtatcgttcaaataaaactatgaacccaactgtcacgcccctgtctacaatgattctgtctcccgcatagtcactgcaccatcactaacggactgctatcgccatcaagaggtccgtagagcgtggtaaacaagaagcaaacatgttaaacaacggacaaattcgctgaccatggtgatgccacttacacccttaatctgatatcgcttctggatactgtcttcggaatgaaattgaatgcgacgcagtaccgaacaacaacgcgtcaaagtacctcgtccatttagatgctgctacctaagctatgaatttgcattcc

SEQ ID NO: 14855 - DNA, 157 bp, Diabrotica virgifera
  misc_feature (3)..(24): n is a, c, g, or t
  misc_feature (26)..(39): n is a, c, g, or t
  misc_feature (44)..(92): n is a, c, g, or t
ccnnnnnnnnnnnnnnnnnnnnnncnnnnnnnnnnnnnnttacnnnnnnnnnnnnnnnnnnnnnnnnnnnnnnnnnnnnnnnnnnnnnnnnnggaggcgagtgaggacacagagaaaggaggactggcagaagccggcgccttttgttttttttttt

SEQ ID NO: 14856 - DNA, 657 bp, Diabrotica virgifera
  misc_feature (416)..(430): n is a, c, g, or t
  misc_feature (544)..(563): n is a, c, g, or t
caccatgtctttattttctaacataaggtaaaatacaataatagtaggtatgctcatataataacacatctgaaataaattagaaaaataagccacaacataatctcacagaaaaatatagactacgagctatccactaatttagccagtacaattatacacgtctcatagcattaattattttatgtatattatcatacactaattaggtgtttgcgacaaaaatctccaagtttttttaacctaataatttgcttttgttagtcgtttttgttctccacagatttgtcgacaacaattatatgaatactatatacttagtttataagtaggtacatggatgagaaaggagcattggagcacgttgattcagcgaaatgtgtcaccattagtcgtattttttctgcctaaacctnnnnnnnnnnnnnnnctgtgtgaactcctgcagccatttattatgttgttcttatctctacttgtttcttgatttgctaattattttgtttgtcgttgtttaaatcatcaacttttaaaaagtgaactnnnnnnnnnnnnnnnnnnnncaaaaacatgaacattgtatgcagtatttttcaaaggctacctgaattgacaggtatactataacaatgaataaagtttacaagatcctttatc

SEQ ID NO: 14857 - DNA, 261 bp, Diabrotica virgifera
gtatatccaattttttacgatgtagatgaagtttattacataagaatatatagataaatggacaagagcagaaaaaagcgatgagatagatttaagtagcctacgaaacatcccactcttataatagatcatcttgtaataaaacgttatccaaggagtatggatgcctcgacatattgagatgcctgtgtgacgctgatgattttgttgagaacttttccttcgttagaatatggacccatagagcgatctgctttatgt

SEQ ID NO: 14858 - DNA, 826 bp, Diabrotica virgifera
  misc_feature (752)..(752): n is a, c, g, or t
gcagtggttagtgcagttttgtgatttaagaagattacgatggttactaccacgaatgcggtcactagtactagcatgattcaaggaaatagtacgacgcctacatctaacacccctggcacaggcgagaataataatggtgttaagagaattagtgataatagaaggagtaacaagcctattatggagaaaaggcggagggcgaggataaataactgtctcaatgagttgaaaacgctcatattggacgccatgaaaaaagatcctgccagacattcaaagctggaaaaagctgacatcctggagatgacagtcaagcatttacagaaccttcaaagacagcaagtcgctatgtcagcggcagcagatcccttagtagttaataaattcagagcagggtttagcgagtgcgcttcagaagtcggcagatttccaggtctagatccaatcgtccgacgaaggttactccagcatctagccaactgtctcagccaaggttccaaaccacaagaagttcctcaagtacaagttcacatacttccaaacactcaaaaacctttagaacagcaagtaccccaaagcagtggcattattcttagtaacggtaacggtactggagttcaactagtaccaacaagactaccgaatggagatttagctctggtacttcctacgaccttacaaacacagccccagtattcaccggcggcagtaccattattagtgccgatagtaccggaaagaaccgcttncaccacatcagcgaccagcagttactcgaattatttctccagtcatagtccagagcctatggagtctatgtaca

SEQ ID NO: 14859 - DNA, 499 bp, Diabrotica virgifera
  misc_feature (182)..(208): n is a, c, g, or t
atttaattggggagattaaagatttcccttataaaacgaaagttatatttagattatagtaatgttgaattagaggttgatgtaaaagttttaatcaaaaaaccgaaaaaattaatatgttctaagaaagtggaatttagcgggagaaaaaggatcatcccaagtgagaacattcaagttcnnnnnnnnnnnnnnnnnnnnnnnnnnntggcacgcgcgtccatatgtaatcaacactattggaaatcaatctgcttggctagctgcttgatccgtatctgtttcttctgcttttgtgtgacagactatgcataacctcccaaggaaagctcaccgcacccgttactgctgaaaatctaacgcattgtatcgttttcggatgcgaccttccccatctgcaagatgcatgaagtttatgtcagaagaatggaattgctacaggagtcccttcatggcagctaacagctctgccaaccttattctcttgcaccatgtgaac

SEQ ID NO: 14860 - DNA, 925 bp, Diabrotica virgifera
  misc_feature (890)..(890): n is a, c, g, or t
ggggaaccaaaaagtagtgtgagtgttgacctatcaaactatcttcagtttaagctctagctagggtgttatcgtgtcaacatgacttccagctctccaaatcgtaccttcttgtatatagccgcatgtgcagctaatattgcggcttttgtctgcggaactggttttggatggacttcaccagaacttcccaaacttaaagacaatactacaagtccattagatcacgaactaacagatactcaggaaggatggattggttcgtttttaccactagcagcagccattggaccgatcggaggaggggttttagctgatataatcggaaggaagaagacgttattacttggaacgttaccgtttatagtagcatacattttaaatatatttgcgaaatccgtattcatcttctatattggacggttcctttctggaattggagtggggataatatttacagtgttgcccatgtacattggagaaatatcagatgatgatgtaagaggatcccttgggtctttcatgcaatttttcatagtgatagggctactattttcatatgccattggaccattcgtaagcattgcaacatttaatattatcttggtaattcctcctgttctcttcatgataatattcttgatatttataccagatagtccttgctatcttcttcaaactaaaaacaccaaagatgcactagaagcgttgattagattaagaggaagagaaatatcgtttgttcaaaaagagatggaggttatgaaagtacaggtagaaaaagagcagcgagataaaggaaacttttttgatatcttcaaatgtaaaggacttagaactgcattattttattctggtggggtttggtggcatttcaacaattatctggnaataatatcatcttattctattcacaaaatctttt

SEQ ID NO: 14861 - DNA, 500 bp, Diabrotica virgifera
  misc_feature (23)..(41): n is a, c, g, or t
cgtgagagtgttttgcaacaaannnnnnnnnnnnnnnnnnncgtttttgtctcatgtaccggatagatcgccggctatacgatattttcacactatgacaacgttttttattcctgggccccatgagcatcagggaccatgaataagtaaataccggcccatcatcttctactgtagatgtgattaataagtgtgatgttcaccgcaaaagaaccatcttaaacaacctcctcgaagtgcgaggatatgccaaagtatcaatctctattcccttgaataaacaaataaccatttatttattacagatagatttataatcacttattttcatattagcaaacttaaacatttacaggcgcgagattaaaaattgcagtccctgaccatttacatttcaaaaataaactcgggactgaaacttccctatttcacagtacggtactaattattgtaacatattatgatgtttatcaagcacaaatttctaacaacgcaccaaa

SEQ ID NO: 14862 - DNA, 569 bp, Diabrotica virgifera
gaagcagattttcgtaaaaagatttgagctgaagccattaaaacagctgcagactaaagaaatataggcagcgtgcagaggtcttaaaggcagaaacacgtataaactattctataaaaaaaagcaaatgtgaatcatgttcaaattttatagaattgagacaatggtgcacgtaatcaaagaaaaaagacagaagatgtgacataaaactagagaaagatggacttgggtggttatgaacaaaaggataagggctataagctctatgatgcaattaatacgaaggtaaataccagtaaagaagagggcattaaggaaaaatccaaaactgcttaaaaaaatttgattttttaaaatctaccaagcaatgagattgcattgacagagggattacctccaagtggtggactcagaccaagatatactctcagatgaggaagaaaaccatacaattatggatgacgacctcagagatgactcaatgacccagagtatgttccagataaagtgatcacccataactaccaatatatcaagaagatccgagacaacgaagaaggccaaggtct

SEQ ID NO: 14863 - DNA, 568 bp, Diabrotica virgifera
  misc_feature (21)..(43): n is a, c, g, or t
  misc_feature (75)..(104): n is a, c, g, or t
  misc_feature (151)..(168): n is a, c, g, or t
  misc_feature (195)..(216): n is a, c, g, or t
  misc_feature (221)..(292): n is a, c, g, or t
  misc_feature (308)..(341): n is a, c, g, or t
  misc_feature (347)..(371): n is a, c, g, or t
  misc_feature (385)..(461): n is a, c, g, or t
  misc_feature (482)..(505): n is a, c, g, or t
attagtattgagaaatatgannnnnnnnnnnnnnnnnnnnnnntaatcctttatattttgtatattgaggattannnnnnnnnnnnnnnnnnnnnnnnnnnnnngattttaaaagatataaaagataaagaattatattgtatattaaagnnnnnnnnnnnnnnnnnngtaatgagaagtgattcggtattagannnnnnnnnnnnnnnnnnnnnntaagnnnnnnnnnnnnnnnnnnnnnnnnnnnnnnnnnnnnnnnnnnnnnnnnnnnnnnnnnnnnnnnnnnnnnnnngatgaggttatgagcnnnnnnnnnnnnnnnnnnnnnnnnnnnnnnnnnngaaagnnnnnnnnnnnnnnnnnnnnnnnnnatgaaaatatgtannnnnnnnnnnnnnnnnnnnnnnnnnnnnnnnnnnnnnnnnnnnnnnnnnnnnnnnnnnnnnnnnnnnnnnnnnnnngaagataatatgagaattatnnnnnnnnnnnnnnnnnnnnnnnngataaattaaatagaggaagtagaggaaatttgtttcatttgtttattaagatcatgacaatt

SEQ ID NO: 14864 - DNA, 225 bp, Diabrotica virgifera
ataataaaggaatgcggcaacatttttttcaactggtttattaaaacgagtgtttatgttgcctacagtgaggcgcaccgacacaccgatagatcgagtgtgcgaacagaacaatataccctacagaagttatggaatccatatatattagtgtcgaagcggaaattttaaaaggaaccaaggatgatccagatacgatgaacgcaccgtaaccgacagatatat

SEQ ID NO: 14865 - DNA, 830 bp, Diabrotica virgifera
  misc_feature (48)..(68): n is a, c, g, or t
  misc_feature (85)..(109): n is a, c, g, or t
  misc_feature (265)..(285): n is a, c, g, or t
cctccttcacgcgtccgtctttatataataagacagtttttagtcctnnnnnnnnnnnnnnnnnnnnnatgataggtaatgagannnnnnnnnnnnnnnnnnnnnnnnntacaagaaacttttctctttagtggctgggaaagcgtgataccgctggcatggattcaggcgcatatcgcaaggacggaacaacttctctgtgtctgtatcagttgcgtgctctgacaggacttctgcttcttgcacgtcaggatcctctcgagannnnnnnnnnnnnnnnnnnnnacccaacaccttacacagtacttatgtcaggaggacctgccgtaggaaaatcatcattagtactacagccaatgacctcggaacatcccacatcgccatgacactagaattgatgatgagagcgctgagaagtctgcatccagttctgctagccggcgaggcacccgaaccttgctttatagactttgccacagcggacttgccgcctgcatagttgtataaacaaatatactgtcacccatgccttctgcgtggtgtaccagagcgccgatagatccgaggctcgagacagcccaaaacaccctacagaattcatggacctcacactacactagcccccacccgctaattttactccgcaaacaaggctgcatcaacaccatcaacgggtaataaacccccgaacaggtcgaacctccggccccgccgcacgcctggcacgccatatagacatctgtcggtatctcccctcactgccgactaactagtggccgggatcccctcgcagctccggctgaagttccaaaacccccgaaagaagccgg

SEQ ID NO: 14866 - DNA, 298 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (240)..(293): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattnnnnnnnnnnnnnnnnnnnnnnnnnnnnnnnnnnnnnnnnnnnnnnnnnnnnnnttggg

SEQ ID NO: 14867 - DNA, 650 bp, Diabrotica virgifera
aaatataatcgctaattcatattatttgctatcagtgttattaatttaattagcgttgcattcaccaaatataaaagcagaatcttcaacttttggaccataagtgttgtgttggacccttaacctccccttataggcaacttataatacaattcttaccttcaaaatatcagctaacgtcataaatgaaacttgatagtattggtattttggctctatagatactattacagtaatgtatggttaaccacaattaaacctaactacaacttataattgttaagtgaacatttactactccgaataatataggtaggattaaaactatggaactgataagatgtcatagcattgtacttcatttgttcggcacaacgatcatgatagtaaagttgatttagtacatgaattagtaggggtgtgtgtggcttaaatcagctgccagttaacatactactcttctcgtagacgataagtcctagtactgctatgatattatggatactatctgcataatccatgtttatatagtgagatcgatagctttcttgtatcagcagttttcttcagattatacgctaaagaggatacagatgacattaagaactatgagaatggtattgatagatgctacttgggaatatgtattt

SEQ ID NO: 14868 - DNA, 917 bp, Diabrotica virgifera
  misc_feature (813)..(813): n is a, c, g, or t
  misc_feature (849)..(866): n is a, c, g, or t
  misc_feature (884)..(884): n is a, c, g, or t
gtgtggtcgtgtttaggaattcttataaaggagtcattgtctgattagatttgtttaatcctagcaaatcgaagaataacatgaggctgtgatgcttaccaagaacagctaagaaaccgagctttttatgtatcgagctgcatcaaggaaagacgttggaaggtgctctaatatttgacacatcacacacccagatataacattgctttaattaatatatccttaattgatataaatattcgttatcgactaagataacgaaatgcaggccatcaagtgtgtggtggtaggcgatggtgccgtcggtaaaacatgtcttttaatcagctacacgaccaacgcgtttccaggcgaatatatcccgacggtgttcgacaactactcagccaatgttatggtcgacggaaaacctatcaatctaggtctatgggatacagcaggtcaagaagattacgacagactgcggcctctatcctaccctcaaaccgacgtatttttaatatgcttctctcttgtcaatccggcttctttcgagaacgttagagccaagtggtatccagaagtacgacaccactgccctaatacgcctattatcttagttggcacaaaactggatttgcgagatgatcgagttactatcgaaaagttgaaggataaaaaactgtcacctataacatatccacaaggtttggcgatggcgaaagaaatcagtgctgtaaaatatcttgaatgttcagctttaacgcaaaaaggtctaaagacagtattcgacgaagccattcgagcggtactctgcccagtaatgcaggtganacaaaaacgtaaatgttcaatcttgtaatttatacnnnnnnnnnnnnnnnnnngcaaaaaagtgaaactanaaaaattgttgtgtaattttgaccgcgtgcatt

SEQ ID NO: 14869 - DNA, 680 bp, Diabrotica virgifera
  misc_feature (34)..(145): n is a, c, g, or t
  misc_feature (385)..(408): n is a, c, g, or t
attggctgtaaaattaggaacaattaccaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcgatgtcgcaattgcagatgctgcatcagttaagaactgacaaaccctaacttatcaacactctttttatttctattttttcatatataagccactactcagatattccacagcgctgagcgttaagaattacatcttatctagtttttatctttatataaagactaggataaacgattatcatacctacgaacatgtttttatttatgtcctataacattactattcttatttcnnnnnnnnnnnnnnnnnnnnnnnncatttaaactatttatatttagtaacgactgcccaagctagtattaaaaacttgaagactcaagcacaactacatcgccctaaccacgccactcggcaaccttccctcccccccggcattagcaacatgtccgtccgtacttgcatcttagactcgcctgcccagcgataaacttgaaagcacgaggtattttgacccgccaactccagcataatcagtagcttttctactaacagctgcaaagaacccgcggatgaaaaaaaaaccgcctc

SEQ ID NO: 14870 - DNA, 559 bp, Diabrotica virgifera
  misc_feature (200)..(217): n is a, c, g, or t
  misc_feature (246)..(263): n is a, c, g, or t
  misc_feature (384)..(404): n is a, c, g, or t
gtgtgtatctggggtcattaattaacaataatctatactactatttacaaatttatccgtggtacaacattaagctctatatcgatcaacaactgtttaacacctcctgttctgtaaggatatgctactcgtttctaaatcatctctaatgttctaagatatgcattcaaatatctttattaacaatatatatataaccnnnnnnnnnnnnnnnnnnaatacaccccattttgagcggtagctctnnnnnnnnnnnnnnnnnngatataaactttttatataaaaatagaaggatcacaaattgctcatactcgaactataagtaatagataattttctatatcttataatcctgttcttattaatttacttacaagaatatcnnnnnnnnnnnnnnnnnnnnnctcctgatgttactattattcttaccaaatatgtgtatttaggaaagtgatatagcggtaacataggaattcacccacaggtttttcacctgtgtattattaatatgactttttgtattatgtatatggtcgcgcctgccctctgattaatttga

SEQ ID NO: 14871 - DNA, 898 bp, Diabrotica virgifera
tttgccctcaaagcgcccgggcaaggcgacagcatgtattctcaggcatcaattttgttaggtcttgtctgcacgtcgctggccttccccaggacgtaccaagaacaaagacagatctactaccagcagcctctgccagtcccctatggcgcctaccagcttcctcagcaactgcagcagcagcagcaacagccaagcatcttccaagtacccgcatctacatcgttcctcccgaacaatgtgcctggactgaggtacggcgcccagcaaatcgtctatgtcgtcccaggaggaaaccaattgctgttcgaagaaggatcaaccggcggtcaaggaaactcgccctatctcgagtcctttatgaacttcctcaatggacacttgccatctagacctggtgctcaggcccctgaaaaacctgttgagaaacctgctgaagagaaaccagctgaaaactctgtcaacgcctcccaagagcaagaagcctccgctgaagaagtgactcctccagtcgaggtcctcaagccccaggctgagagcggccctgctcagctccaacagctgcctgcacagcaacccattcagctggcccctctgccaccccagcacatcgctcaactccccacagcccaggatcagcaaattcttcagcagcagctcctccaacagaggtactaccagccctacctcctgaaccagccccaacagctgaaccaagctctctacggccgaccggccctcgctgctcccactgccaactacttggtcaactatagggcgtaccctctgtccgacaagaaaccaggcagctccgccattgctttccaaaaactcctccaaaagaacgctgaggctgccgctgctggttctcaaacaaactgctgaagggaatctactg

SEQ ID NO: 14872 - DNA, 949 bp, Diabrotica virgifera
  misc_feature (16)..(42): n is a, c, g, or t
  misc_feature (46)..(943): n is a, c, g, or t
cctaacgcgggtccgnnnnnnnnnnnnnnnnnnnnnnnnnnnctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatt

SEQ ID NO: 14873 - DNA, 836 bp, Diabrotica virgifera
  misc_feature (288)..(305): n is a, c, g, or t
  misc_feature (440)..(462): n is a, c, g, or t
ccttataggcgtccgcaaaaacatcaaaaactgtaatatacgctttgaaaaatgacgacctaataaagaaagtattggactttctcttatattttctgcgatattttaaagtggaaagaagtacgtggaacgtagtaacgttgaagaggaaaacaaaattgtgaatgacatattgaacagtattaactgtaataacgtagaggacgaaatagtgtcaaagccaaaaaggtctggtttgagtagaacaaaatctagtagcttcaatctctccaccctcacaaatttccnnnnnnnnnnnnnnnnnngtattaccaatgagacaaataataattacatacaaaagccacatttacaaaataaccaaatagaaataaataatagaaatgatgaatgtggtttaaaacgctcaggtttaagtaagtcgaaggcttgtggaaatnnnnnnnnnnnnnnnnnnnnnnnagcggaagaaaccagcttagaatttggtgatgaaactgaagaaaatcatgttttgtttattttgggtgataacgaaaaactagaagacctaaaaaagaccaatgaagttaggaagacagaaagaaaattatcaagtaatacactagatatatctgagcctgagaatgcagataaactgaatgttatcaaatttcctctgcccgaagagaaacctattggtgacctaatagaggtgttaccaacatcttttcttcccgaccataatgctttagacgaattagtacctgataagatagttcaagggataaaatgtttctaagggcaaatgggaaagaaatctaatcaaatgacctattacggaaaaagtcttgttt

SEQ ID NO: 14874 - DNA, 962 bp, Diabrotica virgifera
  misc_feature (90)..(109): n is a, c, g, or t
  misc_feature (813)..(830): n is a, c, g, or t
  misc_feature (900)..(900): n is a, c, g, or t
  misc_feature (903)..(903): n is a, c, g, or t
  misc_feature (922)..(924): n is a, c, g, or t
cggctccacagccgccagtccgcgtttttaaaaatgatagagctatggcccccccgatcaaggaagctggtagagtgaaaaatgttttannnnnnnnnnnnnnnnnnnntgcacagattgaagggttattagatgaaaaagatttcaaattgccagttacaagggacgaaatggaagcactttttggggatttatttgaaagagtcaacaatccgatagaacaagcattgaaaaccgctcatctaacaatggacgtcgtcaatcaagtggttctggtaggagcaggtaccagagttcccaaagtacaagaacatctcagaaaagccgttggacaagagttggccaaaaacttaaacacagatgaagccgctgccatgggtgccgtgtataaagccgctgatcttagtactggtttcaaagttgctaaatttattaccaaagatgctgttgtttatccaattcaggttacataaaagacttgcagaaacaggagttaaacaagtaaagcgcacactttttggcctcatgaattcctatccccaaaagaagatcataactttcaacaaacacaccagcgacttcaatttcaatgtgaactatgccgatttagacttcttaaatcctaaagaaatacaatatttaggaaccaccaatatatcccaatttgaactcaaaggagttgctgatgctttgaagaaacactcaggagaaaacgtggaatccaaaggtatcaaagctcacttcgcaatggacgattctggtattttgaactttgtgaacgttgaattggttgttgagaagactgtcgttccnnnnnnnnnnnnnnnnnnactatctaaattaggtagtacgtttagcaaattattcggtggagacgagaaaccagcagaagaaaaaccnaancgacgccccaccttctgannngataacagctgaagaggccgaagaaaaaccagtcgaag

SEQ ID NO: 14875 - DNA, 983 bp, Diabrotica virgifera
  misc_feature (32)..(46): n is a, c, g, or t
  misc_feature (233)..(247): n is a, c, g, or t
  misc_feature (250)..(275): n is a, c, g, or t
  misc_feature (854)..(854): n is a, c, g, or t
  misc_feature (910)..(911): n is a, c, g, or t
  misc_feature (922)..(922): n is a, c, g, or t
  misc_feature (929)..(948): n is a, c, g, or t
ctctccagccgcgtccgcattgttgttgattnnnnnnnnnnnnnnncttataactgacttcgctctatcgagattcactttgacactgacgttagtaatttcttttttgggtttcagttgtcagaagtgactggaaattactacacaaccaacgcacctgctcatagccaatattattaatagtaaacagacataaaaataacataaaccttacatgtattgataacaaatannnnnnnnnnnnnnngtnnnnnnnnnnnnnnnnnnnnnnnnnnaaactccacaaaattttatgagattagtagacactcccactatttctaataattcttctttttttttaatgaaagattaagttgattttagcagttaatagtgtgaggtaggaatttttgtgttgtatgtttcctattccgaatgtgtcaaagtgaatctcggtagagcgaattcagtatagctcaaagcttggaacccttataaacggattgatgtgcaattttttggggaggattatagcttcgaacgggtataactttgagaggaatgaagatagagtaatttaacggactttgtttggaagcctattaattgaactttagagtgaggccttttagggctcattttcattccagagcagagccttataaacggttgaattgtctgtgacagttttttgaccactcggatcgaaatccaccctcgaggttcgtgagcagcggccaaaggtccataagaaaccgttgagtttgtcgaaaagagttgaagaggacacggtgacccctctggcgctcagactatatttagtaaatcagttttgtgaagtttttaatgtttttatagactagtcttattangtaataagcctgtggctctagtttttcgttcgacttttagaacttttttgaagttnnaatgattaganttgtacnnnnnnnnnnnnnnnnnnnnctgttttgctagtaggaaaagtaaggtgatgtttc

SEQ ID NO: 14876 - DNA, 903 bp, Diabrotica virgifera
  misc_feature (20)..(41): n is a, c, g, or t
  misc_feature (44)..(819): n is a, c, g, or t
  misc_feature (836)..(873): n is a, c, g, or t
ctctcccagcgtccgaatannnnnnnnnnnnnnnnnnnnnntcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattagggataacagnnnnnnnnnnnnnnnnnnnnnnnnnnnnnnnnnnnnnntgcgacctcgatgttggattaagtttataa

SEQ ID NO: 14877 - DNA, 462 bp, Diabrotica virgifera
  misc_feature (3)..(23): n is a, c, g, or t
  misc_feature (443)..(443): n is a, c, g, or t
cannnnnnnnnnnnnnnnnnnnncgaccaaccgaacacaaagcacacgagagcacgagagaacatcgcagcaagaaggcacgcgagcacagaaagacgagcaagcaggagaagaaggaacaggagcggacacgcagagcagagaagcccaaccagacaaaagccgaaccacaaggaaaaagaacaggggcaaaaagaggggcccaaagaaggcagaaggaacgacaagaacgaaaagaacagaacagagaccaacactacgaccggagccggaaaaacaacaacagcgggaagcccagaggaccgcgcaccaagcacagggcgagaccacaagccccaaaaggaaaaaaagccacacccccaagaaacagacgagaaagacgaccgacacaacaaaccgaagccagaccccgaggcggcaaaagaaccaaacccagaaacaancaaaccgacagggggccaa

SEQ ID NO: 14878 - DNA, 972 bp, Diabrotica virgifera
ccccatacgcgtccggtttcagtttatcgtagatagtcttgcgtggtagcagttgcgagataacagtgcataccgtgttttgccgatatatttttgaataactttagtgaaaaaacatttaatatttaatttaggttatttttgttaaagagtttttccgtacaaaccaggaggctttccatataagatcataaacgtaaataaaagcgtcttgagtttacggggattcgtggaatggcaactgcaactaatcgacgaagatggtcagattttctaacatgtcgtcaagtgttaaatataatggtcatcttgggcttcatgttcaattacatgttaagagtaaatttaacaatagccatagtcgatatgatggtaccagctcagacaaatgccacgaactctacaacaacaacaaaggtaccaattgtggaccaacacaaattcaattggtcgtcttcagagaaaaacgacattctgggaagcttcttctggggctatattctaacagaattacccggaggccgaatggctgaaatcgtaggtgccaaaaaaattttcggaggaggaatgcttatggcaagtttgttgacagttttaacaccggcagcgtgttactggaacttttacgcgatagtgattctaagagcactagtgggatttgcactaggtgccacgtggccctccatgcctccaatggctgcaaaatggataccgccactagagagatctaagtttatggctaatatgatggctagcgcactaggagccgcaatcacattaccggtttgtggttacttgatcagtgtatctggttgggagagtgttttttacgttactggtgccgtaggtatagtttggtctatactttggttcgtgctagtattcgattctcccgccccacatcccagaataaaagcagaggagaggatggatatcgaagataaaatagccgagtttgaaggaggagctaaa

SEQ ID NO: 14879 - DNA, 947 bp, Diabrotica virgifera
  misc_feature (32)..(32): n is a, c, g, or t
  misc_feature (65)..(65): n is a, c, g, or t
  misc_feature (69)..(69): n is a, c, g, or t
  misc_feature (78)..(78): n is a, c, g, or t
  misc_feature (80)..(101): n is a, c, g, or t
  misc_feature (105)..(105): n is a, c, g, or t
  misc_feature (109)..(109): n is a, c, g, or t
  misc_feature (111)..(111): n is a, c, g, or t
  misc_feature (123)..(123): n is a, c, g, or t
  misc_feature (162)..(162): n is a, c, g, or t
  misc_feature (164)..(164): n is a, c, g, or t
  misc_feature (172)..(172): n is a, c, g, or t
  misc_feature (174)..(175): n is a, c, g, or t
  misc_feature (177)..(177): n is a, c, g, or t
  misc_feature (183)..(183): n is a, c, g, or t
  misc_feature (185)..(185): n is a, c, g, or t
  misc_feature (193)..(193): n is a, c, g, or t
  misc_feature (195)..(195): n is a, c, g, or t
  misc_feature (205)..(205): n is a, c, g, or t
  misc_feature (208)..(209): n is a, c, g, or t
  misc_feature (211)..(211): n is a, c, g, or t
  misc_feature (230)..(230): n is a, c, g, or t
  misc_feature (248)..(248): n is a, c, g, or t
  misc_feature (252)..(252): n is a, c, g, or t
  misc_feature (270)..(270): n is a, c, g, or t
  misc_feature (272)..(273): n is a, c, g, or t
  misc_feature (275)..(275): n is a, c, g, or t
  misc_feature (277)..(277): n is a, c, g, or t
  misc_feature (280)..(280): n is a, c, g, or t
  misc_feature (284)..(284): n is a, c, g, or t
  misc_feature (288)..(288): n is a, c, g, or t
  misc_feature (290)..(290): n is a, c, g, or t
  misc_feature (295)..(295): n is a, c, g, or t
  misc_feature (297)..(297): n is a, c, g, or t
  misc_feature (299)..(299): n is a, c, g, or t
  misc_feature (303)..(303): n is a, c, g, or t
  misc_feature (313)..(313): n is a, c, g, or t
  misc_feature (318)..(318): n is a, c, g, or t
  misc_feature (326)..(326): n is a, c, g, or t
  misc_feature (334)..(334): n is a, c, g, or t
  misc_feature (356)..(356): n is a, c, g, or t
  misc_feature (386)..(387): n is a, c, g, or t
  misc_feature (393)..(393): n is a, c, g, or t
  misc_feature (407)..(407): n is a, c, g, or t
  misc_feature (426)..(426): n is a, c, g, or t
  misc_feature (441)..(441): n is a, c, g, or t
  misc_feature (443)..(469): n is a, c, g, or t
  misc_feature (482)..(482): n is a, c, g, or t
  misc_feature (488)..(488): n is a, c, g, or t
  misc_feature (491)..(491): n is a, c, g, or t
  misc_feature (511)..(511): n is a, c, g, or t
  misc_feature (517)..(517): n is a, c, g, or t
  misc_feature (521)..(521): n is a, c, g, or t
  misc_feature (529)..(529): n is a, c, g, or t
  misc_feature (556)..(556): n is a, c, g, or t
  misc_feature (567)..(567): n is a, c, g, or t
  misc_feature (578)..(578): n is a, c, g, or t
  misc_feature (592)..(592): n is a, c, g, or t
tttccctccacgcgtgcgaatttgaagtaaanatggaaatttaaccttataaatttttgaataangagntaattttgntnnnnnnnnnnnnnnnnnnnnnngttnaaananttatataaaaanaataataaagtaattttataaaatgtaaggttagattgntntggttatnanngnaagaangntagatggngntattttttgnttnntnaaatgtaatgagaaatgtnaagagttgtatgtattanagtntatagtatttggttattntnntntntanttanagtnangtganangntgtnagattttgtnaggangttttaanattgagtnttatgggattattttgttaaanttgaatattttattttgtagtgataataanngaatanaattgttagaattnattagttattaatttatantgtaatgtatagtgnannnnnnnnnnnnnnnnnnnnnnnnnnnaagatttattganataaantgngatagtgaggttatgtatanaaaatnaaantgataatnaatattggaaatagaagaatttatatnagattaagggngttttattttntgtttattttaaanatacacaaagcgccctgataaaattttaaaaaaccgcaccatgagcaggtcggtcgattttgctttgacactttgttaacgctcagagcgaatagtaagtcatgacattgactaaagactgttgactgacagggatattatttgatattccagagaaggagctggttgacagttctgttaatgccccgtcctcatttttaacaagatgatattataaagaattcgtaaataatgtatctacattgttcagttattcaagaaaattttctacgttaagggcctattgaagtttttattgtaaacttcttaataatgtgttagtggaagaatgagtttttcattaaaaaatcatttg

SEQ ID NO: 14880 - DNA, 855 bp, Diabrotica virgifera
  misc_feature (14)..(39): n is a, c, g, or t
cttcccccagcgtnnnnnnnnnnnnnnnnnnnnnnnnnnggtctttaaagaatatatttctataataaaatttatcaaattgtaactttataaacgtcacatctttgttattattcctaaagctatatcttccaataaccagaaatttgcgaagacttgaagcttcaacaagaagtccaatgataggtcatttaaatgctgctctggaaggtgttaccactgttagagcctataaagcagaaaatatgatcatcgatgagtacgagaggcatcaagacgttttcacttcggcccactacagtctactgggtttcaagttcggaatgggattctacatgagcatgttggctggtgttatggtgacgctggtcatttgtagtttcgttctttttgaaacagatgccacagctggaagcattggtttagccttgacccaagtgatatatttaggtgctctaatacaaggagcagtgagatgttgggctgatttggaaactttaatgacagctactgaacgagccctggaatataccggattaaagtctgaaacaacacaaggcagcgtaccaaaacattggcctaaagacggaaccataagtttccaaaatgttagtttatcttataattctactcaaagaattttgaacaatttgagttttcaagttcaggcgaaagaaaaaattggaatagtaggccgaacaggggctgggaagtcctccataatatccacaatatttagactctatgaagtagacggaaaaataaccatcgatggagttgatataaagctactacccttaaaacatttactaaaacatctagcaattattccgcaagatcctattctcttttctg

SEQ ID NO: 14881 - DNA, 965 bp, Diabrotica virgifera
  misc_feature (19)..(45): n is a, c, g, or t
  misc_feature (48)..(769): n is a, c, g, or t
  misc_feature (776)..(813): n is a, c, g, or t
  misc_feature (835)..(835): n is a, c, g, or t
  misc_feature (849)..(871): n is a, c, g, or t
  misc_feature (879)..(900): n is a, c, g, or t
  misc_feature (923)..(923): n is a, c, g, or t
  misc_feature (929)..(929): n is a, c, g, or t
  misc_feature (940)..(959): n is a, c, g, or t
ctcaacacacggtgtccgnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagtttaaccggtgtgagccaggntggttnctatctttaannnnnnnnnnnnnnnnnnnngaaaag

SEQ ID NO: 14882 - DNA, 501 bp, Diabrotica virgifera
  misc_feature (65)..(81): n is a, c, g, or t
  misc_feature (83)..(95): n is a, c, g, or t
  misc_feature (298)..(317): n is a, c, g, or t
ttatgtgtttgtgggtgattgtggttttaattaagttgatttagtaatagtagatttcccatatnnnnnnnnnnnnnnnnngnnnnnnnnnnnnngattaaagaaaaaggaagaagttaggttaagagtattatgtgagagatgtagaggtgattaataatttgtggtttgagatagtggagaagtagttggtggtattttggttattttatatggtttatattatagtattgggtatttgtgttctggtagcgggattattgatattgatagttgatgtttattattatgtgtgagnnnnnnnnnnnnnnnnnnnngaagtcattcatgataaattggaaaaaaatgtgagtatatttatgatagtatattgttatatgtggtttgatttgtggtgatttataatgatgatgatttttgagagtggaggatattggtgttgttatgggattaggatatgttgtggtaaaataagagtatggagatggggttgttagatga

SEQ ID NO: 14883 - DNA, 730 bp, Diabrotica virgifera
  misc_feature (8)..(51): n is a, c, g, or t
  misc_feature (53)..(97): n is a, c, g, or t
  misc_feature (105)..(120): n is a, c, g, or t
  misc_feature (122)..(137): n is a, c, g, or t
  misc_feature (139)..(220): n is a, c, g, or t
  misc_feature (231)..(729): n is a, c, g, or t
ctttttcnnnnnnnnnnnnnnnnnnnnnnnnnnnnnnnnnnnnnnnnnnnncnnnnnnnnnnnnnnnnnnnnnnnnnnnnnnnnnnnnnnnnnnnnngtacctcnnnnnnnnnnnnnnnncnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 14884 - DNA, 858 bp, Diabrotica virgifera
  misc_feature (127)..(182): n is a, c, g, or t
  misc_feature (577)..(597): n is a, c, g, or t
  misc_feature (686)..(703): n is a, c, g, or t
cggacgcgtgggactaattttacggcgcagagaacacaggctcattagtttaggtcaaattctccagacactcaagggacccaaaacgaccgaccgcaaagcagttattaaaaacgccgatatcgannnnnnnnnnnnnnnnnnnnnnnnnnnnnnnnnnnnnnnnnnnnnnnnnnnnnnnntacaatatagaaaaggatatcgccgcctacattaaaaaagaattcgacaaaaaatacaatccaacatcggcattcgtatcgtcggtagaaatttcggatcatacgtgacccacgagacccgccacttcatctacttttacctaggacaagtggcgatactaatctcggttcaagagtggttaatctccaaaaagccccaatttcacctggacttctaaccccccaaacaaactatccatcattccctaaccccattttccagtattccactaattaaatgatcaccttttcaaacattcctaagtatatcggtttcgatctggggcgtatttttcggaagaatcttatcgacatgggatgtgaagatgcgccctaaaaatttatcgagttttttnnnnnnnnnnnnnnnnnnnnncttttggaataaaattattttggtggatgcagtttagaatttttcacttaaaatggagggattttggggcaaaagtaaggtgacgcacnnnnnnnnnnnnnnnnnnctcgatggatggcaagaaatttggataaaggggaaactcttcttacaattttgaccattaaccgagtttttgattcgattcggattaataatgtatttaaaagctagcaaaaaaacaacagctgaatcttaattggttggatatttataattaat

SEQ ID NO: 14885 - DNA, 173 bp, Diabrotica virgifera
  misc_feature (2)..(44): n is a, c, g, or t
  misc_feature (52)..(164): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgt

SEQ ID NO: 14886 - DNA, 941 bp, Diabrotica virgifera
  misc_feature (914)..(914): n is a, c, g, or t
caaaggcgtccgtaaaatccgaagaaaaacactattttccattcagaattgttcggtgatagtgagttcgatttctcctcttttaagtgactcgtttacaaaaaaccgcgtacggaaactcggtctcgtgaccgtatccacttatagagcttacggcatcggagataaatataaaactttatttaatttaacagatgctttatccacttatcgtcaatataaaagcgactcgtaatattaatatagatagagttatgaatttaaaaagagaattttatcaagaaaccttcaaaaagatagttcaatggcacttaagaaaatatcaattggatcatactgtagtgacttatttgccctttcatgaaaaaatatacccccttctactcagtgatgaagaatttcaaaaaggtttcttcatcaacaaaacctacgacattatttatttgtggaatacagacatgctcgttttttgctacgacagtgctgccatagagtctgttttgaacacaaagaaatccacccattacgtaacattctgggatacgtggttggtccattacattacagcgacatgaaggaaaagatgtggtctttcgtggaagacgaaccaagactacgtgtttcttgataatggtactcaatggtggggagtcgatgccatttctcgaagttggcttcacttataactccagacctgccagatgcttctccaggttgtgatgctaatccagaaaatttttgagtggagtgaactcaacacgaagcgatataaatggttctgtagtttctgagagccccatcgaaccatcagaaccatcagtcttcgcataatcagcatggttttctgtggtatcggtttctttatatactcttttttatatggaaacgtttacgttctttattcttttatttancatgctgtagaaaagctgagcaggaac

SEQ ID NO: 14887 - DNA, 857 bp, Diabrotica virgifera
  misc_feature (2)..(855): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnct

SEQ ID NO: 14888 - DNA, 604 bp, Diabrotica virgifera
  misc_feature (7)..(116): n is a, c, g, or t
  misc_feature (130)..(163): n is a, c, g, or t
  misc_feature (340)..(368): n is a, c, g, or t
gaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccctttcgcannnnnnnnnnnnnnnnnnnnnnnnnnnnnnnnnncccgggcccaccccggtttaaacccaaatcatgaaaaattttaaaagccgaacaaacttaaaaaaatagcggctaccccaattataaactttaatccaacatcggggcccgaatctttattaccgattggaactccccaaaaaaataccgcggaaaccccaaagggaatttattctnnnnnnnnnnnnnnnnnnnnnnnnnnnnnaatctgaagggatgaatgtaagaatccaggggagaacgacgggagtctacttctataggatcacgatgctcatgttaccggaggtgcagtctccactcgaaagaccgggaaaaaggcggaggttaccaaaatattgacctatgtagatcatccctatttcgctactactatggaaaaccaatagggtcctacaatttccaaggttccccatctgggattaccacctctgctatatt

SEQ ID NO: 14889 - DNA, 221 bp, Diabrotica virgifera
  misc_feature (6)..(28): n is a, c, g, or t
tcgtannnnnnnnnnnnnnnnnnnnnnngatagaaaccaacctggctcacacggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 14890 - DNA, 239 bp, Diabrotica virgifera
  misc_feature (7)..(44): n is a, c, g, or t
  misc_feature (49)..(49): n is a, c, g, or t
  misc_feature (68)..(68): n is a, c, g, or t
  misc_feature (116)..(116): n is a, c, g, or t
  misc_feature (140)..(140): n is a, c, g, or t
  misc_feature (172)..(172): n is a, c, g, or t
  misc_feature (179)..(180): n is a, c, g, or t
  misc_feature (192)..(192): n is a, c, g, or t
  misc_feature (205)..(236): n is a, c, g, or t
taacagnnnnnnnnnnnnnnnnnnnnnnnnnnnnnnnnnnnnnntgcgnacctcgatggttggattanagtttataaattggtgtagcagctatattaattaagtctggtcgactnttaaaattttacatgatctgagtntaaaccgtggggagcccaggttgggttctatncttattnnataaatatattntagtacgaaaggnnnnnnnnnnnnnnnnnnnnnnnnnnnnnnnngat

SEQ ID NO: 14891 - DNA, 937 bp, Diabrotica virgifera
  misc_feature (2)..(795): n is a, c, g, or t
  misc_feature (802)..(839): n is a, c, g, or t
  misc_feature (874)..(896): n is a, c, g, or t
  misc_feature (904)..(926): n is a, c, g, or t
  misc_feature (928)..(928): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataatgggnnnnnnnnnnnnnnnnnnnnnnntggtcgannnnnnnnnnnnnnnnnnnnnnnangttaaaccg

SEQ ID NO: 14892 - DNA, 869 bp, Diabrotica virgifera
  misc_feature (397)..(419): n is a, c, g, or t
aaaaatttatctgagtttccgcgaagccttctgcggaaattgatgtatttgaagcgcttgatgcaatcagggcacaatttaagaaagtttgtgcacagatgaaagttaatatcagctatccagggaaaagtaatatgtcattttgaaaatgaatgccactagagttttaaaagatcacattaagcagcttacagactacttagagccatttctacctttagcgaatcttcatatggtcgattatttcataaataacgcatttgtaaagtatattccaataaaaattcaagaagatatacaaaagattggatataaagaagctgtaagttgtatatttaatgataactacacagatttaccaaatcttggcatatttaatgataaatctaaaaaattnnnnnnnnnnnnnnnnnnnnnnngcctcaaaattgacgatctacaagaaaaattacaatcgttaggttgttctgatccaaccagattgaagttagacattttttatgacttcaaaaaaatctcacgaagtcgacattttaagctacattgcagctgctttgagtaacatatccggaacaacacatttgattgacataggtgatggaaaaggttaccttagttcaatgctagctctacatcacaaaataccagtcctaggcattgacgcttctgcaataaatacaaacggtgctgttactagagtaaagaaactatctagagtgtggaatgcagtttcctcaccacagaaagaagtaaaaagtaaagaacaggttacctcggatttgtacaaacaagtaacgaagttcgttgatagtagtattgattttgtggagcttgtatcagatatatttctagaaaaacctgatggttta

SEQ ID NO: 14893 - DNA, 822 bp, Diabrotica virgifera
  misc_feature (812)..(812): n is a, c, g, or t
caacatttggtacaggatgttctattaccggtacgcgcttcctaaggcagataagatcgctaggaagtattttggagacgacatgccttacttgggagatctggagaaaaatattagtttattgttattaaatgtgaatcccattatacataatgtaaggccgaatgttccgaatgtgattgagattaatcaaatgcatataaaaaagaggaaaccgttacctaaagatatacaagactacctagactccgctccacaaggagtagtttacttcagtttgggatcaaacgtgaagagtgccaatttgactgagcaaataaggaaagaaattgttgctggtttgggagcactaccttacaaagttttatggaaatgggagactgactatcttcctaataaacctgataatgtaatgactaagaagtggtgccctcaacaggatattctcgctcatccaaatattaaggtgttcgttatgcagggaggattgcaatctatagaagaagctataaccttagaagtacctctagtaggaatgccttttgttactgaccaaccctctaacatcaaacgaatagtagaactaggactgggtgttaaagtcgaccacaaaaccttgacgagggacattcttaaggatgctattatggaggtagcccagaatccaaaatacaaggaagaagttaaaaaggcaaaaagtatactattggaccagcccatgaagggagtggaaaaggcagtttggtggatagagtacgtcatcagacacaaaggagccagacatctgagaagtccagcggagatattgacgnttgttggagt

SEQ ID NO: 14894 - DNA, 959 bp, Diabrotica virgifera
  misc_feature (695)..(695): n is a, c, g, or t
  misc_feature (771)..(771): n is a, c, g, or t
  misc_feature (862)..(862): n is a, c, g, or t
  misc_feature (867)..(867): n is a, c, g, or t
  misc_feature (870)..(870): n is a, c, g, or t
  misc_feature (925)..(925): n is a, c, g, or t
gttgaaagttaaagttgtgaatcataattaaaaatcgacttaattaactgatttattcagattaaaatacacttcaactgagatcttacgttactgtgataatatacctgtagctaactttcggttatttatttttatacacttttctaagttcctgtttttgtgattttttcactatgttggatattgtgccaaagaataagcctgctgctggagactgcttcgagatgaaagaactgacggcgagaatttgcagggattaccttcaaggggcctggaagaaggtcaatgccaaaaacattggtttcaagcatatcagcggagggctctccaaccatctgttccacgtctctcttccggactctctaaagacggctgatgccaacgtcgagcacgaacccaaagacgttctgatccgtgtctatggacaaacccacggagaaggcgcattggaggccctcatcaccgaatcagtaatcttcaccttactctctgaacgtaatttaggaccaaaactgcacgggattttccccggaggaagaatcgaacagtacatcgatgccaggcctcttttaaccaaagagttgtcagacgaacgactgtcggtatcaattgccaaaaaaatggcagctattcattcgatggagcaaaattgcgacaaattgcgtgccattggctgcccttaagccggcccntctgggctgtcaaatcgacggacgaaataaaatcgtacctctacacaaagctcccgaatggatctggaacactctncgataggtggttgaacagtttgaagaacatgcaactgaccaacatgccagaaagcaccaaacacatcctgggaaaaaggtgaatttcgggntcggnaanatcgaatggctgagaaaccagattgggagggcgagaacaagtccttggttgtttnttttgtcacaacgacatggcaagtaggggaatat

SEQ ID NO: 14895 - DNA, 871 bp, Diabrotica virgifera
  misc_feature (445)..(462): n is a, c, g, or t
  misc_feature (470)..(501): n is a, c, g, or t
  misc_feature (850)..(868): n is a, c, g, or t
aagttttcagagacaaacagacctgatactctttcaagtatttttgttgttaaactcaaaaagaaaaatctttacttgatttttgtttagctttttatatcgggttaactttgtactattcttggagcttttgaaattactttaactaaaactaatagaataaaagcttcttcgaaaatgtcaatgtaagaaatcgtaacatataagatagaaagtttcattatgaagaagacattttccaaaatatatcaaaatttgcgaaaaattaaagtcttgtctacatttgtcatttgtagctaatatctgaaatttgaccatattcagttcaaatttttgtcttacaatacttttcacatttttgtgaagctttgcagctatgtgcgagctgctattctagcatttgatctttttactggagtctacttcctttagctctactagaagnnnnnnnnnnnnnnnnnncctctccnnnnnnnnnnnnnnnnnnnnnnnnnnnnnnnnttcttctttctatggcactagagtattggtgtttttttttatacaggaaaggcacttcacgaactttcttgtgcatattgaacgtgttacgtttcttttacttttaccgttttatgatttctgaacatgtacccgccatccacttttctttagtcagattataatcgaactgttcagcttctgtatctggcttgtctgcgttagagtatacttaaagtatagagaagagagagatcgatatttatatacgatagtcaattaggccttctgtcaaggcctccaacattttttgttgattaatggtgtcaaatgccttttcataatccacaaatattaaagaataggaacnnnnnnnnnnnnnnnnnnnctg

SEQ ID NO: 14896 - DNA, 936 bp, Diabrotica virgifera
gcctccctcactaaggcctatggtaacgcctataagacctcgaatgcctgttacacctacaggccgacctcaagcaggatatgttcgtgtagctcctggtacgattcgagcaaggaccccagtggtaccagcaggaaatacgcttcggccaattcgacctataaatgctgtcaaacacgaatggttcgagaaaaccgttcgagctgctgctcgtgtcaattccaacctctcgtacactctaacccagctgaacagggcgcaggcgaatgcgacaagtgtagaagcgctggctgtagtgcataacaagttacaggagattctgagtagttcgatcaactccctgatacagattaggaagaatttgagaacggagtttattgctggtattaaaaatattcggtttccatcttctacttcgactactcctactacttcgacggcatctaatgctgcttcgacttcaaaagacgacgacgatgtcatctttgttgacgattcaacacccaaaactaccgctacaaccgtaacaacacccacgcttcctccaggcctatctctcataaagaagactcaggctggtgtcctgagaaccaatagtccgagtacaacttccgtagcaggtcctagcggagttaccaaaactattagagctactccttccaaaccttctactagtgctggtaatcaaggtaaaggaggtttcctgagggtcaaatctttctcggcgctgcaaagtgttacttccgagtgcatcactatccccgacgatcgttcagaagatggagatggagatgcagatgtgttgccagttgaagaaacggatccccttccaatggttgaagttgtggatgaggaagcagcagacaaatcaaaggaagcaaaagttaaagatgaggacgatgacaaaaaaggagataaaaagggacagagtagtaa

SEQ ID NO: 14897 - DNA, 516 bp, Diabrotica virgifera
  misc_feature (17)..(40): n is a, c, g, or t
  misc_feature (91)..(114): n is a, c, g, or t
  misc_feature (340)..(365): n is a, c, g, or t
  misc_feature (425)..(449): n is a, c, g, or t
  misc_feature (503)..(515): n is a, c, g, or t
ctctacgcgtccgctgnnnnnnnnnnnnnnnnnnnnnnnnactgttctttaacggttgctcggtagttgccggagattgtgaaagaactgnnnnnnnnnnnnnnnnnnnnnnnnagcttcaaaatggtcatggagaaaccagtatggactggaaaaataagcgcaaataaaatccaacccaacgccaccgtgaatgacttcactgttaaatggcacgttgatgatgtagatgtggatattagtggattgggactcattggagatgctacagctgtagccattcaaacaggtgttaaaactgccctcaacactggactcatcggaaatgtcgttggagatnnnnnnnnnnnnnnnnnnnnnnnnnngtggtaccccactggcaaactctgggatcttatggcctggtgcaaatcataaggccaacnnnnnnnnnnnnnnnnnnnnnnnnntcgaatcaaataattaactaatatagatttcttgtctaaatttgtaaagatagnnnnnnnnnnnnnc

SEQ ID NO: 14898 - DNA, 837 bp, Diabrotica virgifera
cttaaaagggagagatctcttcgaggaaaaaaaagtaggtctctattccgacgaaacgaaagcagtgcccgcagcaatcattatgcagtttttgttattgtataagaggaatctgctgataataaagagatgttacggtccatcgctgaacagagtattggcccacattgttattggtctgatctttggctatttgtatagaaacgttggaagtgccgcggatacagttttagcaaattatgtatatttgtatggtactcttttactcacagtatatactggtaaaatgcccgtaactttatcatttcctctagaaatgaagatactctctagagagcattttaaccgttggtataagctaactccatatttattgtctgtgatattagttgaaattcctttccaagttatatgtacatggatgtacatagcagtatcttattcgttaacgaaccagccattagactttaggttattcttgtttgtcatttttgtaacagcgtgttctctctgtggccaatccatgggatattttataggagccacaacaccagtaaaggtagctgtattcatcgccccagtgttagcctgcttcttatcagtcttcggtttttgcatcagagcaatagacacctctaccatgttcaaaccgatcttcttcatcagttactttagagcagcattccaaagcgtcgtttatagtatttacggctttaaccgagagatattggtttgcccaatagaggaggaatactgtcattataaagatcctcacaagttcctctcggaaatgaaattttagatgtagattttagttcaaattttatattgattggt

SEQ ID NO: 14899 - DNA, 840 bp, Diabrotica virgifera
  misc_feature (23)..(42): n is a, c, g, or t
gaaaacaatccagcagataatannnnnnnnnnnnnnnnnnnncgtaaaaaggttatacaaatacaacaaaataattgattctttttagaatttcatacaaataagcacattgtatctggtgatcggataaggaaatgtttacgatgcgcctgaaattgggttcagatagaaataaagaatggacatcttgcttttgtttgcatgttcgaacagctacaatcctatttgggatatggcatttggtgcttcatattttggctctgacagtactggcactgatgatgcgcaatcatcatgtgattctccaaaagaacgaagacctacaaactgatttcttgcctacccctctaagcaaaaaagatgatgacaatccctactatttgcccacaactcaggatagccgcaaaatatacacatctgacatcgatatgggagccctaatgacggtttgtaccttatccattacccttcttatggtctacggaacaattaaaggaaaaccgacacatgtcctcccattcttctgcctacaacttttcgattttgccattacagctctaaccgcaactggatacttttgctacttgagatctgctcatcgcctaatcgcagaaaactggaaccttcctctgcgccaagaacttctccagttgagcccgcaagttttgacgctcatagtgttgctggccttcttattttcaatgttatggaaggcatactggatcagtgtagtttggagatgctacaagtacctaaccttccgccacaaactaaccgaaacgccattcgatacatcattcctgaatccgaccaccgtggtatcaccgatccagattatcc

SEQ ID NO: 14900 - DNA, 619 bp, Diabrotica virgifera
cgaaccgcaggagacggagacgagcgcggagcgaaccaggaagagacctctaattttgattggaagtatgtgaatttgggtaggggacaaataatggataaaaaaatatcgatatgttaagagtgggagaaaaatgcaagggatctgatggtttacagattcataggaaatgatctatttaacctttggaaaatctgctcatgaattgtttggactggccttggaatattataagaaattgcaatttgtatcagagaagatttggatagagtatctagattgatctttggagttgctaatgtcaatgatatagaaaatagattaaggaatagtgttaattggtaaaaatcgccagactaatgttgattcataccctgagattggtgataggctactcattaacaaagggtaaaaatggaggaccaccaggataatgttcgcaccaactttcgacgcctaattcttaaaatcttacatgcgcagaattaaacaaaaatgctaatgctgtgtacgaaagtttaatatggattatgtaggagggttcagattgccaagtttacctcgggtgtccaactgtaaatagtttgctagaaactgatatgtgggttacagtagaaca

SEQ ID NO: 14901 - DNA, 916 bp, Diabrotica virgifera
  misc_feature (827)..(913): n is a, c, g, or t
attggacctcaatatcacattttttacgattcgcaataaaccctccctttaatgacactcaattacaaatgggccatactcctccctttttatattagaataatatattattagaacccctgatgtatcatgaatcatcaatgaataatcatctatctattattatgcagtttagactaggtcaaaactatcaaatgttattgtatcaccaatatgttaaataactgttttcgcaaagaactgaccttgcgccctttgatatatctaattgtttaccaaaaacatcatcttaatatattaacaatacaattgtaaataaaaatatctctatcactactatccaatatttttaactgtgacgttcctatcataaatttatgaaaatcaaatttgtagataacatgtaacatgaaccacttccttagctcccaatgtggtattatttatgtatataaatgattatttgaattttttataaattcataatgacaagacaactacttttaattgtacttcacataatgatgatgatattaccatgacatcatggaatattaaatatcaatatatagcgcccaatagaaccctgattgctccttatgttcgcactgctattagacacatgtatgtaagtattatttatcaaggcacggctgaccactgagtcctgtgagtgttgcgagctgatgatgacgaagatgagtaaatgtactcactacttaatatatcctctatctatacgacacctccgcatgatgatgacctcgactccatgtaatttatagagaatagtatatctattgtattaaacttaattatatataacnnnnnnnnnnnnnnnnnnnnnnnnnnnnnnnnnnnnnnnnnnnnnnnnnnnnnnnnnnnnnnnnnnnnnnnnnnnnnnnnnnnnnnnaag

SEQ ID NO: 14902 - DNA, 642 bp, Diabrotica virgifera
  misc_feature (379)..(404): n is a, c, g, or t
  misc_feature (424)..(467): n is a, c, g, or t
  misc_feature (503)..(547): n is a, c, g, or t
  misc_feature (549)..(566): n is a, c, g, or t
  misc_feature (581)..(618): n is a, c, g, or t
attctattatttattttcgttgaatgttcgtgacacaatttcgttactttaaaatttcattcactgtttgtctattcatttttcttggttgaagacgttttatttggttgtgccgagttgacttccgcttgtggcatgttgttgggttgttgatgttgtggctttagagatttttaggctgatttgagagctcctgcacgagacctcaaggcagcagtaacctgaggtgcaacttgagcttcctgattgtatttactatccattcttcgaatcagtgtaccaattcagtctgggggtttccattgtcatttcttcggttgcttgatgactgaccacacttaagtgtcttccttctatgtcctgggagagagttgtttgnnnnnnnnnnnnnnnnnnnnnnnnnncttaagattctaaaatatgnnnnnnnnnnnnnnnnnnnnnnnnnnnnnnnnnnnnnnnnnnnncttttattaagaaatagatttaaataatttaagtgnnnnnnnnnnnnnnnnnnnnnnnnnnnnnnnnnnnnnnnnnnnnngnnnnnnnnnnnnnnnnnngaggaattctgctgnnnnnnnnnnnnnnnnnnnnnnnnnnnnnnnnnnnnnncattaagtataatgtctctcctgc

SEQ ID NO: 14903 - DNA, 848 bp, Diabrotica virgifera
  misc_feature (134)..(134): n is a, c, g, or t
  misc_feature (282)..(302): n is a, c, g, or t
tctacaaggggtgcgtgataatgtaatagatttggattaactccacaaggattttgttatattgattatgaacaggtaataccatagtaaagggaacatttttatttgatggttccgaaaggtttttgactagnttttgtataattttatcccattgaagtttaaataccagttgtagtcttttatttttgacgtactagcaaatattttatatgtgatagattaattattagtattatagaatttatacttttttacaaaacgttgtgtgcataacacagnnnnnnnnnnnnnnnnnnnnnattttgactacataaaacgaggttttcgaaaagaaattgtaattttaccatatatttgtttcttctcgtctgcgctgtactaccagtgaataaaattgtaaaaataattccaacaataattctaattgcaaagaactagaaaattcttcaacccgcctttagacttgatcttctcactttccacgagcttaattttttctcgatcaccactatcactggggcgaaatggagggttagtaagacaataagaatcttaggtattataatataagtaagtttatagtattcaaagtgattgagtcttcatgagtttggtaattgctgacgagtatacaacagtggtatgaatgttcttagcatatagtgaaaatgataatttatgtttacgaagaagttttgtttctcatcataaaaatatctaataattaatgcatttcatctagaagtgttccaatgccattatccctttagagccgtgttttctaaaaatgttacaaaattatctttaggaagatcttcaacttcgagaataaaatctcgatgaaa

SEQ ID NO: 14904 - DNA, 608 bp, Diabrotica virgifera
  misc_feature (2)..(18): n is a, c, g, or t
  misc_feature (20)..(64): n is a, c, g, or t
  misc_feature (71)..(183): n is a, c, g, or t
  misc_feature (192)..(380): n is a, c, g, or t
  misc_feature (382)..(568): n is a, c, g, or t
  misc_feature (570)..(607): n is a, c, g, or t
cnnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnc

SEQ ID NO: 14905 - DNA, 750 bp, Diabrotica virgifera
  misc_feature (239)..(259): n is a, c, g, or t
  misc_feature (338)..(357): n is a, c, g, or t
  misc_feature (422)..(470): n is a, c, g, or t
  misc_feature (610)..(630): n is a, c, g, or t
cttcacgcgtccgtttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 14906 - DNA, 474 bp, Diabrotica virgifera
  misc_feature (4)..(275): n is a, c, g, or t
  misc_feature (282)..(319): n is a, c, g, or t
  misc_feature (339)..(352): n is a, c, g, or t
  misc_feature (355)..(377): n is a, c, g, or t
  misc_feature (385)..(407): n is a, c, g, or t
  misc_feature (437)..(468): n is a, c, g, or t
cccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 14907 - DNA, 984 bp, Diabrotica virgifera
  misc_feature (644)..(676): n is a, c, g, or t
  misc_feature (903)..(903): n is a, c, g, or t
gctgatttgttatccatcgaacatgtgtgggaaatggtaggtcgaaacctaaatcgattgtcacgtcctacagcaatcttagaagacctgtggcatgccataagaagattctgtatgagccttcagcaatatgatatagaccacttaattcgataaatgcctcatagagtaactgagtatatagaaaatcaacagcgactgctggtcgtataatggttttgtatatctggatgttttcacctcgtgaggcaagttttgatctcattagatgtttcattgcatagatcggttttccgcaattattcgcgtttgagcttctagttttacttttttgtcattggtgactgttgctcctagatattgttgctttctaaactgttgtgtaaaattcaaaaacagtggttgacacctgatactctcttgcaaggttgaaacgctagaactatgtttgagtctttttctttaacaaaaatataactttattacattctgtcgtggtaatatcgtccttgctaaagttcttctagaagctaataggtttttcacattatgtttctcaaaggctgcactcgaattgattaattgttaagaaaattttataaaaatcttacctaaaatgctacataagttgaaaataggttatnnnnnnnnnnnnnnnnnnnnnnnnnnnnnnnnncaatacaatttattttttgtttaataatcacatctaatgttggagctggcatcaattttattgcaaaacgaagaaattttcaaggaaggttaattgtctattttgctttcactcgaaagaaagtgaagaaaacatttacgtcttaacgggttttcctgtcctgcgtatggaaaatatcttacggttcttatagaaatttgtctttttgtaagtgatacagcgtgaanaatattgaataactcccataactcttttttacatttttatgtttaagaaatttatattttcccgtcgaagagtttttttct

SEQ ID NO: 14908 - DNA, 969 bp, Diabrotica virgifera
  misc_feature (462)..(482): n is a, c, g, or t
  misc_feature (715)..(749): n is a, c, g, or t
gaagaaacgaacacaaaagcaaggatgaaaagcaaggctgacatgcgtctttgcgttacgtgcaaatgctacatgcatgatgaatgcctgcgacttacaaaagacgacataattgcagcatacatatgtccttattgtttataagtatcgttaataaaacatgtttggtgtaaaatttatttaattacccatttccattccatattccatattaaaaataaacctatgctaaaatgtaacgcctggcgatattgacaacaggggttgacaatatcgccatttaacgttatttttaaaaaggccctaattaattagtgatcattaggataatcaaattaagaggtcatcatttgttggtatatagtataggccataaaatgacgacttgtcgttttctttgttttacagtggcgacgcgtgactttttctaaagtgttaccaaaaccagatgtaaaaaatccnnnnnnnnnnnnnnnnnnnnncctcccaggtataagtttttgttttcaatcctgtgggataaaattaaacaaatcactattcccaaattatatgtatgtaattatgtatatgtaacaagtataacaataaataataaacaaactaaacatattattctaccataaaattaacataaaaaatgaacaggtaggaaaaagaacagatgttgaaaactattgtttatattttaattcttccattttcaataatatcnnnnnnnnnnnnnnnnnnnnnnnnnnnnnnnnnnngtaaaaagtagaatgacttttcaagtagttgatcaattacgcaatacgtagcaacactcttcaatgtttaaatgcacacactgtaatctgtaataggtactaaacatactaaaccaaacgttttaccaatcttcaaaaatggtaacaatactgatatgcaccgcgtgcccgcgcgccgtctcaaaaaccccgtcgttcttcaaaatttttcaaagctaat

SEQ ID NO: 14909 - DNA, 98 bp, Diabrotica virgifera
  misc_feature (8)..(8): n is a, c, g, or t
  misc_feature (15)..(80): n is a, c, g, or t
  misc_feature (88)..(88): n is a, c, g, or t
atttattntaattgnnnnnnnnnnnnnnnnnnnnnnnnnnnnnnnnnnnnnnnnnnnnnnnnnnnnnnnnnnnnnnnnnngatccaanttttttttga

SEQ ID NO: 14910 - DNA, 415 bp, Diabrotica virgifera
cgggaacatatgtgcaattaataagtagtggtacattttttacattaagtacataatgcctgattggtctaagacaatgtattcatacttaatgtaaaaaatgtgcaattaataagtagtggtacagttctgatcagtgttaataaaaatactctataattttttgaatgaaagttttgatccctagaactaaacttaaatatatattgttcatttcaaatcaaatgtggtaaacgacttttaaaatatatgtaaaggtaagcgactaaatactccttaatccatttatatttaatgttacgataagtataaatatgtaacaatttatatttaactaaaacaaaatgggcgacagctcaaacattgtttgcaatgccagagtacaagatttatgtagccgataatataataatag

SEQ ID NO: 14911 - DNA, 713 bp, Diabrotica virgifera
attatccagtgtctgcccgaccatccctcatgatgttctcatccgagaattgaaagaaatgggcctaaacctcgtctcccccataacctttttaagaatcggtgcttctttacctgaatacaaccacataaaaagcttcagaagacaagtatttgtcagcccacatagtatcatgattccagattctattttaataaattacgaaagcgtcacctacagaattttcatagctcaagataatcttacatgctacgcatgtaagcaaacaggccatatatcaagcaaatgcccaaacaccaacaatacactatcccccactcaagcccaaaactcaacttcacagaaccctacttcaacgctaatctcccactccgccaccgataatggttcccagtcacatcaagctgaagacggtgatccaaacaacataaatattcaaaaaccttcttcaatttcttctactcctcaaaccctactgccaacttctgaagcgagcaaaataattcccaccgaagagaacattcccactaaaaatccatgtgaaaaaacctctgaagtaatggatcaacaagcttcactcggaatcataggagaatcatccagtacatctgtgaaaagaagtattgacgaaacgttatcccctcccatcgaaaatctgaatactaataatccaacgtttgctctccctcaaacaccacgtcaaaccaacatcc

SEQ ID NO: 14912 - DNA, 198 bp, Diabrotica virgifera
  misc_feature (7)..(44): n is a, c, g, or t
  misc_feature (63)..(76): n is a, c, g, or t
  misc_feature (79)..(101): n is a, c, g, or t
  misc_feature (109)..(131): n is a, c, g, or t
  misc_feature (161)..(192): n is a, c, g, or t
taacagnnnnnnnnnnnnnnnnnnnnnnnnnnnnnnnnnnnnnntgcgacctcgatttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 14913 - DNA, 156 bp, Diabrotica virgifera
  misc_feature (68)..(69): n is a, c, g, or t
  misc_feature (81)..(81): n is a, c, g, or t
  misc_feature (113)..(113): n is a, c, g, or t
  misc_feature (115)..(115): n is a, c, g, or t
  misc_feature (120)..(149): n is a, c, g, or t
aatgaaatatcttgcagtttttgtgaggtttgcgtatttatacgcagtttttttactaaaaagaaggnnagaagagaattngaggagaggagggggggggaaaagaaagggananagagnnnnnnnnnnnnnnnnnnnnnnnnnnnnnnggaaagg

SEQ ID NO: 14914 - DNA, 859 bp, Diabrotica virgifera
  misc_feature (21)..(38): n is a, c, g, or t
  misc_feature (682)..(708): n is a, c, g, or t
  misc_feature (762)..(818): n is a, c, g, or t
  misc_feature (846)..(858): n is a, c, g, or t
tccctggcgtccggttttcannnnnnnnnnnnnnnnnngtctttggaggaccttgccgaagcatcgcagacaacaaatattaaactattggaagggataatagtcgccgctgagacgttaggtggagaagttatttttttctctatatcaggtgtcatcttagaacgttttggacacgtccactgcttcagcatgtgcttcattaactatgctctacgcttgggattactatctgtagctcctagtccatggtgggtggttccgatagagttcatttttcaaggaccaacgtatgctcttacttatacaacaatagtggcgtatgccaacgaattagcaccacctggagcctctgctaccatgcaaggaatagctgctggaatggacgatggatttggttatgctattggtagtcttttgggaggaactctatacaaatactttggaggaaaaccaactatacaaatttttagtttcatcgctgtcatctgcagtattttacatttggttctgcacaaaaccattcttaaagatggagagtctgcggattcttcagtggagtacaaatcaccagaagatgcaattaaaataaagttagagaaagaaagtgactgaataaattagtttttaaaattgtatatatgtaatattagaataggcattacattgtaaataatagggnnnnnnnnnnnnnnnnnnnnnnnnnnngttatacctttgtataaatgataaatatgcaattgtaaagatatggttgtttgnnnnnnnnnnnnnnnnnnnnnnnnnnnnnnnnnnnnnnnnnnnnnnnnnnnnnnnnnctatattaacaaactaacaagaccaacnnnnnnnnnnnnng

SEQ ID NO: 14915 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14916 - DNA, 65 bp, Diabrotica virgifera
  misc_feature (16)..(44): n is a, c, g, or t
tttaataagcgtccgnnnnnnnnnnnnnnnnnnnnnnnnnnnnnctaaattttgtaatgatatgt

SEQ ID NO: 14917 - DNA, 917 bp, Diabrotica virgifera
  misc_feature (4)..(35): n is a, c, g, or t
  misc_feature (182)..(199): n is a, c, g, or t
gggnnnnnnnnnnnnnnnnnnnnnnnnnnnnnnnngtgtttgtgtgttgggggtggtgtttgtggtttttatgttgtttttgttgtgttgtgtgggtggtggtgtgtgttgttgttgttgtggggtgggttttttggttggtttttttgtggtgttggtgtggtgggttttggttttgtgtnnnnnnnnnnnnnnnnnntggtgttgttttttggttgtgtgtttttgttttggtattttgtttttgtttgtgtttgttgttttttgggtttgaggtgtgggtttttattgtgttttggtttggtttttgtttgtatgtgtgggtttgtttttttgttgtgtttggggtgtgttgttgttttttttgtgtttgtggtggtgttgttttgtatggtgtttggtgtttggttgtaggtttgatttgtgtttttgtttgttgaggtgtgtttgttttgtggtttggattgttgggtttttgtgtgggggtgtttgggtttggtttgggggtttgggagggtgtgttgtgtgggggttgttttttggttgtgtttgtggtggggggtggggggtgtggggggttgggtgtttgatgtgtgtggggtgtggtttgtttgtatgttgtttgggtggtttgtttgttgggttttttgtgttgtgggtttggtttgaaggggttggtttggttgggttttggtggttttttgtttgtttgagggtttttgtttttttggattgggggggtgtaggtttttggtggtgtgatatgagggtttgggttgttttttttggggggggtttgtagtggtttttttgggttgttttttgggtgttgtcggtggtgttgtttttttggggggttgtttggttttttgtgttgtgtttttggtgtgtgtttggttttgggtgagggttttttt

SEQ ID NO: 14918 - DNA, 492 bp, Diabrotica virgifera
  misc_feature (20)..(42): n is a, c, g, or t
  misc_feature (233)..(306): n is a, c, g, or t
  misc_feature (311)..(376): n is a, c, g, or t
  misc_feature (394)..(412): n is a, c, g, or t
  misc_feature (421)..(435): n is a, c, g, or t
  misc_feature (437)..(453): n is a, c, g, or t
  misc_feature (456)..(474): n is a, c, g, or t
catttttggtcctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagctttc

SEQ ID NO: 14919 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14920 - DNA, 887 bp, Diabrotica virgifera
  misc_feature (45)..(816): n is a, c, g, or t
tgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagacttcaaaaaccccaactccgacaaaagcaaatggatcactcctgaccaacttcttgacctctac

SEQ ID NO: 14921 - DNA, 916 bp, Diabrotica virgifera
cttcacgcgtccgggatgatgcttttgtaacagaaatagtgcatacaataaatataacagatgaaaggagagaggaatttatagctgaaactaaacaggataaaaaacttcaattgatcaaagatttttgtgaaaaagggtggccgtcatgctcttcgagggtaccttatgtagtaaaagattattttagtattaggcatgacatctacatattgaatgatttgatattttatatggacagagttatagtcccggattctttaaggcctaggatgttaaagtttcttcatgaaacacactttggagttacaaagacacagcaaagagcaaggcaagtgttgttctggccaaatatgaataaggacatagtggatttggttagaaattgtgttgattgtgagaaatatcacagaagtaatgttaaagagccattaatactaagagaaattccagaacttccatttcaaatgctagcggctgatatttgtgagttcggaggagcatcttatttaattgtaatggattatctcacaaagtggattgaaattgttctgttgccgtccaaaacatcccagtcaataataaaatcatttaagaccatgtttgccactcatgggattcctttggaaattgtatctgacaatatgccttttggctctaaggaatgtagagaattctctagagaatggaattttaaatttgtgacatctagccctagatatcctagatcaaatgggcaggcggaacgagctgttcagatagctaaaaatattctcagaaagtgtggtgatcttcagttagctttattagaatataggaacacaccactgttaggatcagacaagtccccagcacaactcttgaatagtcgtagacttagaaagcaacttccagtcttacatgaaaaatatttacc

SEQ ID NO: 14922 - DNA, 969 bp, Diabrotica virgifera
  misc_feature (102)..(119): n is a, c, g, or t
  misc_feature (177)..(196): n is a, c, g, or t
  misc_feature (807)..(807): n is a, c, g, or t
  misc_feature (829)..(889): n is a, c, g, or t
  misc_feature (891)..(952): n is a, c, g, or t
cggacgcgtgggaaagtttacaaaaatgagtgtctgtgataaaaacgttaatgttgatgagtgtacagaaatcgtaagaaaaaagataaaagatgtcaagcnnnnnnnnnnnnnnnnnnctgatgatatttatatacaaagatttctgtatagtactggttgtttagatacagaagnnnnnnnnnnnnnnnnnnnnctataccacgaaacaatagtaaaaatacccgactattatcccaaactaggccctaaagatataaaggatgtcttagatatgaatttctcagtagttttagacgattgtgataaggaagggagaccaatttattatgaaaaaatggagagacttgatccagcaagattaacttctatggacgtaatcgcagctgaagaaatttggttcgaatatatcttaagcagacatcctggaaaagcgggaaaaggcttatgtatgcttgttgattccagtggatatagctggaaactttttaaatggttaacgccaagtgctctatctaatggaagacgtaaaatagacgctataccttttaaggaaatacaggtgcatattgttaatcattcccttatggtggatgtagcacttaaattagcgtggccatttgttccagaagaacgaaagaaaacggtacactgctattttaacaattatgaaactttatttgagcatatagataaaagtgtgcttcctgcagagtatggtggcgaaaacgaagttaactttacaaaacttactcaaaaactttatgatagaaatgaagaaattcaagaaattttcagctgtacaanaatgttattaaactataaatannnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnngaaaaaaatcggggggg

SEQ ID NO: 14923 - DNA, 1025 bp, Diabrotica virgifera
  misc_feature (282)..(326): n is a, c, g, or t
  misc_feature (328)..(343): n is a, c, g, or t
  misc_feature (352)..(425): n is a, c, g, or t
  misc_feature (427)..(527): n is a, c, g, or t
  misc_feature (529)..(587): n is a, c, g, or t
  misc_feature (599)..(634): n is a, c, g, or t
  misc_feature (636)..(649): n is a, c, g, or t
  misc_feature (655)..(673): n is a, c, g, or t
  misc_feature (675)..(689): n is a, c, g, or t
  misc_feature (691)..(706): n is a, c, g, or t
  misc_feature (708)..(723): n is a, c, g, or t
  misc_feature (725)..(759): n is a, c, g, or t
  misc_feature (761)..(789): n is a, c, g, or t
  misc_feature (791)..(812): n is a, c, g, or t
  misc_feature (815)..(830): n is a, c, g, or t
  misc_feature (849)..(863): n is a, c, g, or t
  misc_feature (865)..(914): n is a, c, g, or t
  misc_feature (920)..(979): n is a, c, g, or t
  misc_feature (983)..(1015): n is a, c, g, or t
ggttttatgtttcagcttaaatgtggtccatttaacgtagctaaatgagtagcattatcctataaaggagttcttcaactcttgcaacggtaagaatcgatgaaatacaaaatggaagaactgattaagaagaatgtgaaggtatatgggcagtttcaggtaaaatcctttgtggatccgaatgaattatataatgtaggtttaagacaaggatgtgaaagtgagtgatatactttgtttggaatggaatgttattcgtttttacatatattcaatttttgnnnnnnnnnnnnnnnnnnnnnnnnnnnnnnnnnnnnnnnnnnnnngnnnnnnnnnnnnnnnnatattaagnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnngggaattcgggnnnnnnnnnnnnnnnnnnnnnnnnnnnnnnnnnnnncnnnnnnnnnnnnnngaagannnnnnnnnnnnnnnnnnntnnnnnnnnnnnnnnngnnnnnnnnnnnnnnnntnnnnnnnnnnnnnnnncnnnnnnnnnnnnnnnnnnnnnnnnnnnnnnnnnnntnnnnnnnnnnnnnnnnnnnnnnnnnnnnncnnnnnnnnnnnnnnnnnnnnnnctnnnnnnnnnnnnnnnncgaaggaccctattgaggnnnnnnnnnnnnnnncnnnnnnnnnnnnnnnnnnnnnnnnnnnnnnnnnnnnnnnnnnnnnnnnnncggggnnnnnnnnnnnnnnnnnnnnnnnnnnnnnnnnnnnnnnnnnnnnnnnnnnnnnnnnnnnngaannnnnnnnnnnnnnnnnnnnnnnnnnnnnnnnnttctgggaaa

SEQ ID NO: 14924 - DNA, 949 bp, Diabrotica virgifera
  misc_feature (238)..(261): n is a, c, g, or t
  misc_feature (919)..(919): n is a, c, g, or t
cggacgcgtgggtttgaaactagtttcattgttttgtagttttgcccgcattcttgttcattaatcatgatcattaatttattatagtttattgttcatattttgtattttttatacctaaacattgtaaacacagcacatgcacgttcgtgcacattcccccagattaattatttatctgtgattgtaattactgtaggaattgggaatgttaaggtggaaaagtgaagaacattcnnnnnnnnnnnnnnnnnnnnnnnnacacaatacacaatattatgtaaaacggatcatcatcttggatttcaaataaacactgtattgtactgggaccactaccacatgttttattaccattgaatcaatgtactaaatgattttgtaaatttccaatatattgattcagtttatatgtcagctatggattttaaagttgaaattaaggatgagcctgtcgaatatatccaaaaggatacagagagccagctatccacatccatagatctggaaaacttcaaaaatgaaaaagaagataaatcagaaatgggactaaaagctgaaatcaaggaagagttttcagacggttatcagatagatgatcagctatttacatccccagatcttaaagacttggttaaagccgatgaaaataactcaggattttctcagaacggaatggaaatcgtgaaaactgaacttacatgcactacagaacaacaaataagtgcaaacactgaagaaacaacatcaagaaattctatttgtgaatgtaaaatttgttttaagcaatttagtcaggcaggttctttgaaacaacatataaaaacgcacaatgcagaaaagcgttacaagtgtgaaaatttgtttaagcagttttctcaaaaacaaaatttaagattcatttaagattgcacactgnggaaacgcccctatagtgtgaaatttgttt

SEQ ID NO: 14925 - DNA, 422 bp, Diabrotica virgifera
  misc_feature (7)..(25): n is a, c, g, or t
ttcccgnnnnnnnnnnnnnnnnnnnggacgaaaggagtttacacgtgagccatcctgttctttggagatgtgttggataaagtgatatagggtgtcactcgctgtagactgcgacatgatgaaatatttcctcactaaatagttgtcccccgacacacgagaaacaagcgagattccatacgcacggataaagatgctattgtaataatcatgcgtcatcaagtatatcgatcatgctcagggagacaaggccatgacagtagcgtattgatgcgggtagcatatggaggaagttgagaaggcacaaagggaagaaaaactcactacacccataatgtttaagcaagctcagggcattaccttgagctacacagatgaatactaggaactccacgaagatgcaggataaaaaaatatgcaat

SEQ ID NO: 14926 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14927 - DNA, 172 bp, Diabrotica virgifera
  misc_feature (4)..(164): n is a, c, g, or t
attnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 14928 - DNA, 732 bp, Diabrotica virgifera
  misc_feature (2)..(15): n is a, c, g, or t
  misc_feature (20)..(533): n is a, c, g, or t
  misc_feature (540)..(577): n is a, c, g, or t
  misc_feature (597)..(610): n is a, c, g, or t
  misc_feature (613)..(635): n is a, c, g, or t
  misc_feature (643)..(665): n is a, c, g, or t
  misc_feature (695)..(726): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 14929 - DNA, 969 bp, Diabrotica virgifera
ctttgtggccctgaagtccacccactgaagtatcagaatagatgagaaatctactgaatttcttcagcgttcttctcgtgctgcattgttattcagtcgtactaggtgagccttcttattacagacagttcagggtgctaggagattatccgtaccaaacctactacggaaacccttatgctgatcatccctacagatatgccagtaatagtgacgtttacataaccgacagatatggaagaacttcactacgatctggagacagttatagaggtttacaatcatcactaacactgattgtgacagtaaaagctggaaattctattttaaaaaaatatgacagattctaaatggtatttcgcagagtttaattattcgtgataataattcatgtcttcttcttcttaatcgttaacttgatgcaggtatcgtcagtggcgtaacaaactccgtcggggccctcccgcagaattggaaatggggccccttttaaaaaattactaaatgcgactagtgtaacaaaaacttatatagcccagaaaatttagttcctactcttcaacaacctgtacatccggtacatgtggacaaaatgcacaatgccaagtagtaggaggacgacctgtgtgttcgtgtcttagaggtcattctggagatcctctttcattatgtagaagggaagaatgcctggatgacggtgaatgcagaggtcaattagcgtgcagaggtggcaaatgtattgacccatgtgttggtacatgtggcgttaatgctaactgtgaagcaagaagaggagtacccgtttgtacctgtcctgctggatatactggagatcctattaccagctgtagaagatttaatcccgaggaactttgtcatccaagtcccttgcggccaaacacccattgtgaagtgaaaaacgaagtacccacttgctcttgcctaccaggattccacggatccccactg

SEQ ID NO: 14930 - DNA, 911 bp, Diabrotica virgifera
  misc_feature (718)..(741): n is a, c, g, or t
  misc_feature (860)..(860): n is a, c, g, or t
  misc_feature (880)..(880): n is a, c, g, or t
agaaatactaaaaagactagaggcgataggaagaaagaaagtaaacataaacataaacgaagaaaagactaaatatatggaatggacagaacgagaatacacacaaggacaatatctgacaataaacacaagcaaaaatatatacattcgaagaagtagagagattccaatatctaggagcgacattctcctgagaccaaatataaaagaagaaatgcaaacaccctgtatataagacagtgataagacctataggattgtatgccagtgaaacatggacgatgagcaaatccgggcaagtcttgcttatagtgtgggaaagaaaagtcataaaaaatatttggcggaaagatatggaatggaatgtggataagaagaccaaatgtagaactggagaggatgtatggtgaaccaaacatagtagggatcataaaatcacaaataagatggttgggacatatccaaaggataccaaacacgagacttcccaaaagaatactaacgggaggaataggagaaagaagaggaaaggtagaccgaaaaccagatggaagaaagatgttgaaaaatacatagaagaactgaaaatcacaaattggaaaaataatgcagcaaataggagagattggaaaggaatagtaaaccaagccatgggccttctaggcctggagagctaaactatatatgattttaactatttataatgggaaataagccnnnnnnnnnnnnnnnnnnnnnnnntattaacgtttcgaggttaatatcgaggcaaatcgggtgccgttgtcgaaatacaaaatactactaacataaacaaaactgttgttgcttagtaaaaaaaaatcttctcataatttatntaatttgactcatttatatncggcaattcagatacatatgatacattttaa

SEQ ID NO: 14931 - DNA, 583 bp, Diabrotica virgifera
gcttattagctgaacaaataggacatcttttctttagacataactaagactttactgattgatccactgccagtgatgggcgggggatgacctggatggaagagaagttccttccatctagattgctgacacggatcagtgcatgactcgagtagacaatataattacggataccaacagctaatgtagcaactgaaccagacttattgtaatgagatctctaactaaactttgttgttcgtaatgcagtgcaatagaagcaggagtataactcaactttagtaccgaatggacaaaataatgcatctaaatgtatctatacgacaacggaaatatactgatttttatattgtttattatactatagtaagatggtaggactagacttgctttcatgatcagatttgtacccagatactacgagcgcgacatcagattacctacctgtgctgtagtcaaacattgctcatatacatccttagttgccggaaatctcagatcaacattacaatggagaattgatgacatttaaccctgtaacctataatgagacttacctgttgatgtatctggaaattatata

SEQ ID NO: 14932 - DNA, 947 bp, Diabrotica virgifera
  misc_feature (5)..(28): n is a, c, g, or t
  misc_feature (30)..(837): n is a, c, g, or t
  misc_feature (844)..(881): n is a, c, g, or t
  misc_feature (918)..(940): n is a, c, g, or t
atttnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgaactcgatgttggataaaagtttataattgggnnnnnnnnnnnnnnnnnnnnnnntgttcca

SEQ ID NO: 14933 - DNA, 927 bp, Diabrotica virgifera
  misc_feature (64)..(84): n is a, c, g, or t
  misc_feature (86)..(98): n is a, c, g, or t
  misc_feature (179)..(191): n is a, c, g, or t
  misc_feature (193)..(216): n is a, c, g, or t
  misc_feature (238)..(266): n is a, c, g, or t
  misc_feature (389)..(410): n is a, c, g, or t
  misc_feature (511)..(529): n is a, c, g, or t
  misc_feature (788)..(788): n is a, c, g, or t
  misc_feature (912)..(913): n is a, c, g, or t
ccgtatacctacatttttgcaatgttgattgaaaagcccggtcagtgaacacaaaattttgccnnnnnnnnnnnnnnnnnnnnncnnnnnnnnnnnnntgggaatagatagttgaaagtgtttattaaaacaaattacaatccgaaagtatatttttccatatattttgctgtattttnnnnnnnnnnnnncnnnnnnnnnnnnnnnnnnnnnnnnatcggcattattttactataannnnnnnnnnnnnnnnnnnnnnnnnnnnncttcagtattttgtcatctttcatgtacttacctatccccaaatttctatccttgattttttttttgccttagtgttctttgattggacttaatattcttgcatataaaaatacgtttcttcnnnnnnnnnnnnnnnnnnnnnnctttccaaaagggaagatttttgtctgaaaaattgtttgacgtcgtttgttatactcctgcctctataatgtccacgtgtgtacattttgttaaacgaagnnnnnnnnnnnnnnnnnnngtactattttgtgtacccatttctacttaatacgtgacaaacgttgatcgaatcttggtatgactagaattttacaataattccgtattctattatcacttcatgaaataagatcatttataattattaccaaaatgtttaccatgagaaaagtacttacgcttgtgtaaatgattacaattactcacatttattcagttgacaataacatattgttacgacagtttcgtatttaggacaacttcttcattttcaatanataaaattttattttgaagatatatgataaatttattctgcataatatccatcccaagaacgcattcatctatcggctacaagaaatagatgttttatcaaggtgtttcccatcttttatggtnngcgtacttctcatg

SEQ ID NO: 14934 - DNA, 115 bp, Diabrotica virgifera
  misc_feature (2)..(114): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 14935 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (161)..(191): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttggttnnnnnnnnnnnnnnnnnnnnnnnnnnnnnnngaaaggac

SEQ ID NO: 14936 - DNA, 915 bp, Diabrotica virgifera
  misc_feature (331)..(348): n is a, c, g, or t
ttttccaaagaaagttagcaaataatagagatcaaaagatatcttgcatcaaaaatcttaaaattgaatagatttttaaggcgtttaatgggattgatcgatgatgagcttacagaagtcagaaaattgtgcgaacatgtcgtcccaggaactaaacttgtgtcttgtgtcaggacaatggttcgagcagaaataaaaaggaccgattttaagaaaattgtcgtctgtattcaattcccgactgattatcccaaagtacctctactcattgaattaaaaagtaaaactttatctgaaaagttactacaaaaattgactgatgtctgtgagnnnnnnnnnnnnnnnnnnttggggaaacctcaagtacttaatactatcaaatttttgcgaaattttattgatgagaatgcactttcttgctgttatgatgaaataactaacataagaaaattacttcagtctgaagacgaaatcaagttaaagcagaaaagctcatcaattacattaaagatcaataactcaaagtactttttagtctgtaaagtttttattccagatgattatcccataagtgctattggaattcaagaggctgacactaacttctcgccagctctccaatgtcatatgttagcacaggcaaaggaaattgctaggaagtgtgtggagccaccattacacaaaagacccaatcagcctcctttccaaccaggcccatctctgcaaaagtctattgaatttttgatagattgtgtcaagaggttaccaggagagacttgtcagttttgtaataagatttgttttcctcctaatccagagcaattagaaaaagatgaaaattcaccaaaacacattgagaggatatattgtggccatttgtttcaccagattgttttttcgattacatgaaacgac

SEQ ID NO: 14937 - DNA, 908 bp, Diabrotica virgifera
  misc_feature (96)..(124): n is a, c, g, or t
  misc_feature (135)..(157): n is a, c, g, or t
  misc_feature (567)..(622): n is a, c, g, or t
cgaaggttggaaatcatcaaggctcttatgaggaggctcttttcttccttccgcatttcgtttcttcgaattctgtgttacataataagttaaagnnnnnnnnnnnnnnnnnnnnnnnnnnnnnactttattgcnnnnnnnnnnnnnnnnnnnnnnnctagacaaacagtaataattataataaagcaaaaggcgacgttcgctcttagatgatgttcctagaaacaccagctaagaagcgctcttccacgtaaccgcaatacaaataattactattctagtgtaacctaaagacctatttacatgctaaaataaatttatcgtatatgataataactaattatctatttttattgaataaatttttattgaataaactttgcaatcatttaaacgaatgtagccaaatttactggtttataatctaaattttaattttatgctattattaaatagagacttttttacgttggatttaaattgagagatgggtaaagttttgaaattttcagggatcatattgtacagattagcaatattgtaagagaagcaagatcgaaataacgnnnnnnnnnnnnnnnnnnnnnnnnnnnnnnnnnnnnnnnnnnnnnnnnnnnnnnnnacttctgaccaaatttttggtggatcgatttttttgcacggcgggtattacggtactaaatgtaaatagataaatgtataatctaatgtccaataattcaagtaacacagcaaagcaaagaaaataaccaaaagaatggttaccatctggaataaccactggaaccaatgcttcatatggaattactactttcatatatctgtaaattttattatcatgtttttatagtacagttatttcttattttcttgtctatatccgtgtaaatagaaaccaaaactttacc

SEQ ID NO: 14938 - DNA, 970 bp, Diabrotica virgifera
  misc_feature (802)..(802): n is a, c, g, or t
acttatacatatttctgcaactattgtcagatacatcttagtatctcattttaaacacttattgacttacaccggttgacttctgaggtatcgatatatatacacaatacgtcatatgtcatcgatcatacgtcatacaattgatgtcatacgccatttattgatcaagtgttcgaaaaagaaaatggtggcaatgaattgccctatatttgttaaaactagtcccatgaaatggaaacaagttggattttttgtaggaacttggagaagtaaaacgtgaacgtagacttgtatatttttagaaaactttaaaagaagcttggtaaagctacaacgcggtttatttaggcatattatgaagtaacctttttttttgtattctccctttcctgcgtatttcacattgatatacattgaaatgatgataaacttaccgtgttaaggtcagctgcaattcaggagctagttaacctagtcaaaacgaagacgaataaagtcaaaatttaaataaaatatcgaataagccatttaccgaaagattaaataattgttgagaatattcaacaaatgtttagggtaagctagaagaaagcaatggatatattattaatgaacagaaaaccaaacagcgggagctaaaatttgatttatacacagaacaaatctaaatataacgtatacaacaagcagaaaaaacgagtgggacattagaaacatttcaagtcacgaaatatgcagcaatgaaaggaaaatggagagacaacaaaaaggccaattcctaatatcacgattgttgtattanattaccgaaaaatatattctctattcacttatttttccttcatgagctaccgtgttgacaaaatcctaatgtaaatttttaagagcggctatcctgtagtaaaaatggcttagatagttagctaaatccttatattttaaacatttttaaaagttttggttggggggc

SEQ ID NO: 14939 - DNA, 745 bp, Diabrotica virgifera
  misc_feature (52)..(75): n is a, c, g, or t
  misc_feature (83)..(100): n is a, c, g, or t
  misc_feature (103)..(119): n is a, c, g, or t
  misc_feature (153)..(224): n is a, c, g, or t
  misc_feature (272)..(336): n is a, c, g, or t
  misc_feature (338)..(355): n is a, c, g, or t
  misc_feature (381)..(409): n is a, c, g, or t
  misc_feature (453)..(510): n is a, c, g, or t
  misc_feature (512)..(537): n is a, c, g, or t
aacagcgtaattttattggagagttcacatcgataatatagctgctacaccnnnnnnnnnnnnnnnnnnnnnnnngagaaaannnnnnnnnnnnnnnnnnccnnnnnnnnnnnnnnnnngagaatgatttatgatttgaatcttgtggattannnnnnnnnnnnnnnnnnnnnnnnnnnnnnnnnnnnnnnnnnnnnnnnnnnnnnnnnnnnnnnnnnnnnnnngaaatataaatatgatacataatttttttgtaatagaaatgttattcnnnnnnnnnnnnnnnnnnnnnnnnnnnnnnnnnnnnnnnnnnnnnnnnnnnnnnnnnnnnnnnnngnnnnnnnnnnnnnnnnnnggatgatctaatatttataaggatgnnnnnnnnnnnnnnnnnnnnnnnnnnnnngattttcaattttcaaataggataaaaaattttcatatataagnnnnnnnnnnnnnnnnnnnnnnnnnnnnnnnnnnnnnnnnnnnnnnnnnnnnnnnnnncnnnnnnnnnnnnnnnnnnnnnnnnnngagttatgaaaataatattagaattaaaatattgaattgtgattagggaattataggatgaatatgagaattcggcaataattatttctcttgtttattaaaatccagaatttaagcagtaaaaataatgtctcgcctgaccactgactagagagaatgctcgcggcatttggaccgtgcttcggttacttaatgattaattgaatga

SEQ ID NO: 14940 - DNA, 856 bp, Diabrotica virgifera
  misc_feature (14)..(50): n is a, c, g, or t
  misc_feature (54)..(143): n is a, c, g, or t
  misc_feature (152)..(189): n is a, c, g, or t
  misc_feature (191)..(540): n is a, c, g, or t
  misc_feature (542)..(612): n is a, c, g, or t
  misc_feature (615)..(615): n is a, c, g, or t
  misc_feature (626)..(626): n is a, c, g, or t
  misc_feature (641)..(641): n is a, c, g, or t
  misc_feature (646)..(764): n is a, c, g, or t
  misc_feature (766)..(855): n is a, c, g, or t
ttaaatggggtggnnnnnnnnnnnnnnnnnnnnnnnnnnnnnnnnnnnnngtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtatnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnaanatttttttcanctgtttattaaaaanatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 14941 - DNA, 741 bp, Diabrotica virgifera
  misc_feature (46)..(67): n is a, c, g, or t
  misc_feature (222)..(256): n is a, c, g, or t
tcctatttcactatagtgtttacaatccgaggcaaagacattaccnnnnnnnnnnnnnnnnnnnnnntggttcacaaaagttcctaacctttgcttggtgaatatcactaaaaacctatatttcacagaaatttaagaccgaattatggtgatattatcttaaaatgctatatttaagcagaaaaagcagcagattaagaaaaatttcaactttagaggaannnnnnnnnnnnnnnnnnnnnnnnnnnnnnnnnnntctttgtttacaaataactatatgacagtcgtgacgtcacacttctgctgtcagtcttgtgtttaactaattttgtaatactaacgacaaacttttaccatatctgtataaattaaaaaccataatattgattttataatatgtatccattaagatagtatatcggtaattaaacagaatagacatatacaccacatctacacatagctcttatttctactggtattgtatactaaaactttttgtttgtttttacatcttttataaacatactgtatacttgtttgtagctcatcgtgttctattagaacttgattctctttaggaaaaaccaaaaaaaatgtatttaagtattatcactagtcttgtacaatttctttgtttacctacatcgaaagtgtgttattttatttatttttgcagttattagtttaatgcgattgttatataattttggttaataaatatttcactttctgcatttt

SEQ ID NO: 14942 - DNA, 1089 bp, Diabrotica virgifera
  misc_feature (415)..(715): n is a, c, g, or t
  misc_feature (717)..(776): n is a, c, g, or t
  misc_feature (837)..(872): n is a, c, g, or t
  misc_feature (883)..(902): n is a, c, g, or t
  misc_feature (969)..(1001): n is a, c, g, or t
  misc_feature (1012)..(1029): n is a, c, g, or t
  misc_feature (1032)..(1076): n is a, c, g, or t
cccttcacgcgtccgagaataccttactgttagaatttaggactgttatctatgcatcttgggcctggcgtataatcaatgaatagaaaggtgaaccgtaatttataagaatgacgagtctccgatgaggagcatatttcctatccgtgaatatatcttgatatattgctgaaatattggaatattacggcattcataataacatacttatcttctgttttgataattatatctgccatcatttaggactcttgttcttctataacacctggaatatcctcatatgagataggttgaaggaggacccattacatattatgttattaactaccgaactctacttaagacttctgattccaagtgaatcatcactgtattgatatgcatatctactgtactttctatagtatcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnacgataagaccctaatgggatatatgaaaatgaatagtacggttgtataaaaaaactttcnnnnnnnnnnnnnnnnnnnnnnnnnnnnnnnnnnnngtaaaaaagcnnnnnnnnnnnnnnnnnnnncgaggaagacccttataaaggttttataacatttattaaataacctctttttagggatttaaactcnnnnnnnnnnnnnnnnnnnnnnnnnnnnnnnnnccgggcgattnnnnnnnnnnnnnnnnnnacnnnnnnnnnnnnnnnnnnnnnnnnnnnnnnnnnnnnnnnnnnnnnccccatttttttt

SEQ ID NO: 14943 - DNA, 986 bp, Diabrotica virgifera
  misc_feature (536)..(536): n is a, c, g, or t
gttattccttctgggtgtattttggagtgctatcgattcatttttgccctggcatatagtcaatgaagagaatggggaaccgttagttataggaatgacggtcaccgtgggagctattccagccgtgatattcttgatatttgctgaaatatttgtagattactgcggccataataacattcttatcttctgttttgttaattatatctgccatcatttaggtctcatgttcttcgataacgcctggtatatcctcatttgtgaatggttggaagtgttcacattacatattatgtacataactaccgtactctacttaagacatctggttccaaggaaattcactgcttgcggacaagcactgccaatcattgctcacttttgtttaggtcgttgtattggagttgtattgggaggactggccttttctgacttcaactcagaatatgtgttccagaacgttcacaaatacttctgcgttgccgctgtagtagtggcgataatttatttctgtttgtaccatttctacctgaaangcctactgcattccccccgtacatttgcccccggcccctgccccagctcttatacaaagtatgaatggcaacggagcttacacacccctcagagtttaccacaacagcaaatcaaagaaaggccactttagatattaattaattctaaacatgtactaaccaaaatcagctttacatatttttgtaagaatatttttgaatctcaattctaagctttttgtacctcgtacaaacttatttttacggcaactgttgtcataatctaagtgacagatagtaattgacttatgtaattcttacgagagttggtaaatgttcaatatattttgagggtagctttaggtatcttgttatttattttagaaggaaacatatatttttgtgccactatgtaatctaccaattctgatttatatagttttgtctagtttatttctgtttacatctaaa

SEQ ID NO: 14944 - DNA, 856 bp, Diabrotica virgifera
  misc_feature (8)..(26): n is a, c, g, or t
  misc_feature (114)..(131): n is a, c, g, or t
  misc_feature (163)..(180): n is a, c, g, or t
  misc_feature (183)..(203): n is a, c, g, or t
  misc_feature (608)..(608): n is a, c, g, or t
  misc_feature (663)..(698): n is a, c, g, or t
  misc_feature (709)..(746): n is a, c, g, or t
  misc_feature (778)..(795): n is a, c, g, or t
  misc_feature (800)..(821): n is a, c, g, or t
tgtgggtnnnnnnnnnnnnnnnnnnngttttggggggtgggggggttggggcggggggttggggtcgggtggggcgcggggtggggtgggtgggggggtggggtggtggggatnnnnnnnnnnnnnnnnnntttgtttggcagggtgggtgggagggtggttnnnnnnnnnnnnnnnnnntcnnnnnnnnnnnnnnnnnnnnntggctggtgtttgtttgccgggcggggtgggtgatgatgggggatggggtgtgtggagatgggcgatgggggtaggaggaatggaggtagggggaaggctggtctggtaggtagtggtggtggtgggggattgggggcaaggtagagagtaggagaggttatgggtgtcggtgaggagggggagggcatggggttgggtgggagtggggggtttggggggggaacggtggagggttgggaggggggttgtgggctttgagggaggggtggggtagggggggtgggaggagggggtgaaaggaggggtggggggggcgggtttgggaggggggtcggtggaggggtttggggggggttagggggggggtaatgttgggttggtgggtggggtgtgggggtgggganggtgtggggggggtgggtggcgtagggggggttgtcggggaaggggggggttgtnnnnnnnnnnnnnnnnnnnnnnnnnnnnnnnnnnnnttttaggtttnnnnnnnnnnnnnnnnnnnnnnnnnnnnnnnnnnnnnnggggggttttgtggattagtggagagggtttnnnnnnnnnnnnnnnnnngggannnnnnnnnnnnnnnnnnnnnnaaaattttgggggggggggaaggggtggggttttg

SEQ ID NO: 14945 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14946 - DNA, 962 bp, Diabrotica virgifera
  misc_feature (802)..(802): n is a, c, g, or t
  misc_feature (848)..(887): n is a, c, g, or t
gtccactgtcgttggtcttctcagcgcgtcggttgtttttttcgtgtgaataaattaattaagatgacgacgtcggagctaataatggttaattcatggaacgaccactacaacacagatagttgcaatattaagataaagaacaagaaactaaaaaaagagctgtatgagatagccagtagggaactgagagaaagtgaatctagtcgtaaggagtgtcttgaacatctcagaaactggattaaacagaatcctgatatagaaaactgtcttactgatgatacctttttgcttcgatttcttcgagtcaaaaagttcagcattcctatggcagaacagaccctcctgaagtatctcaattataggaaaaggtttaaatactttatgcataatttggactgttgtgagcctaatgtatcagaaatcattggcgatggatttttatatgtgagcccctttagagacacctgtggtagacgagttgttctttacgatgtatcaaaatttaatcttgagaagttcaacggagctgatcttgccaaagtgttttccattacttacgaaaccttaacggacgacgaagagaatcagatattgggtgttaaacacgtaggaaacttagaaggggctagtttaaactatattcctttatttactatttctgattttgcagtaatgattaggtggggcgatgaaccggcggcgatgaaacgtcccattccgttttttttacagtgcagtctgaaaaagcattagtcccataatatttacaacttttgttttatttgaagttttatttctncaataataatatttcatgagagatcgaaaatcgtaacataattatnnnnnnnnnnnnnnnnnnnnnnnnnnnnnnnnnnnnnnnncagactgaaagaaattgacaagtaacaaaaaagctatggaaaagaaacaacacatctctggggcctaaaaatggc

SEQ ID NO: 14947 - DNA, 136 bp, Diabrotica virgifera
  misc_feature (13)..(13): n is a, c, g, or t
  misc_feature (21)..(21): n is a, c, g, or t
  misc_feature (26)..(26): n is a, c, g, or t
  misc_feature (54)..(56): n is a, c, g, or t
  misc_feature (58)..(58): n is a, c, g, or t
  misc_feature (66)..(66): n is a, c, g, or t
  misc_feature (73)..(73): n is a, c, g, or t
  misc_feature (78)..(79): n is a, c, g, or t
  misc_feature (90)..(90): n is a, c, g, or t
  misc_feature (92)..(92): n is a, c, g, or t
  misc_feature (105)..(105): n is a, c, g, or t
  misc_feature (109)..(109): n is a, c, g, or t
cctcacaagcgtncggatttnagttnagtgggtaaggttcctccccaaaaaatnnnanattaaggntattgtnaggannggaaggatggntnaaaatgttttggnattntaatttctcagaagaaggagaagaaaa

SEQ ID NO: 14948 - DNA, 780 bp, Diabrotica virgifera
  misc_feature (537)..(555): n is a, c, g, or t
  misc_feature (614)..(762): n is a, c, g, or t
gacaatatgcgcatagaagatgcatctcagaaacaaactgtaggagctgctatcagacaggtgtatactgatggattattcatagataaaattggaaatgctgtagagtttttcagtgatacgtcatttggaagatcaattattcatcacgcgaagaaacaatcccagtttagtgatgtttacttctaccagttttcttactatggaagcattccaggagtgcgaccttatatagagggtgcctacaaagtagcacattcagacgacaaccagtatatttgggtttcaatgaacaactctaacttgaacacatatcctaaaggagatgttttgaccagtgaacgttttcttaccttatttacaaattttgcaaaatctttagatcctgtcgctaacaacaccgaactgttagggataacatcctggccgaaggtaacaccaaatgacttccattatttggatataaacgaaactttgacaataaaaaaagatttgaagagagacgtatatgaaggctgggtaaaggtgtatgaaaannnnnnnnnnnnnnnnnnngatacattttaaaagcgtaccatagtacctacagacaattaaaaagatcattaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatagggggggggccc

SEQ ID NO: 14949 - DNA, 61 bp, Diabrotica virgifera
  misc_feature (10)..(53): n is a, c, g, or t
gttaaaagcnnnnnnnnnnnnnnnnnnnnnnnnnnnnnnnnnnnnnnnnnnnnaatttatt

SEQ ID NO: 14950 - DNA, 126 bp, Diabrotica virgifera
  misc_feature (10)..(121): n is a, c, g, or t
gttaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaat

SEQ ID NO: 14951 - DNA, 225 bp, Diabrotica virgifera
atctttttctttaaacgaacaatttaccgtatattatctatttttatttggtcccgctaaattgttcgtttaaagaaaaagataatatacggtaaatccttaagatattctactggccaatgccaatttaatatcacttaatttaatagcctttggtgcagtattttttatttctctataattgtaaatgaatatgcaagaattccaatagattgtatgcaacac

SEQ ID NO: 14952 - DNA, 227 bp, Diabrotica virgifera
  misc_feature (11)..(33): n is a, c, g, or t
ccctttcgtannnnnnnnnnnnnnnnnnnnnnngataaaaaccaacctggctcaccccggtttaaactcaaatcatgtaaaattttaaaagtcgaacagacttaataatatagctgctaccccaattataaactttaatccaacatcgagggcgcaatctttattatcgatttgaactccccaataaaattacgctgttatccctaaggtaatttattcttataatc

SEQ ID NO: 14953 - DNA, 860 bp, Diabrotica virgifera
  misc_feature (191)..(210): n is a, c, g, or t
  misc_feature (306)..(326): n is a, c, g, or t
  misc_feature (330)..(349): n is a, c, g, or t
  misc_feature (352)..(373): n is a, c, g, or t
  misc_feature (376)..(388): n is a, c, g, or t
  misc_feature (520)..(538): n is a, c, g, or t
  misc_feature (565)..(582): n is a, c, g, or t
  misc_feature (662)..(679): n is a, c, g, or t
  misc_feature (827)..(827): n is a, c, g, or t
cacgaactgaagggatatgttgtagacataaggattaaatcgatgtccctgtgtttgtggaagtgtcttgtgatgtgatttctttgtgttaatcttagttagagtgataatcttaaactatggtaatgaatctgtgattatataacactggtcggttttttaatgaagcgattgcgagtatatgcagtcgnnnnnnnnnnnnnnnnnnnntttcgaattttctcaaatatgccaataggttattgaaattgacatatttttttctaataaaccttaaaaaaagcttgttaccaatattttttcagnnnnnnnnnnnnnnnnnnnnnctcnnnnnnnnnnnnnnnnnnnnagnnnnnnnnnnnnnnnnnnnnnngcnnnnnnnnnnnnncgtaccctttaaatatttttaaatgtgtattataattgcaaattgttaataacttaaaccaaaattaaattatttcttttgaaaaactcaagttgcaaataaaattgtgcaaatcctttaaaatcatttctnnnnnnnnnnnnnnnnnnnctgatgcattaagaattaatgaaagtnnnnnnnnnnnnnnnnnncatgttaaaagttatttttggcttcaatacctactcataaagtttccaatctaaacaaccgagtaattattctatttttnnnnnnnnnnnnnnnnnngatttcctcttttaatattggtaacaacactctaagttattataatttagaatcatattgaatttctttttctattgtcacgtttaatgaattaaaaagttctatcaagttaaaaatcgtggtctctattaataattttccattaaanagtcagttaggcggataaagaaaagaaggtcaa

SEQ ID NO: 14954 - DNA, 707 bp, Diabrotica virgifera
caagtgtgtacaaacttatcagtctttcaactacaattgtctataaaacactaatacgaatagtgctaacacatggagcagatacgtggcgacctacacagagcgaccaagaactgcttaaacgtttcgagcgaaaaattgtaagaaggaagatatggagaaataaaagagcaaggtttgtggcgcaggcgttgcaacttttagttgtatagaagtttcggagaatctaacgttgtaaaattcatgcacacctttgatggatagggcatgtaatcagacgataggaaggcgcaatagtcagagaagcttttgatcgaagaggaccgatgggacaagccagaggaagaccgagacttaaggtatcaagacaacaattttgatcttctttagctttttgttgagatctagttctctgtttgttatttctcttacatgtcagctgataacttcaaacttttttataccaaattctttgtccttgacgtaccttgtccgactgttcttctcttctctctcttatctcaaaggtaactcttccactaaggtaccaaattactgtctctcttgtttatttaaacactctgtgtatataacagaatataatattatagtgctaatcagtacattttatatcgaagaaaatatttttgctacatccaattttgtaattgtaattctttatttggtcatttattattctgttgtat

SEQ ID NO: 14955 - DNA, 706 bp, Diabrotica virgifera
  misc_feature (30)..(68): n is a, c, g, or t
  misc_feature (85)..(183): n is a, c, g, or t
  misc_feature (200)..(251): n is a, c, g, or t
  misc_feature (253)..(300): n is a, c, g, or t
  misc_feature (312)..(368): n is a, c, g, or t
  misc_feature (381)..(467): n is a, c, g, or t
  misc_feature (476)..(493): n is a, c, g, or t
  misc_feature (500)..(520): n is a, c, g, or t
atatagagatagaaaaataatagtgagagnnnnnnnnnnnnnnnnnnnnnnnnnnnnnnnnnnnnnnncctcgtgtgtatcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagaagtgatactnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnngggggaagatcnnnnnnnnnnnnnnnnnnnnnnnnnnnnnnnnnnnnnnnnnnnnnnnnnnnnnnnnnctcatattataannnnnnnnnnnnnnnnnnnnnnnnnnnnnnnnnnnnnnnnnnnnnnnnnnnnnnnnnnnnnnnnnnnnnnnnnnnnnnnnnnnnnnnaaagaggannnnnnnnnnnnnnnnnnattgtgnnnnnnnnnnnnnnnnnnnnnggtataataggagtactccaccatttttttctcatgtgtatattaaaaatgtgtctttgtgtattatatatagactctcctctgccctgtgattattgagagtgcgcgcgatattgtgagcgcgctagggtaatatactcattagtttttatagagagaggtggtgtgaggggtgtgtgtgaaaaa

SEQ ID NO: 14956 - DNA, 570 bp, Diabrotica virgifera
aaggccaagaacgcactacaacgctaccaacggaaatacaattctctgagataaaagccaactgtggcctgtatgtcatgataggaaacagcgaaaaaaggccaataagacgcatatctaacgtattgcccaaaacgataatcgagatatggcccatcagaagagatatgagaccgatacggaggagcaccctccgtgtaagcattctcgagtgtactacaaatgacggaaatggtctgcatctcaatcgcggaagtgcgcccggcacgaccttctagcgtgagaaaatgatagaccaattaagatccacgaatatattacaggaggtcgatatcgacgctgctggacaagacaattacgaatagtgcgataccatgacgacttctatgtgaggacaccagagatgcacattcaactttccattgggtcatcccggctcatcgtctagatgttttacaccaccaacgttttgcttagtggcccgaccgctctagcgaataagtcttccggtatttgactcactagacaaatgtaattattaaatatatgcatccatcaatataattgtgt

SEQ ID NO: 14957 - DNA, 931 bp, Diabrotica virgifera
cggacgcgtgggctgttcgacttttacgaaagtacccacgcctgttggtacagaaactaaactaaacagtagtacaacgcctactttttcatttggtgttaaacctagtacagagaaaaagcctgaagtggaacctccacaacctggtggtagcaaagcagttgctgttgttagtggaactgttttaccagaaaaaacatcaagtaccatttccacctttgctaagccggaagagaaaactgctcttccaacagttgctgctgcaaaggaattaagtacagcacccactgctgctgtaaatgatttgaattcggcgagtcataagcctgcatttagttttgctgcggataaatccaagcctattgccaaatttgaattttctaaaccggctgtacctgcggcaaccaattcagttgagcctccaccaaacaaagtaatcaagtcgtcgcttaatccaggattttcttttgggaaagcagtcaattccgctggtgccagtactgcacctgtgtttggacagaatactccatctgctactcccgtgtttggtcaagatacagcgacatctcaatcgacatttggacaaaacagttcaacaggcataacactgtttggacaaaataagtcatctagtagtacaagtggtaataatggtattgatgctaagcctgctccagcctttggaattcctgctaaaccagcagttgaccttccgcctaccaatacaacagtctcgaaatcattctctttcaccaaacccaacgtggaaccggcgactaatgccccagtattcaacttcgggcagtccgccagtcaagccgtcagcgcagccactacccaatcgtcaggcttcagctttgggcaggctgcgaaagcgccagttttcagtttcactggagctaagacagacagtggatccactacgaatatg

SEQ ID NO: 14958 - DNA, 51 bp, Diabrotica virgifera
  misc_feature (2)..(50): n is a, c, g, or t
gnnnnnnnnnnnnnnnnnnnnnnnnnnnnnnnnnnnnnnnnnnnnnnnnng

SEQ ID NO: 14959 - DNA, 986 bp, Diabrotica virgifera
  misc_feature (142)..(159): n is a, c, g, or t
  misc_feature (570)..(589): n is a, c, g, or t
  misc_feature (910)..(910): n is a, c, g, or t
  misc_feature (933)..(953): n is a, c, g, or t
atctccgcgcaacatcttgaggtctgtatatcttactggctaaagtaaaaatttagcacacacaagttcgcttaaatctggcatatcagcaagagaagtgcataatcaaaaaataaaactctccaactgacattttattatnnnnnnnnnnnnnnnnnnttaagtcgccaaagcacacatttaatataaagcaatgtttttttagtgtgtaatattattgcaattaaaactcacaattaggtcaagatgatttaatttttttggcttgatttttaacgagcagcagcaggatcgcttgagttggagtcgtgcctgactagtgatcgagaagtacaattgttattaatttacaaagtaaatgaagtacaaaatattattttaacccttttaatataaagtccgagcattaaagttttctttgaattaaattcattaaatcaacgtttttaagacatttataccatattttctgacaggggagttatcaatgatgcattttttatttggatatttaatgttaaccttttatcaatatgttatttcgttgtacaatattttttcgtgttaaannnnnnnnnnnnnnnnnnnngattattcgcgacttgctagatttgtttctagaagttagtactatttaatatatgtaaagctttcattgtcgttttctcgtaattgcgaatgagcttatgtttagcagcgttcatagtttaagcataacacattgtttacatctgatacatttttatttttacgcgaatcttatggtaccgttcaaaaaccattcaaaataggaaccaaatactttgaactacatatatttttataaacgtataccataaaaaaatacataaacatatggaacattttttgcatttaaagaacacaaaaatttttggtgatattatatttnttgtaatgatatagtttttatannnnnnnnnnnnnnnnnnnnnctcttatatgtttatatttaatgttaaaaagct

SEQ ID NO: 14960 - DNA, 1034 bp, Diabrotica virgifera
  misc_feature (565)..(586): n is a, c, g, or t
  misc_feature (978)..(1001): n is a, c, g, or t
  misc_feature (1007)..(1028): n is a, c, g, or t
caataacaacctaatcaagaatagcaaaattaacaacacaatcgataagccatttagaggatttgtgctttaactctggcatatgatacattaacacaggtggattagattcttcatacactatataattacaacattttgcgttggatttagcagcatggaatggaaagtaaacttttttttcacaagtagaaggcgtaggagctctttgtaatatttgtccaccacctgcttttattatcgttgccaaattatccttttgaacgttacatccattcatattcaccatatccacatgtccagtaatgtaaaaacttatgccatcaaaaagtttcggcagttttagcatgtcattcattatagacttttgtattccgatattaagtaaaggtagatctacaaatttgtaatcagttattggtataaagtaattattgtcaacataatcgtctatatattcttggggaattattgtacaaccctccaacatagcagttaagattttaaccgatattttatgtgtcttttttattatgaaatgtgttactttcttgcaatcgtattnnnnnnnnnnnnnnnnnnnnnnctgctttaatttgtttttatatatggtgtccgtgtagtaacagaacgctaccatttgctttaaacaaaaaagttgaggctcttgacgtattagatctacctgctctagaaatatcgatttaaattcatttggatcatctatgcattctaaaggctttttcccaaagtaatcgagtgcatttctatcagctccatattgaagcaataaacgtataattgacttatttcgacaagaaacagctttgtgaaggggtgttgtgtaatcttgaccaggtacgttagtcaaagcaccatgcttcagtaacatttctacaatttctaaacttcccctttctataagcttcattgaaaaggaccccaaccagaaaaatcttggagcattaacatctaacnnnnnnnnnnnnnnnnnnnnnnnncttaannnnnnnnnnnnnnnnnnnnnngaaaaa

SEQ ID NO: 14961 - DNA, 950 bp, Diabrotica virgifera
  misc_feature (84)..(102): n is a, c, g, or t
  misc_feature (234)..(251): n is a, c, g, or t
  misc_feature (521)..(542): n is a, c, g, or t
  misc_feature (931)..(948): n is a, c, g, or t
cccgttaaatgtttattatatcgttgtcctcttcctctccacaacaatggtctaaatggcctggttttattattttacaaatgnnnnnnnnnnnnnnnnnnnaagtaaaaattataacaaagcataatagttatattttgaaaagtaaaacaactaagaaagaaaaagtagcatgtaaaaagcattggctaccaattgttgcttaggtccgtatccactacaattacaaagttnnnnnnnnnnnnnnnnnnctatccaattcttaagcagtatatattctgatttaaatctaactccaaaatatgtactgtaaagtagtcataactgtcaagtcagtagaggacaaagcgtacaaataatacctacttatggagtaaattgatgcttttaaaaatatttcgattatccagaagaaaagtgtcacaactcaaaaaacaacgtttttagtatatagtgtcttagtatatacttaaaagcaagtagttattgggcgtaaattcgttttaaacgatctgctaaannnnnnnnnnnnnnnnnnnnnnctatggataagataagagaatgtttctaattgtgtaagaagcaaaaccaaaaatacttagatatttgatttaacaaagaaacaagattttgagttaggtcactttttttaaaatattcgtcacttttttaaacattaacgaaaaacacctaggaaacttttcgaaatacaacggttttcgtgacaaataacgatatgttcacgtagtacgtcacagcataacctcaaaagtgtcatggttccggaatatatattcattttaccgccaaaagagtaatgacactactgccatccagtggcgtagcgtgagtgtcggctgcccggggcggaagacaaagttgccgccctcttatttaggtattttaatttaatgtatactatacattacgnnnnnnnnnnnnnnnnnnat

SEQ ID NO: 14962 - DNA, 918 bp, Diabrotica virgifera
  misc_feature (98)..(122): n is a, c, g, or t
  misc_feature (299)..(333): n is a, c, g, or t
  misc_feature (681)..(706): n is a, c, g, or t
  misc_feature (755)..(792): n is a, c, g, or t
agacaagccgcgaaagttgtgtcttgaaaagtaaaaatgacgtctaaagtatctcgtgatactctatacgagtgtgtgaatggagtcttggaaaatgnnnnnnnnnnnnnnnnnnnnnnnnnggaaaccgtggaactccagatcggtcttaagaactacgatccccaaaaggacaagcgtttcagcggaaccgtcaaactaaagcacattcctcgtccaaagatgcaggtatgcatcttgggagatcagcaacattgtgatgaagctaacgctaacaatgttccattcatggatgtagnnnnnnnnnnnnnnnnnnnnnnnnnnnnnnnnnnngttaagaaactagccaagaaatatgatgctttcctcgcttctgaagctctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctctctgttgctgttggtcatgtaggcatgaatcaagatgaattggttcaaaatgtccatctttcaatcaacttcttggtctcactgttgaagaaacattggcagaacgttaggtctctccacgtcaaatcatctatgggacccccacaaagnnnnnnnnnnnnnnnnnnnnnnnnnntgagacttttatttacacacttaaatgtgggtatctaaataaacatcgnnnnnnnnnnnnnnnnnnnnnnnnnnnnnnnnnnnnnnacgcggtggggaagtttatcaagatgttgatgccaaaaaagaatagagtatgtatttacgaatacctcttcaaagagggagtcatggtagctaaaaaaaattacatgcccccaaaccccccaaact

SEQ ID NO: 14963 - DNA, 534 bp, Diabrotica virgifera
  misc_feature (2)..(44): n is a, c, g, or t
  misc_feature (52)..(160): n is a, c, g, or t
  misc_feature (171)..(533): n is a, c, g, or t
gnnnnnnnnnnnnnnnnnnnnnnnnnnnnnnnnnnnnnnnnnnnaccttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 14964 - DNA, 78 bp, Diabrotica virgifera
  misc_feature (4)..(77): n is a, c, g, or t
ttgnnnnnnnnnnnnnnnnnnnnnnnnnnnnnnnnnnnnnnnnnnnnnnnnnnnnnnnnnnnnnnnnnnnnnnnnnng

SEQ ID NO: 14965 - DNA, 171 bp, Diabrotica virgifera
  misc_feature (2)..(166): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggt

SEQ ID NO: 14966 - DNA, 934 bp, Diabrotica virgifera
  misc_feature (232)..(249): n is a, c, g, or t
gttatgcaaaactaaaaacccttaatagacagaatgtcgcttggtttatttttgtttttcttagtaatcgttaacgtgacaataacagggatttttccaagatacttttggctatgtgtcaccagaatccgctgttatctcgattttaaagaaatggcgcttggtcgagttatgcataacgctgtccttcctccttaaagaattagttcactgtttgtgattttataacgcnnnnnnnnnnnnnnnnnnaatagaagtatgtatgcactttacaattttcattgttttgaaatcacctgccgcaacatcaaataaatcagtatatttatttttcataattaatactacttcgactacagattgtttctcttaatttttgcagtgggaataaattcaatatcagactcaatttgttctggtacttattctgaaccgaaaaatatccaaattcagatattatctcacaaagccacacacttcaaaacgaatgtaataaacaagccaaacatggacgtctaaatatgaactacaaactaatttgcggagtagcagaatacagattcacacctatccaaataagtcacaacaaaatccgtacgctctcaattagaattggaaataaacacgttgccaatatgatattcaaacttcaaactgtttgaagaagtttgatttcaagtcaaacctaaagatatcgaaatcaagtcaagtcaaacttttttacaaaaaaagttgattttcaagtcaagttaagtttgttgaataaaatcaaactagtttgacttgatgcatctctatttgggattatagcagggtagtctgctatatctagggcctacggtatacaaggaaggtaacagggccagtgctacgctttaccgcctattattaccccctgttttacccaacgtactcattttattcagggtgagta

SEQ ID NO: 14967 - DNA, 919 bp, Diabrotica virgifera
  misc_feature (802)..(802): n is a, c, g, or t
gctgaacaagaattaactgtctacgaatgatgaaagtaaattgatgaagtataaaacttagaaattagataacagaagtagtcaactgcatccaaattcagctgatttagggcatttacgggaaccttttaccttttgggaagtgaaagtggccgtgatatcgaattagtataaccgaactgaaaatgacccatgtagtacaaacacaaaaacaagtcattcgttaattggtaaaagtgcctaaggtcctattttcatcttgtaactatgaaggattgtttaaagtgttgataagttagtaatgtaccctaaaattaattgtgtgtaatgaatacctgctagtaattaccgaatttggagcgagaaaagagaaagaaaatgtcatcgataaaaagtggaggtctaaccaaaaaggaaggcaagatgaggatcagagccttcccaatgactatggatgaaaaatatgtagaaagtatatgggctttattaaagaatgctatacaagaaattcaaaagaaaaataactcaggtttaagttttgaagaattatatcgaaatgcatacaccatggtattacacaaacatggtgaacgcctttatacaggattaaaggaagtggtcacccaacatttagtgaaggttagagaagatgtgttacgatctttacataataatttccttatgactttgaatcaagcttggaatgatcatcagacctccatggttatgattagagatatactcatgtatatggacagggtctatgtccaacaaaacgatgttgataatgtatataatttgngacttatcatttttagagatcaggtggtacgttatggctgtattagagatcatcttcgagagactttattagatatggtaatgcgagaacgtagaggagaaaaagtgatagaatttc

SEQ ID NO: 14968 - DNA, 985 bp, Diabrotica virgifera
aacatacgtgaactgatattaaaaatactcattttatttttgtgacaaaataacgagtgataaaaatattggcaactaactttatcgtttaactgttaccacgatctcgtggaaaagtgattataaaatgcttgtgatatggaagacagtatagagaatttgttttaatggagtgtgtgaatattagaactgatcttagaaaataagccgtccaaagtcagaaaataatagattcggaaagataaaagtagcaacacaaaactgccaagatgcacgggatgatgaaaattttttccaatttcaaagatttctacaatgacataaatggtgcaacgttaactggtgctatagacgtcatagttgttgaacagcctgatgggtcctataactgttctccgttccacgtgaggttcggaaaattgggggtgcttagaagtagagagaaagtggttgacatagaaatcaatggggaaccacaagaaattcatatgaagttaggggagagcggggaggcatttttcgtagaagaattagaggaagacgatgatgaagaaattccagaacacttagcaacatctcctataccagtttctgacttcgaaacattatttaaaaaacaaggaaggcgtctcagtctggaagacatctccaatctgggattggaaaacgaagaaaatgactacaaaacgcgtcgcaatacggcagacaacgaaagtaacaagatgcgagaacgcaacttcatcagacgacaactggtcttgggtaacctagaaataaataatgaaaattcagcagaagaaatgacactatctataatatccggaaagctcagtagcgaagatttaagcaagagccacaacgacatttctgaaactattttttaaatggacagcttggatatagatatcagtaaaaacgaagaactaaaatctgaaaaatctggtatctcctgaatcaaccttccctaaaatcgacgatcctacaa

SEQ ID NO: 14969 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 14970 - DNA, 101 bp, Diabrotica virgifera
  misc_feature (5)..(75): n is a, c, g, or t
  misc_feature (87)..(87): n is a, c, g, or t
aagcnnnnnnnnnnnnnnnnnnnnnnnnnnnnnnnnnnnnnnnnnnnnnnnnnnnnnnnnnnnnnnnnnnnnnnnaattatttatantataaatttattta

SEQ ID NO: 14971 - DNA, 991 bp, Diabrotica virgifera
  misc_feature (93)..(111): n is a, c, g, or t
  misc_feature (327)..(356): n is a, c, g, or t
  misc_feature (365)..(384): n is a, c, g, or t
  misc_feature (906)..(906): n is a, c, g, or t
  misc_feature (921)..(921): n is a, c, g, or t
attcgaacttcccagaagattgaatggataaatgcaggtactcaaatgtttgcaacatgttctatcgatgcttcttgaagacgtagctttatnnnnnnnnnnnnnnnnnnngtaagttgaaacactatacaaaccttatttattagatatttaataaacacaaacattatgctgtttttctattactgttatcagtattttatcaatgtatattatgcctatgatcgatgattcatgatagttgagttacagtaaaattattttagcacagaaggaacgcagcgctgccggctgtatttgcttttctgtggacattaatcaaatgcnnnnnnnnnnnnnnnnnnnnnnnnnnnnnncggttgacnnnnnnnnnnnnnnnnnnnngacttttttgctctaaatggtgcacttagcccataccttggaggaacgcactattttccgggacaccctgtatagtttaaaaattattttctgttgctcaatcggtcattcgttcgtggaagtagatacatcatgcattaattgaaagatctatccactggtggttgtaacttaacgtccgcatcattctgcgtttaattcaggttccaaaactgacatttaagtccaatattttttgttcacgtttggtacaaatattttttagaagggtatgcgtccaagttcttacgagctttgctgttgctgcctgctcctacgtcaaatgctgaatttgcatgaacactgaaccttactttccaaggaatatattaaataatatcatttatttaatacttttcgtagcaagctaagtaatgttaacgaagagaattatgactttgcttagcaaatacagagtttttattttatagccttgaatttttgttaattttgatatctatacgtatatattgttttatattngtacatgtactttgngtaatagctgccgatattgccattttttataaaaataacgagagcagaggtgtataaataaatttttggt

SEQ ID NO: 14972 - DNA, 685 bp, Diabrotica virgifera
gcagctttgctggtattgtataactgtctagcattcatgaaaacatgataattcttacatcgctctagtgtcacattttgtatcgcacttctttggttttctgaggacttttcggaggttttctgaagactaaaatatgatgcatttatttttgacgacgaattcatgtacaacacgcaggtgtgcatgaagaagatgactctttcttcttccaatgataaatgttttcattgacttgaccgtgaattagtgcacttgacttgaaccgaccgctcgaatccaataacttcggagggctgtggctcgagaggggtagttgttcagacttaggtcccatgaacttttttaatctacacatcgagaagtgtcattgaccaaactttcgttgaatttgaccgggacctcttttccataaggagtgttgcggggtcctttcatatccgtaacttctacccttttacggaactagtacccgatagtttatttacccttttgtcgtttatgtataggtacaaccaaaggtttattttgtacagatttctcacactacaataattgtaacatttagatttaacctctgtacgataagtacgcttgctgtgcctttagtagatctaagtagttttagatttaagtaggattgtaatcatattttttgatgatcctgaataaaattaactatatg

SEQ ID NO: 14973 - DNA, 869 bp, Diabrotica virgifera
  misc_feature (3)..(42): n is a, c, g, or t
  misc_feature (44)..(668): n is a, c, g, or t
  misc_feature (675)..(712): n is a, c, g, or t
  misc_feature (732)..(745): n is a, c, g, or t
  misc_feature (748)..(770): n is a, c, g, or t
  misc_feature (778)..(800): n is a, c, g, or t
  misc_feature (806)..(806): n is a, c, g, or t
  misc_feature (830)..(861): n is a, c, g, or t
ccnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttnaaccggtgtgagccaggttggttnnnnnnnnnnnnnnnnnnnnnnnnnnnnnnnngaaaagga

SEQ ID NO: 14974 - DNA, 948 bp, Diabrotica virgifera
  misc_feature (879)..(879): n is a, c, g, or t
  misc_feature (929)..(929): n is a, c, g, or t
  misc_feature (932)..(933): n is a, c, g, or t
  misc_feature (945)..(945): n is a, c, g, or t
cggacgcgtgggtgaaaactcgatcgacattgaaatattttttagtgttatcaaaatcactgtgatattcatctctggcaaattatttattatttcaccaatagatatctataacgtgataatatttatagtaattaggtgtacctataattataaatattaataacaattaagtgttaacctgtgacagtggtgaaataatagtattgaacagtatagtgactcgttaaaactggttaattttactttgtttataatatttgttacatttttaatatggaaaatcacaaaattgtaagttacattcggaaagccctaagagctgactgttacgaagatttttcgatcgaactgcaaggaaaacctaagaaaactgaaggatatgcatcagatatggtatttgcaaaaataagattagctgattctgacaaaaagattcaagaatatcatttggccataaaattttcgaaagcatctatgcgaaagttcgaagtttttagaaatgtatataaaaacgaacttttattctataaggaaataatggaagtgtttaatgatcatcaaaataaacaaaatgtttctaagccatttaaagcagtggcaaaatgtcatgccaccttctcggatgaagatgtggacataatatttctagacaatttgtatcagcaaggatacatattacatgatcgccatatatctatgaatatgaatcatcttaaattattaatgaaaacttacgccaaatttcatgctatttctctttctttaaaagaacaacaaaatgagtcgtttctaaaaatcttagagaatgatcttataactaagaaaaccgtagattttggcatgtcagatttttttcatgcctgtgtggtaaagttncaaacatttaagagaaggagaacagataagaagtggtttattcaatttanaanntaactgcaatgncaa

SEQ ID NO: 14975 - DNA, 539 bp, Diabrotica virgifera
  misc_feature (13)..(32): n is a, c, g, or t
gttaaaaattacnnnnnnnnnnnnnnnnnnnntaaaaataggaaaatggagtatggaaaacgggttttaataaccactgatctgttagcgagaggtatagatgtacagcaagtttccctagttattaattatgatttgccttctaatagagaaaattacattcacaggattggtcgaggtggtcgatttggtcgtaagggtgtagcaataaatttcgtaacggacgatgataaacgcacgcttaaggatatcgaacagttctataatacaaagatagatgaaatgcctatgaacgttgcggatctcatataaaagcgagctaataaagagtgttggtgtgttctacgacgtctcctgaagtatctttggtgcgtcatcaatcctgtggacaccaaaatttggaaataaagaactaatttccattttaaaattacaattcagtggttttgcttcttatttaagacccggtttcctgactacagttatgatgttgtaatgatcatgagagggatgcgtagctattgaacctttgaataaat

SEQ ID NO: 14976 - DNA, 54 bp, Diabrotica virgifera
  misc_feature (10)..(35): n is a, c, g, or t
  misc_feature (38)..(38): n is a, c, g, or t
aaatttattnnnnnnnnnnnnnnnnnnnnnnnnnnctntttttatattattata

SEQ ID NO: 14977 - DNA, 672 bp, Diabrotica virgifera
gatctctcagtcgttgtcgtggttagggcttccgcctagagttttattcatcaaccacttattttcataatttaagaaattatattatacctatttatacgaattgtataatattataaatatactacatattattatgtaaagaaatgaagacgctgtttcacagcacaacacagcgtccggctgcctcatcgggccatttagagcatcaatgcatagttccatccaatggattataatgtgcccctatgaggcgcccaacattttatcaactacgctgaggattcctgttcctgaagtttttctgaagtgcctaagcagtccatgttcctgattcctcgaccggatgaggagttttggaagtcatcaaccccatacagctcatggagtttcgagtttcccggggtagccagtcactttctggtaactgaacgccgaagagcattcagactctgctaccaccgtctggacatagcctatggattctcgatggcctagaggaggacaaacgccgagggggatgacatccaaacatattaaacagtgagattgttgggacactagaatctagtatatacactacatataatccgttgttgtgggtaaccatatatctagtttagttttacgattaatatattgtttttagaagttgtcaaataaattaataag

SEQ ID NO: 14978 - DNA, 237 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (195)..(195): n is a, c, g, or t
  misc_feature (200)..(232): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngnaaggnnnnnnnnnnnnnnnnnnnnnnnnnnnnnnnnntaata

SEQ ID NO: 14979 - DNA, 667 bp, Diabrotica virgifera
  misc_feature (5)..(57): n is a, c, g, or t
  misc_feature (76)..(96): n is a, c, g, or t
  misc_feature (141)..(164): n is a, c, g, or t
  misc_feature (297)..(310): n is a, c, g, or t
  misc_feature (312)..(328): n is a, c, g, or t
  misc_feature (391)..(412): n is a, c, g, or t
  misc_feature (423)..(440): n is a, c, g, or t
attgnnnnnnnnnnnnnnnnnnnnnnnnnnnnnnnnnnnnnnnnnnnnnnnnnnnnngcagggattatgagttagnnnnnnnnnnnnnnnnnnnnnctaatttaaatgagctagagaattagaatttttattgcaatatgnnnnnnnnnnnnnnnnnnnnnnnngtgagaggttgtgcttgtataaatatatcgaagtttttatgatatagattaaaagtatttattaagaatatgtttataagtagatatttgtatatgattaatataaattatttttagggaggagattaagagnnnnnnnnnnnnnngnnnnnnnnnnnnnnnnnggaattatgatgaaaaagtgtcatagttttaaatatgcaatgatttatttttagataggattnnnnnnnnnnnnnnnnnnnnnntgattagaagnnnnnnnnnnnnnnnnnngatttaatagtgatgatagtattattgttaagaagaagtagatttaggaaaaatatatagggttaatgaaggaattcggaaacatgtttttcacgtgtttattgataacatgtctgtttgattataatgtgatgtctcgcctgtgcactgattaatttgagtggacgtggtatgtggaccgtgctgaggtaggataatgattattgtgtttatagtaaggtggaatg

SEQ ID NO: 14980 - DNA, 921 bp, Diabrotica virgifera
  misc_feature (774)..(774): n is a, c, g, or t
gctggtgatagtgtcggtgtctcttctatattctgcattctgcgtcctgcttagaccggtcttgtaaataataaaatagatacaatttaaccttttgtgtgttgactgtaaatgaccagttgtttaaaaaaacagtggaattgtttttaccgcattcctaataatggcattatctgttttagaggacttcgttaaagatcttttgaaagaaaatatcatccagaattatacagcacaaagaataaccgttcgtgaattttacaacaaaaattacagaaatgtgggagggatgtgtttttatgagtttaacatggagttatggagatattggtatataaactcctttaccacaaaaactataaaatttgatgaacgatggatcaattattttgctcttcaagttggaggaagctctgtgaataagaaaccatttaacgaacaggtctatatcaatgacaaaaagtgtctgttgtgtaatgttacttttgacaatcggaataaatatgtaagccatgtagacaaacaaagtcatcaagttcgtttgagctacgctaaaaacaagtcaagttttaaaaacaataaagaattaaaaataactttaatatttaacggaaaaaattatgcggagagaaaacttcaagttcctgtgaaaacagatatgcaagcaaccgtacgcatccaaaatatctcgaaaaaagtaatcaacgttatggacatcattaagattaataacttgttccgagatatcagcattcaagaagaatttgagagtgnggttcttttgaaccgtctggttccgttgatgttactatgagggcttatttcgacatagcgtatctgttgtatatccgattgtagtggttactgaagaaaataagacaatgaagcaaaagttccacttagtcatgtttgaaattgatc

SEQ ID NO: 14981 - DNA, 270 bp, Diabrotica virgifera
  misc_feature (7)..(44): n is a, c, g, or t
  misc_feature (110)..(132): n is a, c, g, or t
  misc_feature (162)..(193): n is a, c, g, or t
  misc_feature (202)..(239): n is a, c, g, or t
taacagnnnnnnnnnnnnnnnnnnnnnnnnnnnnnnnnnnnnnntgcgacctcgatgttggattaaagtttataattggtgtagcggctatattattaagtctgttcgannnnnnnnnnnnnnnnnnnnnnnagtttaaaccggtgtgagccaggttggttnnnnnnnnnnnnnnnnnnnnnnnnnnnnnnnngaaaggacnnnnnnnnnnnnnnnnnnnnnnnnnnnnnnnnnnnnnnggattcaaaaattttttatctttatttccat

SEQ ID NO: 14982 - DNA, 52 bp, Diabrotica virgifera
  misc_feature (4)..(50): n is a, c, g, or t
aagnnnnnnnnnnnnnnnnnnnnnnnnnnnnnnnnnnnnnnnnnnnnnnngg

SEQ ID NO: 14983 - DNA, 967 bp, Diabrotica virgifera
  misc_feature (20)..(54): n is a, c, g, or t
  misc_feature (541)..(555): n is a, c, g, or t
  misc_feature (684)..(704): n is a, c, g, or t
  misc_feature (809)..(809): n is a, c, g, or t
  misc_feature (861)..(861): n is a, c, g, or t
  misc_feature (868)..(869): n is a, c, g, or t
  misc_feature (905)..(906): n is a, c, g, or t
  misc_feature (913)..(913): n is a, c, g, or t
atgtaaatttgcgctaaacnnnnnnnnnnnnnnnnnnnnnnnnnnnnnnnnnnncgggggtatcccgaattacagaatttaatattgttgatgtgttccaagttcaaaggtgtaaaaatatgactatcatgccatttttgccatgtgtatatatttatgtaaaaaattgatcatgtatatttgcgtttttgttcctcattaatcttataaacttactgtaaaaatcaaaaatgtaagaaaggatgctaattaaaatcatcaaaatgttggtacaatatgcatggttaagttttaccagagcaaacaattttggtcgtgtaaagaattcgtttacttttcgtgtcaactgatacaaaatatttaaatcagtggtactaaataagccacaatggaatattataaaatggtttactacaaagtaccaagtaaaacaaataacctattgaagcggaaactggaaaagtatgggacaacgtgaagataacagtactaacagtacttaataaagtaccagcataagtactgatctgatattttgctnnnnnnnnnnnnnnntggattatttggacttttattaattccaaaaactgacacatttttgggctaattgaacagatacaacattgtagtcactctaaaactttttcagaatacattgttgaaaccgaaaaagattcagtaacnnnnnnnnnnnnnnnnnnnnnccccaattctttttaggaatataacctactgtatgtttttgttgaacaaaaatgtaacttacatagtaactttttacacgctgtaaatgtaactatacagagtanatttacaaaatgtaaaaatctgtaattgtatatagaattgtaaatcttatancgattcnnaacgtaatatgcttaatatttgatgtaaatttactnntgtacantctaaaatgcccatagtgatggttttacatcattgtgctgttcgattaaagctt

SEQ ID NO: 14984 - DNA, 893 bp, Diabrotica virgifera
  misc_feature (771)..(771): n is a, c, g, or t
  misc_feature (786)..(786): n is a, c, g, or t
  misc_feature (839)..(857): n is a, c, g, or t
  misc_feature (883)..(883): n is a, c, g, or t
agtttctaaaaaataattataataatcacgttttatttaataaaatagttataaatagttaaaaataatcagcaaaggtaaaaatgaagattaccatcaaatgtttaaatggaggaagtactttagtggatgttagtgaaaccagtactgtggcggaactgaaaaaaacagtggagaaagatctaaagattccagtgtttcaacaaacaataattttgcatggcaaatgcttacaagacgataaatgtttaagtgaatatcctaaaataaaagagggaaccaagctttatgttgcaatcaagaaaccagaatcattcagcactactttacataccttcttaaaaaaatactattcagatgaacagtgcaaagttattgtagatgaatttatgagaaattttcattccaaggttgagagtctgagtttagacgacttggaaaggatagcgaaatcagaattggacaatttggagacatagacttgactgtattacgagtaatcttatttatatctcttatataccctgtctgtggaagaaagaacaatattgacttttaggtgttaaatctagtgaacaaaatggtatggtgactttgaaaacaaaagattacatttgtccaactaaatctttttaattagaatgaatcgtcaggtgtctaatatcaaacacaacaaaattttgacatattcatgaataaaatacatattttactacaacaatattctatctattcattatttgtatataatttcatcacatcctgttctanaccgtagcaactcanaatattgaaagtttacaggaggatgaaaaaatatttggatttaattatttccnnnnnnnnnnnnnnnnnnngttagtataaatctaatttttatgtncatattttac

SEQ ID NO: 14985 - DNA, 85 bp, Diabrotica virgifera
tttttatatatgaatatttaaatggatgctcaacttacatattgtactgtataatgtataagtgaataaaatcagtttttgtatt

SEQ ID NO: 14986 - DNA, 925 bp, Diabrotica virgifera
  misc_feature (120)..(187): n is a, c, g, or t
  misc_feature (498)..(517): n is a, c, g, or t
  misc_feature (863)..(863): n is a, c, g, or t
  misc_feature (913)..(913): n is a, c, g, or t
ggaccagccagaatgttagggtgaatgaagaccattatcgcgccatgataacgaactatttggtaccagaaattgaagttcgtagcttaagtgacatttggtgccaaaaatatggcgccnnnnnnnnnnnnnnnnnnnnnnnnnnnnnnnnnnnnnnnnnnnnnnnnnnnnnnnnnnnnnnnnnnnnagtgacttggccgcctatatcctgtgacatcacacgtctagtcgttttcctctgaggctaccttaagtccaaagtctacatgaataaaccggctacgattgaggcattggaggacagtattactcgagtcactagtcaaataccaatcgaaaagcttgaacgcgtcatcaagaattagaccttcagaatggaccgtcttaaccgcagtcatcgtcaacatttgaaagaaattatctttaagaagtaattgtaaagaatggttcttttttaagacaataaagatttttaaataaaatccattttttcattgnnnnnnnnnnnnnnnnnnnntacctctaaatgaatcaccctttacaacaggcttcgaatgtagctacagaatggacttcaaatgaaacaagaatttagggcgactagatttagagtaatactagactcgatgtttacttggaatcaacagagagaacgatgtgatttaaaaccagaaaacgaactaaaataagctttagtaaaactgaaaattagaaagtctctaaacagtagacgaagcctatctcttcatctactttacaaagggtggggcatttcgtttcgtacatgatggttgttctgctgtaatcttgattaatctcctactcatgttagtctacctattttttatgaagatattacgttnttaccatcatatatctgtttgtatttgtataatctctcataattgacccntactctacaaat

SEQ ID NO: 14987 - DNA, 748 bp, Diabrotica virgifera
ttcaccgcccccggtcccattccatgattataataatcacactttatttaggaaaagaaggataaagcattaaaacatacgcacgcaatgggagaaatgaagattaccatccaatggttgaatggaggatatacagatagtggatgctagtgagacccctactggggaggctctgaaaaaactagcgtacaaatatgtagagagtccagtgtctaaacaagcaagaattctgcatggcaagatgcttacaagacgagtcatggataaaccgctcctgtaggataatagagggaaccaagctaaatgccccaatgaagaacaccaaaaacatgcgtcattactatactgaccttctgtgaccactactactctgatgaagagtgcaaagttatggtagatggagttatgagaactcttcatgccaaggccgagaggatgagcttacacaacttgcaaaagatagggaaatccgcattggacaaagagcgcacgtagacttgactgtattacgagtactcttattgctatctcttatatacccggtctgcggaagaaagaacagtatggcctgttaggtgtccatatctagtgaacgacatggtatggtgtctttggaagcagtagatgtacatgtctccaactaaatcattgctattagaatgaatcgtcgggtgtctagtatcattcacggcagaattttgacatattcttgaatattatccatatcctactacagcagtatcctatc

SEQ ID NO: 14988 - DNA, 856 bp, Diabrotica virgifera
  misc_feature (23)..(73): n is a, c, g, or t
  misc_feature (102)..(144): n is a, c, g, or t
  misc_feature (157)..(279): n is a, c, g, or t
  misc_feature (294)..(312): n is a, c, g, or t
  misc_feature (321)..(340): n is a, c, g, or t
  misc_feature (370)..(401): n is a, c, g, or t
  misc_feature (413)..(431): n is a, c, g, or t
  misc_feature (460)..(485): n is a, c, g, or t
  misc_feature (487)..(512): n is a, c, g, or t
  misc_feature (539)..(664): n is a, c, g, or t
  misc_feature (674)..(759): n is a, c, g, or t
  misc_feature (770)..(813): n is a, c, g, or t
  misc_feature (821)..(840): n is a, c, g, or t
ttttttttttcgaaattaaaagnnnnnnnnnnnnnnnnnnnnnnnnnnnnnnnnnnnnnnnnnnnnnnnnnnngagaagggggggggggcgctgtgaaaaannnnnnnnnnnnnnnnnnnnnnnnnnnnnnnnnnnnnnnnnnngcggtgtggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggacacccctnnnnnnnnnnnnnnnnnnnggccagccnnnnnnnnnnnnnnnnnnnnacgggtgtattgttaatagaataatccatnnnnnnnnnnnnnnnnnnnnnnnnnnnnnnnnctcttatcaaannnnnnnnnnnnnnnnnnntgtatcgaaaagaaaagagaattgcaacnnnnnnnnnnnnnnnnnnnnnnnnnngnnnnnnnnnnnnnnnnnnnnnnnnnnagggccccctccttccctttcttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccccccnnnnnnnnnnnnnnnnnnnnnnnnnnnnnnnnnnnnnnnnnnnnnnnnnnnnnnnnnnnnnnnnnnnnnnnnnnnnnnnnnnnnnncacaattctannnnnnnnnnnnnnnnnnnnnnnnnnnnnnnnnnnnnnnnnnnntttgtttnnnnnnnnnnnnnnnnnnnnagggggggaagaaggg

SEQ ID NO: 14989 - DNA, 566 bp, Diabrotica virgifera
  misc_feature (2)..(367): n is a, c, g, or t
  misc_feature (374)..(411): n is a, c, g, or t
  misc_feature (431)..(444): n is a, c, g, or t
  misc_feature (447)..(469): n is a, c, g, or t
  misc_feature (477)..(499): n is a, c, g, or t
  misc_feature (529)..(560): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 14990 - DNA, 864 bp, Diabrotica virgifera
  misc_feature (2)..(582): n is a, c, g, or t
  misc_feature (589)..(616): n is a, c, g, or t
  misc_feature (624)..(790): n is a, c, g, or t
  misc_feature (794)..(856): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcannnnnnnnnnnnnnnnnnnnnnnnnnnngaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnccattttt

SEQ ID NO: 14991 - DNA, 516 bp, Diabrotica virgifera
cctcccccggctgccgagtggatacacatacacttaggaaatatccggatgagcatggcgtacctgctacagagtatttatccacagaataatattagctattttatagagttgtgtccctcggttgttatcatttgcagtgcgattgtttgacgaatatggaaaagattaaatcgtagatatggtattgcaggtatggcggtcatgtggtacgggaatatgatgatgtggatgatctcgctggaaagggacgggaattattgttgtctaaagtatggtgtatagttgaattgtgcgctggtgtgatgtaagataggtctacatgtacattgtatagtggaattgtaagattggaagctggggatgagtaagatgttcaagattgaagtttgttttatttatatgaaaatggaaggtgacgatggtgttatagggataggaaaagcagtcattactcttcgtaggaattgtcgtgataagcgttttgggcgattgtttagtaaatatagtgattgt

SEQ ID NO: 14992 - DNA, 556 bp, Diabrotica virgifera
cggacgcgtggggtcaaacattttcttttgataaagcttgtatctaataaatagtctatgcactgacctgttataaataaattatgtattcatttataacaggtcagtgcatagactatttattagatacatgatttattttaagtatattatggtaatgacgcgatagatcatatttatatttctttttgaaatgagactcgaaatatgctggggtttatgatttcatactataagattgtttttgaagtagaggtattcctttttataaatatataatgttaatatattatgtataaatctagaaatggggagtgacgctcaacaggatccatgattcatcttcacgagaatgcgaactcataactcttctataaaggcaactagatcctattaactggctgtctatgtacaaagtcgtgacagggagaaccttgcattaacacaacttaatcaacctgcgactcatccacctttcatcttgtggagtaatagcgaacatgcccgctacgatcgcccatctcaacaggagcccagacggaatgatagaatggca

SEQ ID NO: 14993 - DNA, 940 bp, Diabrotica virgifera
  misc_feature (6)..(27): n is a, c, g, or t
  misc_feature (58)..(78): n is a, c, g, or t
  misc_feature (753)..(753): n is a, c, g, or t
gaaggnnnnnnnnnnnnnnnnnnnnnntacatttcaaatgtatttttgttttcgaatnnnnnnnnnnnnnnnnnnnnnagttaagttaaaattgtcttatgaatcaataagaactatttctgtaggtaattatttacaaaatatgacggaacaaagcaggacaacggaatttcaagaaatttgtgaaggtttggcaaatattcgcacgggaggaaaagtattttacaatcctgttcaagaatttaatagagatgtaagcatttcagtaataagtgcctttgcaagacgctttcgtaaagaaaatgaagaacttagagccaaaaaagagaagaatgaagtaaacacccagctggaactttggcaagctggtaccaagtacgaagatggtattagtatcctagaagccctctcagccactggattaagatctataagatatgccaaagaaattccaggtgtgaaagaaattgtagctaacgatttttccttgcaagccgtagatgatatcaagaataatgtaatactgaataatgttgaacatttggtaaaaccaaatcatgatgacgctgtagcattaatgtatcaacacaagaaacaaaaccagttcgatgtgattgacttagacccttacggctgtccttcaatgtttctagattcggcggtacaagcaattaaagatggaggcttgttacttgtaactgctacagatatggccgtgctggcagggaacagcccagagacctgctacactanatatggcgcgatttctatcaggagcaggaattgtcatgagatggctttgaggattttgttgcagtctatagagtcgcatgctactcgatatgggagatatattgaacctctgatgtcactgtcagctgatttctatattcgagtgtttgtgagagtatattcaggagctcacaaatgcaaattttca

SEQ ID NO: 14994 - DNA, 915 bp, Diabrotica virgifera
  misc_feature (35)..(35): n is a, c, g, or t
  misc_feature (100)..(123): n is a, c, g, or t
  misc_feature (366)..(381): n is a, c, g, or t
  misc_feature (805)..(805): n is a, c, g, or t
  misc_feature (893)..(910): n is a, c, g, or t
attttcctttgaatgaccgtttggtttaatttttntttgcgttgaagctttttgtagtggattgtttttacaagatttctacttgtgggtgtactttagnnnnnnnnnnnnnnnnnnnnnnnncagaatttggcgttatggcatccttcccaaattttccaaaagactatacatatgcatggagtgatactagcagtgatgaaataataacagtaaaagtaaaggagattagtgtgtgccccttccaactccatttccttttgcatattgtgtaatatataggttcctcgttagttcttgtccatagctcttaggtcgatatgcagtttggccagtaaaatgttaagaatcttccttttatttatnnnnnnnnnnnnnnnnctgatatatgttcttgatactttcaaagtttctgctccatatagtaacacagtcttcacattgttgttgaataatctatcttgctttttcttgtcatctgatgtgatgaccacattttccttagcacattgaatgcgttttgagctattcctattctctgttctacgttctcctctatccctcctttgttgttcaaaatactgcccaagtagttaaatttctctattgtttctaatcctgtgcctcccagtgatatttccaattctcttggtgtatttattttcattatcttagtttttctgacgtttatgttaagtctgaccttccctgcctctgctaatttttcagttttgcgttgcatgtgttgtattttttccgttaaaaggcatatcatctgcaaattccaagtcctcaagttggttanaaaaaataaatatttgctataatattatattatctattatgttgtttacccttggataagagtgtaatggtataaacatgacatcttnnnnnnnnnnnnnnnnnntaatt

SEQ ID NO: 14995 - DNA, 850 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (635)..(684): n is a, c, g, or t
  misc_feature (689)..(797): n is a, c, g, or t
  misc_feature (803)..(845): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnncccgnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatggtttttaataaacaggtgaaaaaaatggttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaannnnnnnnnnnnnnnnnnnnnnnnnnnnnnnnnnnnnnnnnnnctcat

SEQ ID NO: 14996 - DNA, 745 bp, Diabrotica virgifera
tcgacactttccgacactttacgggcgcactgatctgctgctttgtttccatcgataccaatatgagatgggatccatatgaaggtaatgcgtctggaattttcttgagcctcttctagttcagattttaccattttctctagggggtttttaggatacacatgatttaaagtttgtaaagcaccgagtgaatcacttaggatcaagcattttgatattttgtttttgttgacatgttcaagggctttgagtattgcataaagttcagcagaaaaaatactgaaatatttgggaagtctaaaatgattttctgtcatttctaaaacaattgaactgcttagaattgtaacttgtgtttggactaaggttagtttcttgtaggcaaattatttctggacagtattctgattggatgatttgaagcatgggtaaacgatggaacagtccatcaatattccactgtaatatagagatgaaaattaggcatcggaggaagataattcactgtcagtgatatctttacctagatagtgattcaatttatttttaagtcgggtgaagcgatgtttcgtagttttgtctgataggtatgggtaagatatcgttaataggtttattaaaccggtgagatcggttgtgtattcctggataatttctatacgtgaattgttaccttgggtattttcaattagcattattagatgatcatagattaatgagagtgttgtggaatttttattcatga

SEQ ID NO: 14997 - DNA, 199 bp, Diabrotica virgifera; identical to SEQ ID NO: 8259
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (196)..(196): n is a, c, g, or t

SEQ ID NO: 14998 - DNA, 53 bp, Diabrotica virgifera
  misc_feature (9)..(41): n is a, c, g, or t
aaagcttannnnnnnnnnnnnnnnnnnnnnnnnnnnnnnnngtttataaaatt

SEQ ID NO: 14999 - DNA, 389 bp, Diabrotica virgifera
  misc_feature (2)..(42): n is a, c, g, or t
  misc_feature (44)..(56): n is a, c, g, or t
  misc_feature (62)..(84): n is a, c, g, or t
  misc_feature (275)..(348): n is a, c, g, or t
  misc_feature (353)..(387): n is a, c, g, or t
cnnnnnnnnnnnnnnnnnnnnnnnnnnnnnnnnnnnnnnnnntnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnct

SEQ ID NO: 15000 - DNA, 742 bp, Diabrotica virgifera
  misc_feature (2)..(16): n is a, c, g, or t
gnnnnnnnnnnnnnnncattgtttgcatttattataagatcttatattttgaatacttgaccttttctattcaaatgtacaagagctgatcatattaatgataaattagatatgagtatcccagcagagaatataatacgtaggaataacctgaattcaggagacctttctttcacccgcttattaaaaacctgaattttagcatgaactgtaacgacccgcctggccactgcccatatcgaatgccctaccatattttgaccgggccttgccgattgatatttcactttttttattgaaatgtggactgaaagttcgaatgtgaatttgactgcccctattactgttccaaataaatatacttataaaactacaaacttacctttttttagcttattcctaacaccctataaagattgatcctactatttatacatgattataccattatgtacagttatattctacattcatttagttgccactgtcataacacctatttccacttgtataatattataacatcaactgataattgtttaagccaaatgttttgactatgagatgaaattacctgaagacactcatgctctctctattgaaaaggtattgtcaataacctcgatcgtgacctcatcgtagatacagagttaatcttcgttgtatgagatatatcattgactgtgttccacttgtaaaattctacatgatgtgagactggagcgacgtgagctccaccgac

SEQ ID NO: 15001 - DNA, 129 bp, Diabrotica virgifera
  misc_feature (7)..(88): n is a, c, g, or t
  misc_feature (97)..(97): n is a, c, g, or t
gtgattnnnnnnnnnnnnnnnnnnnnnnnnnnnnnnnnnnnnnnnnnnnnnnnnnnnnnnnnnnnnnnnnnnnnnnnnnnnnnnnnnnacttagggnatacagcgtaattttatctggagagtcaatcg

SEQ ID NO: 15002 - DNA, 920 bp, Diabrotica virgifera
  misc_feature (68)..(100): n is a, c, g, or t
  misc_feature (564)..(582): n is a, c, g, or t
  misc_feature (797)..(797): n is a, c, g, or t
  misc_feature (828)..(857): n is a, c, g, or t
  misc_feature (872)..(872): n is a, c, g, or t
  misc_feature (882)..(883): n is a, c, g, or t
cctttcacgcgtccggtcactgaagtcgagggcgtccgcgtcgtcttcttccacttgggacctttttnnnnnnnnnnnnnnnnnnnnnnnnnnnnnnnnngtcttctgaggtgtcctgcccattagagtcttctaaacttcatttcttttatgagggtatagttcttcgacctctttgttacttcgtatcctatattgtcctcttcatcaagcattcatcattctaaggatttttttcccaaacacgtagtctatcttcttttgccttggtcattgtccacgtttcgcttccatacatcactacgggtcgtatgattgtttttatactacttgtatctttgtacgtcttgttagttgtttcgatgttataatgtttttaagggcataaagacatctgttgccggcttgtatcctaatatttatttcttgtgagccgttaatatcttcagtttttgttgttccaagatatttaaattctctaacgcgctcaaagttaaagtcatcgatggtgatgttctgattgattctctctatgctttggttattgcggctaatatacatatnnnnnnnnnnnnnnnnnnngattaggagtcccatcttctctgcttcctttagaaccagtgtccacaattatgttttcttctggtcattgtttatttgtctactttacctcattgcaaaaatggtgcatgtacttattttaataacatgtacatattataacgtaatagcataaagacctccatatatggactatgtgtctcttttatttctggaattttatggattttagttanatgttttgttgttgaattacgtacgtattgnnnnnnnnnnnnnnnnnnnnnnnnnnnnnntttactattacattngtgtagtgannttagtaatatgaactatacttcactcgaatagccgat

SEQ ID NO: 15003 - DNA, 911 bp, Diabrotica virgifera
  misc_feature (877)..(877): n is a, c, g, or t
cttatgcaatgtgttaaaaaatgcaagatattccttccaagtacttgcacacagaaaatagctatattttttggagctttagcaatttttaaaaagatatgttacttaaacagtattttcctatgattttcttgaaataattatttaattaagtcagtaatatttcaaaatggtactgataagcacttattcgagagaaatacatccctactgataagcacttattcgagagaaatacatccctactgctgaactttttgatgaaaaagtttatttgtactcaattttctcttcctttcttacacataaaaccataaaattggtctgcttttttaataaaactcagtgtgcagttttatcacatgtaccacgcagtatttattcattttgacaccataggtttcgtgttttacaatattttccacattttatgtggcagttcttgttttacaactgttttttcgtaaaattactgccagaatgaaaatctggcaacacgtggaaatgtgacgtgcgactgtgtttgttttgcgtttcctatatatggttgttactatataaatatattgcaaaatttactatgtgcatatataagaacaaatgtacttttttcattgtttataaatgtttgggtacctttctgaagacaaaaacaaaaatcatccgtttggtttttagaattttttagatatttcttgaagcaaaatttggcgttttggaagttcaaaacgcaaaacaaaggacatcgcacatatcttgtggacaatgtaatgtcactcaaatgcaataaaatttacaaacagattcgtcccgagattaatatcatttcatatcattgcgccaactcagaatttttgattaataacggcatacattngtaaaagtccatagaactgtcattcataaatact

SEQ ID NO: 15004 - DNA, 132 bp, Diabrotica virgifera
  misc_feature (2)..(46): n is a, c, g, or t
  misc_feature (54)..(55): n is a, c, g, or t
  misc_feature (60)..(60): n is a, c, g, or t
  misc_feature (62)..(64): n is a, c, g, or t
  misc_feature (66)..(124): n is a, c, g, or t
tnnnnnnnnnnnnnnnnnnnnnnnnnnnnnnnnnnnnnnnnnnnnntaattatnntattngnnngnnnnnnnnnnnnnnnnnnnnnnnnnnnnnnnnnnnnnnnnnnnnnnnnnnnnnnnnnnncatttttt

SEQ ID NO: 15005 - DNA, 818 bp, Diabrotica virgifera
  misc_feature (198)..(219): n is a, c, g, or t
ggccttgacaattatccagtaaccaccttcatatgattggccaatataattaaaaatgcgaataaaagttcagagcgtagaaataggtgtcgcttttccgaacttgcacggtcccaatagatgaaagtgaaattgatacattttgtaatcatattaggcaaatgcaaattcttcattatttttgtagtgttgataacnnnnnnnnnnnnnnnnnnnnnngcgtacctttgcccccagtgaggtatacttggcaaatgcatgtttcaagtcaatcttcaaagtgaatatcaagttgagcttgatattctatcaggtaattttgactcgattgccaaatgactcaagtcagcatgagtactcctgtgcgtacttttgtaggaattattgatattatgataagagactgaaccattgcgcaaaccaagatattgatgaattctgagagaagaaataaacagtgtgatgaacccataagtcacactcccaacaccagatactgttgtatgtggtcatatgaacctcaagaggttatgtagaaagaatttccgggacgactgatgtagaagctgaattcggagagattccttggatggtggcaatcttaagagaggaatcggaacaaagtaacccgctaaaactgaacgtgtacgaatgatgtgatgcattgatccatcctctggatgcgcttaccgcggcccaccgtgccgcacgtaaaaataaagtaaattatggttatagttggagagtgcgacacccagcacggagaaggagctttacccgttccaagacagagaggtgcaatcggattgttgttcctc

SEQ ID NO: 15006 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15007 - DNA, 921 bp, Diabrotica virgifera
  misc_feature (27)..(44): n is a, c, g, or t
  misc_feature (50)..(90): n is a, c, g, or t
cgaacgctatttcaaactaagtattcnnnnnnnnnnnnnnnnnnagtttnnnnnnnnnnnnnnnnnnnnnnnnnnnnnnnnnnnnnnnnnaaaagtcaatctagtgatattattgttaaagatgttactattccgcagatgttatatgaaagtatggagccaaacctcaaatatattggagctatatctggaacgactggaagaagctacacattcgaacaaatcaggataaaaagtaggaatttttccaaagtattgcgcgagaaattcaagttaaaagacggagatgtcatagcaatgtttttacctaacgtacctgagtacgtcatctgtttcttaggatcattggaagctaggctcatagtgactactatgaatcccatgtacacagcagatgaaatagcaaagcagattatagatgcttctccaaaattaatcgtaactcaagctaatttggtcagtacggctagatctgcattagaactaacaaaacgacagctacctttgatcattgttaaggagacgcaagcggaaagtctgccagaaggtacaatagatttgtcagaattaattaatacacatttggacgtacctgatcttctaccaggaaaagcagacgacgtggccatcatgccgtactccagtggaacaacaggattaccaaaaggagttttactcacgcataaaaacatgacatccaatctgacacaaatgagccatccggacttctcttcagtggaacctccaacagataactttcaagacatgtccccagcagtgctgccattttatcacatatatggcttaacgttgaacttcctcttcatctgccaaggaactagatgtgtagctcttgacaaatttacttcagaatcttacatagcagcctttgagaataaccctatcagtatgatttttgca

SEQ ID NO: 15008 - DNA, 922 bp, Diabrotica virgifera
  misc_feature (596)..(622): n is a, c, g, or t
  misc_feature (684)..(706): n is a, c, g, or t
  misc_feature (746)..(762): n is a, c, g, or t
  misc_feature (764)..(790): n is a, c, g, or t
gtttatgatattttatacaataaatatgtaaatcggatcaccatctggaaataaacaccgtattgtactgggaccactaccaggtgttttattatcattgaatcaatgtactaaataattctgtatatttcaaatatactcattcagtttatatgtcagctatggattttaaagttgaaattaaggatgagcctgtcgaatatatccaaaaggatacagagagccagctatccacatccatagatctggaaaacttcaaaaatgaaaaagaagataaatcagaaatgggactaaacgctgaaatcaaggaagagttttcagacagttgtcaagtatatacaaaggatcagctgtttacatcgccagatcttaaagacttggttaatgaagcagatgaagataactcagggctttctcagacgggaatggatacaatgaaaactgaacttgcatgcactacagaacaacaaataagtgcaaacactgaaaaaacaacatcaaaaaattatatttgtgaatgtaaaatttgttttaagcaatttcgtcaggcaggttctttgaaacgacatataaaaacgcacaatgcagaaaagctnnnnnnnnnnnnnnnnnnnnnnnnnnngttttctcataaacatcttttaaaggatcatgtaagattgcacactgtagaaacgccttatnnnnnnnnnnnnnnnnnnnnnnngttttctcaaaaaagtaatttgaatatacatttgagagtnnnnnnnnnnnnnnnnnannnnnnnnnnnnnnnnnnnnnnnnnnngttttctcaaaaatgtaatctgaatacacatttgagagtgcacactggagaaaagccttataaagtgcaaatttgttttaagcagtttagtcaagaatctaaatttgaaatacatttgagagtgcacactgg

SEQ ID NO: 15009 - DNA, 247 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattacgaaagg

SEQ ID NO: 15010 - DNA, 904 bp, Diabrotica virgifera
  misc_feature (5)..(58): n is a, c, g, or t
  misc_feature (60)..(838): n is a, c, g, or t
atttnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttatttggagagtcaaatcgataataaagattgcgacctcgatgttggattaa

SEQ ID NO: 15011 - DNA, 920 bp, Diabrotica virgifera
  misc_feature (834)..(834): n is a, c, g, or t
gaagaattcacttggcacaggatcacttacgcttggcccagaggtcaaggcaatggacctcgtaacagggtgcaaaggtacgctcagtacgctggggctgggggtagtagcagtcctataatctacgaggatcccaatttgcccaacagcggatggaatccttcagaaggaatcgattataatcatggaaatgtcagtcgtgtgcggcctaccactttagtaatgatggatttgactactgataaaatcattcgatcattccaaatccctgcagaccaaatccggccaaccagtggtttagctagtgtaaccgtagatgtaactaaagacacctgtgatgatgcctatgcgtatatacctgatttaggaggatatggacttatagtgtacagcctaagggaagacagatcctggagaataactcacaactatttctacttggaacctctagctggagagttcgatatctccggtcaccgttttcaatggaacgacggtatattcagtgttgaactaactaatgttaaaccagatgaaaatagagacttgtatttccattccatggcaggaacgcatatgtatcgagtgcctacgaacattgtaaagaaccacactttagctacgaggtcataccatggagaggatttccagaatcttggagatcgtggagccggatctcagacctcttccgcagacatccacaaacccagcggtattatgttcctaggtctagtcaaccaaaacgccctaggttgttggaacaccaaaaaacccttgagtacgatttctgtagtacaaaaagatgacgccaagatgatctatccttgtgatgtnaaagtaagcaacgacaaagtctacgtcttgactaacgccatgccagagtttttgtacggagctctgaactatgaccaaattaactt

SEQ ID NO: 15012 - DNA, 269 bp, Diabrotica virgifera
  misc_feature (5)..(47): n is a, c, g, or t
  misc_feature (53)..(75): n is a, c, g, or t
tttgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaaatataaactttaatccaacatcgaggtcgcaatctttattatcgatttgaactctccaataaaattacgctgttatccctaaggtaatttattcttataatc

SEQ ID NO: 15013 - DNA, 879 bp, Diabrotica virgifera
  misc_feature (313)..(327): n is a, c, g, or t
  misc_feature (639)..(656): n is a, c, g, or t
  misc_feature (788)..(788): n is a, c, g, or t
caccacattcgctcacttggatgccaccactgtattgtcccgtgccattgctgaattgggtatctacccagctgtagatcctttggattccacctcacgtatcatggaccccaacattattggagccgaacattacaaagttgctcgtgatgtacaaaagatcttgcaagattataaatcactacaggatattattgctatcttgggtatggatgaattgtctgaagatgacaaacttactgtatctcgtgctagaaagatccaacgtttcctttcacaacctttccaagttgctgaagtcttcactggtcannnnnnnnnnnnnnntcctcttgaagaaaccattaagggattccaaaagattcttgctggtgaattagatcacttaccagaagtcgccttctacatggtaggacccattgaagaggttgtccaaaaggcagaaaaattagctgaatctacataaatgctaggataacttttctgcctcttgaagaaaccattaagggattccaaaagattcttgctggtgaattagatcacttaccagaagtcgccttctacatggtaggacccattgaagaggttgtccaaaaggcagaaaaattagctgaatctacataaatgctaggataactnnnnnnnnnnnnnnnnnngtgattccatcaatctgcagagagaaagacgtttctttttattaagatcatgtaaagaacttttcattacactaccagattttttttatatcgaaaatttttgtttattagccctaatttcatctgtcatgngtattgttgtatttttaattaatccataaataaaatagatctaaaaataatagcagtggagtttataaaattattagaaaaattgttttag

SEQ ID NO: 15014 - DNA, 886 bp, Diabrotica virgifera
  misc_feature (157)..(175): n is a, c, g, or t
  misc_feature (263)..(281): n is a, c, g, or t
  misc_feature (379)..(419): n is a, c, g, or t
  misc_feature (844)..(844): n is a, c, g, or t
ccctctcgcgcgtccgcttacatagatttaatttcccgaccccaaggggagggaaattgccacgaggacaatacaaatcgctaagtaattttaagagctcgtgtgtaattcggtaaaattatttcatgaataaaattgtatccttaaatcattttannnnnnnnnnnnnnnnnnncttcgtctatatatttgttaaacctgcccatggttttcactttggcaagttataaaacattaattgtgattaatgtcactgaatgtcnnnnnnnnnnnnnnnnnnngtaacaacgaaggacatctgccgcgctacttgacgacggataattatcaaaaaaattatcagtagtaactgcataagagctctaaaattattgaattnnnnnnnnnnnnnnnnnnnnnnnnnnnnnnnnnnnnnnnnnaaggcgagtgaaattatgtcaaagggtcacgagggcaaaaattctatattaattttagagttcgagtgcaatttgttgcgattatttcatgaataaaactgttcaaaaccaaaattttattgtaatttatttatggaagtacaaattagtacagttaaacacaaagtttttataaatatttgacgattgagagtcatcacttttataattttgaaaacattaattgttattaatgtcactgaatgtattttttcgtagcaacgaagggcatctgacgtattatacttaacgatgggcaattatcaaaaattatcaatttaattcagatttatgtagctttctattggtcagaatctcctatgaatgaaataatcaacgttaatatcacaagagggtgaaaataaactcaaaataatgcgacattntatcgaaaacttgttgcctggcaatagacacgagagcccgca

SEQ ID NO: 15015 - DNA, 1035 bp, Diabrotica virgifera
  misc_feature (790)..(790): n is a, c, g, or t
  misc_feature (800)..(800): n is a, c, g, or t
  misc_feature (857)..(857): n is a, c, g, or t
ctaataactgacaaaataacgcaaaagatggaaaacatataagttgtgagataaggggaaaagagactggtagagatgctaaatttagtgataaaagcctatgaacttgcattctacttggtgtttcccacctttagacatatcagagctatatgtcaactaaaactgtcactgtcacagtgtcagttaacaaacaagtccaatatgtctaaaggtgggaaacagcagatagaatgtggatttataggttttatcactggatttcgcacctctactagtttaattcctttttatctcacaacttaatatgttattagcatgctcatcactgtatactgactaactttttttgttttttaacctcaccaaaccttttttattcgtatctgtatatttatcgaagttcaaatgtattttttttattcttccaaatgagccagaaacttgacaaaaaaacaattttctgaatcccttcgaataaaattctttttaagtttatctcatcggaataaaaaataccttttctctcttggtaatttttcgaaaaatgcttccttttcacgttgtttgctattttttgttaaagaaatgccttaattagcgatttttgggattttttcccaaaaactactcaatgaattataattctacaaaaggctttataatccttaaaccctcaagtataagtaagaatattttgacaaggacacatggtttatatctcgctgaaaacatggagtcaaaaattcatctaaaataggcccttcagacagtctaccgctgccatgtngcctaagtgntggacagtgggttgcagaaaaacgggcacatgtcacataaatatttgtataaatttnaaactatcgtttgagcaagatagaagccacttatccttgtcaaatattaataataaggttttaagatataaagtttttatatactacatttcatttagttgtttcttagaaaaaaatcgcaataactcaaaattcgtccctgaaaatttttactaaatgattccgaaaaatgtttttt

SEQ ID NO: 15016 - DNA, 376 bp, Diabrotica virgifera
  misc_feature (2)..(328): n is a, c, g, or t
  misc_feature (338)..(338): n is a, c, g, or t
  misc_feature (344)..(344): n is a, c, g, or t
  misc_feature (358)..(358): n is a, c, g, or t
  misc_feature (363)..(363): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattattnaatagnttttttagtattanatttnattatatataaat

SEQ ID NO: 15017 - DNA, 945 bp, Diabrotica virgifera
  misc_feature (345)..(408): n is a, c, g, or t
  misc_feature (798)..(824): n is a, c, g, or t
  misc_feature (910)..(932): n is a, c, g, or t
gtgcattgaaaagacataggtacaaaaaaaaacgattcggtatgttttcatatattaagcacaatttatttgacttttctgatttgtttacttttgtggctgtcagtcagttgaatttttttgcggtttttgtcgaatttttgcgttttgaagtttctttatattacacaaacagttgttttcacatctaattttatattgggctttgaaattttaaggtaaataattatgttttggtaattaatatttaaaacatacaaagctaacgtcattcacacagtaaagaaatgattgtgtttaggtttccgtcaaagtgaataaaataacaaaaataacatatgttannnnnnnnnnnnnnnnnnnnnnnnnnnnnnnnnnnnnnnnnnnnnnnnnnnnnnnnnnnnnnnnctacttcaaatgtagctgtaattatgcacaaaaattttgaagcaaaacttacatttgacattctatatatttgataatgtcaaattttataataaaacccgtaatcggaacagtagccactttctgtcacttgttgttgcgtgaaatagatttcggacttatttcgtatgctttaaatgatgacgcacgggtaaacactcgcggactcgactgtagtttgtgcatttttaaacatcttatggtgagcttatacgggcaattttttgagcaataattgcccgacagcacgaatgtatcaatctgaagtaattaatggagcgatatggagcaattaaaaaaaaatgcggtaattgtttaatgatttaaatatcttgaccacagggtgtttcnnnnnnnnnnnnnnnnnnnnnnnnnnnagaaaccttagcacaaaatacgaagaattaacctaaaacgcttaaatgaaatattctcctacgagagaaaaagagggtgttttatnnnnnnnnnnnnnnnnnnnnnnngcccattgtttta

SEQ ID NO: 15018 - DNA, 760 bp, Diabrotica virgifera
  misc_feature (2)..(728): n is a, c, g, or t
  misc_feature (734)..(757): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnaga

SEQ ID NO: 15019 - DNA, 946 bp, Diabrotica virgifera
  misc_feature (5)..(28): n is a, c, g, or t
  misc_feature (199)..(219): n is a, c, g, or t
atatnnnnnnnnnnnnnnnnnnnnnnnntatgctgtgtattgtttatatattggggtattaacactgagggacttattattgcaagagtaaatagaagaaacagaactagtatttaactatttttaatgggagatgggccgcagttttgctaaaaaatgatttggttacgtttcgacgtccaaatcggacgccgttgtnnnnnnnnnnnnnnnnnnnnnggacgtcgaaacgttaatggaatcattttttagtgaaactgtggcttgtttaacattaaaaatagttcattgcaaaaatgccacaagaaaatagcttcagaacaacattaagaactagtatttaatcggtgtttatagatttgcatgctaaaaaaataatagatggcgatgtacggttgaaaacgtttttagggttgaagagaagcataagagaggagaagtaatttgtttcctaagttaaccctgttgcgaatctcagctgtttgaatgtagtaaatctaggtagctgtatgattactttaagtaggagcaaaatttcgcaccgatgtgttttaatatgtacatacatacataatcgaaaacctcttatacccgtaggtgtccaggctttcttaaattttgtcgacaaatttacgccactcttttctgtctctagctagttccttcgcctcactccatgtcttccctctttcttcgagaatctcatttatgcttctgttccatgtttttcttggtcgtcctctacaatttttccctattcttctcgcctcccatatcttcttcacctgtctagtttcgttcattctgatcatgtgtccccaccatttcaatttcttttcttctgcttttacctttagtgttttcgttccctagtcttgtctaatgtcttcgtttcttcttctgtctgttcttctaacactcagcactttccctcagtatttaattt

SEQ ID NO: 15020 - DNA, 109 bp, Diabrotica virgifera
  misc_feature (8)..(8): n is a, c, g, or t
  misc_feature (15)..(88): n is a, c, g, or t
ggtgatanaaaatannnnnnnnnnnnnnnnnnnnnnnnnnnnnnnnnnnnnnnnnnnnnnnnnnnnnnnnnnnnnnnnnnnnnnnnnnaccttaggggataacagcgta

SEQ ID NO: 15021 - DNA, 709 bp, Diabrotica virgifera
gttgttcattctaaaataatatcatattgtttatgaacatccttgccacatgtccttaatggatacacaattgacattcgagagaccaactatattgttacaaaataaaaagttcctcttatgaaccctgacaatcatatataataaaatcttaattacatagttatcatttacacactctaaaaaatctaggaatcaatgtctattaacgaaagagaagaataatccaactacttgttggaaagcaatgtcatccattgttacatatatcaattcctttataagataaaccaacttaagttattaacaacctatctatccttaattattatatcatattattcaaactcaatgatcctttatggataagattatgattgaaaatatattgccatttagttattcaaaaatcatgaacagtgagaatcatgctattctatcataaccaccgaatccctctaatatctaatcatcatctcatctatatacaacttgttcatcacaatatacattaattgtaatactgtgacacatcgataaatgctagtatgtatacaaaaagattgatagtacttatgcctttatatatgtgaaacgtcatggactctcttcccattctctttcatgctgtacactcaaaaaagatgatctcttgcattaatgttgagaacatccccctctcttcgcattaatgtctacgtacaactta

SEQ ID NO: 15022 - DNA, 112 bp, Diabrotica virgifera
  misc_feature (10)..(82): n is a, c, g, or t
  misc_feature (86)..(86): n is a, c, g, or t
gttaaaagcnnnnnnnnnnnnnnnnnnnnnnnnnnnnnnnnnnnnnnnnnnnnnnnnnnnnnnnnnnnnnnnnnnnnnnnnntttnattatatataattttattattggggg

SEQ ID NO: 15023 - DNA, 949 bp, Diabrotica virgifera
  misc_feature (854)..(854): n is a, c, g, or t
  misc_feature (858)..(859): n is a, c, g, or t
  misc_feature (865)..(865): n is a, c, g, or t
  misc_feature (884)..(884): n is a, c, g, or t
agatattgttccttagtttttgatgaaatatcattgtctcagaagttaagttacgataaatttagtgataaagtcattggttatgtagatcttggtccattgggtcgtaaaaatgagtatgctgatcatgcactagtttttatgctcaatggtctgcacaaaagttggaaacaaccaatagctttttttttacacaacattctgtaaaatcacatgatttgaaggttttaatttcacaagtgattagtcaggtagaaatagaaaccggtttgaaaatactgtgtactgtgtgtgaccaaggtgctacaaaccgtgctgctattaacttactttgtagggaaaataacgaaccagggcctcactttttcatcaataatcataagatattgacaattttcgacccaccacatttattaaagtcaactcgtaatgccatttaagtcagggtggttaacaaccattgcagccacaaaagagttgtggaatatttgtaaagatttgggatttaagtttttaagaacccgtgctctaaatcaagatcctttggaaaactcatttgcctctatatgccatctaggagcagaaaatgtaaatccaagttgctaccagtttatttcatcatttaaaacatctgttcttaataacttaattactccttcttctaataaaaattgtgaaacagatgatggctctattcttgataatttgcaagactttttggaaagttcaataaccaaaaatgattttattgatttagatgttttagatgtgaatgaaatagaaaatctagctctaccattacctgatacagatgttacaggtcatgaaggtaacacattagcatatgttgctgngttnnatatanaaaatctttaatcgattanagaatgtgaggtgtgtgcagctaatatcatatctgactgtttggaaccacacatacattttacat

SEQ ID NO: 15024 - DNA, 925 bp, Diabrotica virgifera
  misc_feature (159)..(176): n is a, c, g, or t
  misc_feature (364)..(408): n is a, c, g, or t
cgctgtattaatgttgttgctagacaggtaaattgtcattttataccgggtgtacgaatcaaactgttttttttttgtccaagttcgcatcatcctgtggaatattctagcatatataaggtactgaaattaaaacccaactatagcctcatgttttcnnnnnnnnnnnnnnnnnnattggttcgcttatgttggataataaaaaagttaggtgccttgacacctagccgtgttcttcatgaatgcaggatgtttctgaataaatgcgacagacattagggggtagttctgcaggaaaaagtgatgacatttgctttgtagacatatgtccgcgtctcggaaacgaagcgtttgcggacatgtnnnnnnnnnnnnnnnnnnnnnnnnnnnnnnnnnnnnnnnnnnnnntaaagcttttcataattatttggaaacaccctgtattgatgaagagcattactagttgttgaagtgcctattttttttattatctaatatgggcgagtgggtcaaagaacagaatgttaagaaagcctgagcatttgaattttaatttcagtattttatagatgctagaattattccacaggatgacgcgaaatttgagaaatcacagtttgattgttacacccggtgaccaggtatacaatgacaatttacctttttagcaacaatattaatacagcggccttattaaagaataaggctataacatacctattaaaaatcacttaaatgggacacaggtttaggaaattcgagacatcaaaaatagcccatgtttaaaaagatgtgttaagctttaagatggtatggacatgtataaagaatgccccgaagctcttcagcctaaaaatcctaaaaactaccaccaccgaactgaagtcgacaagtaggcctacctacaatctaagtggaaaacacg

SEQ ID NO: 15025 - DNA, 763 bp, Diabrotica virgifera
  misc_feature (617)..(641): n is a, c, g, or t
gtactatattttgttgaacatttatccacacagaagaacgagttgaaatattaggaggctttcgaagtagaagatcgtggaagagtaaaaagagaaaccaaagcgtgcgatcacacacggcttagactaggaccatgtaaaagtataggaagatcaacaaaattgagaacatagatgctacacaagacataaactttaggccgaaatcaagggctcactcgtaaatatcaactggaactctccaaaaaaattaaactggaatccctaaagcatttcattgtaataaactagaaagatgaagcatagaattattagtcaagataataatatacacaaagctgaactaatttcttaatcccccgcgttagatgacattgtaaaataaataagactcatagtataaagagtaataagtaattagaaaaaactcaatggcatcttatcggctattataataatcaaactgtctgaccttacaaaaaaaatacgatacagatgaaacaaaaacggtctttttctcaccgaaccctgcatggcaactgtaaaaagagaaactaatgatgaggctaccataccacgtccacgagacagcggacattcaaatgactctgtgcctnnnnnnnnnnnnnnnnnnnnnnnnntaaaacatggctacactaccgatagaagaaacacggtgacgaaatccttcattagacctatatattactactaaatatacaattatctatgactactagaatcatcattactagattgatat

SEQ ID NO: 15026 - DNA, 93 bp, Diabrotica virgifera
  misc_feature (4)..(92): n is a, c, g, or t
tttnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 15027 - DNA, 625 bp, Diabrotica virgifera
  misc_feature (3)..(67): n is a, c, g, or t
  misc_feature (69)..(239): n is a, c, g, or t
  misc_feature (241)..(394): n is a, c, g, or t
  misc_feature (396)..(514): n is a, c, g, or t
  misc_feature (527)..(540): n is a, c, g, or t
  misc_feature (542)..(566): n is a, c, g, or t
  misc_feature (571)..(602): n is a, c, g, or t
ccnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttgaccgcnnnnnnnnnnnnnncnnnnnnnnnnnnnnnnnnnnnnnnncaacnnnnnnnnnnnnnnnnnnnnnnnnnnnnnnnnctaatttataacgaattttattt

SEQ ID NO: 15028 - DNA, 996 bp, Diabrotica virgifera
  misc_feature (744)..(744): n is a, c, g, or t
  misc_feature (823)..(841): n is a, c, g, or t
atttaatcagtcgtaaaaaaatatacagttcctctaattggcttagctcacgctgggttaagctgatttcaatagccattagactaatagtatttatgaatgactgtttaattgacttcaaacgatttccataaacttaattacaatttacgccgttattaatcaaaactcatagttggcgcaacgatttgaaattgttctaatttcgaggcgaatcatgtaaattttattgcgtttgagtgacattgtattttccataatatgcgtgcggtgtcctttacattgcaaactatttgtatttgagtagtatcgttaaatttcgagaggtaaaatattgaatagctggtataataattaaaagtacaatagattaacaatactttctacctgtaccggaaacttaccacaccattcaaatacaaatgactgtaagcttaaaatttttctggaatattttaatggcaactataagtagtttccgcggtgaaacaccttgtatgcatttaaatggtttcggctcacgtcagcaatgaaagatgctcattcttttcagtataaaatccaaaactaatttgagactgaatcgagttgggtgataaagttgtaatacggtgcgatatggagtctggcgtaagattttttgtacacgctgtatcgacacaaattgtgcagtatttaatgtaagatcatccattcttccgtatcttccaaaactttttaaatatactacgtttaaaactctanagttgattttagtttccccaaaacagcaatactcgcggtttagttgagttgaaagtgtgatagacaggttttagttacnnnnnnnnnnnnnnnnnnncgatttgtattagttgtaatatacaatgaaagacggaattgtttttcgttgtgtataaaactttgtgtgactttttgaaatgtacatagttctagtataagtttgttgtgctgagccacgagaagtatctcggttggaattgttccttttttttt

SEQ ID NO: 15029 - DNA, 922 bp, Diabrotica virgifera
  misc_feature (4)..(19): n is a, c, g, or t
  misc_feature (216)..(285): n is a, c, g, or t
  misc_feature (494)..(511): n is a, c, g, or t
  misc_feature (867)..(867): n is a, c, g, or t
gatnnnnnnnnnnnnnnnnagttcatagtggggactacctagacgtctaagaaatccattaaaaagttaaagtggtactgaccagacggatctccttattcgacaagttacgtagttatttatctctgtctctccaaaagccgaatgtacaaaaccataatacgaccagcagtgacatacggaagtgaatcatggtcattgagaaagaaagtaatnnnnnnnnnnnnnnnnnnnnnnnnnnnnnnnnnnnnnnnnnnnnnnnnnnnnnnnnnnnnnnnnnnnnnnaaatgaatggaggagcagatacaacaatgaattagagactctcttcgagcagggaaacatcgtaagatacataaaagctaatagactaagatgggcaggccacgtagtacggagtgatgacaacagactgattagcaatgtgttttgtgagagaccagacgattttatttatttagcgtatggactttcacagtacgataaatacacannnnnnnnnnnnnnnnnncaaacactaaaatataatgagtgaatctaaatattaatgtccaatttacatagccattcaattgcttctggggagcattccacaaagtcctggagatttccacggtaggcacgatttagataatctgaaacacaattacttatggtctgtctaggtgatccacaatcgcactgtggactttctgcacgaccccatttgaacagagaatcagcacatttaccatgtccggtacgtatgcgattaagcctcgcccaggtggaccggggcagaccgatccaatgaaaccctgggttggggtggatatctgaatatagtctgctgctattgttggcatccatcttgtggaccattgcctntgtatatcataggaatcaccaattggttcgggcagatctggatgggaggatttct

SEQ ID NO: 15030 - DNA, 921 bp, Diabrotica virgifera
  misc_feature (93)..(111): n is a, c, g, or t
  misc_feature (907)..(907): n is a, c, g, or t
gtactaaaggtgagaaattagacctacattgtctgtccctcaaaaaataagcgttaaattgaggatttctaatgtcgacattaaaagttgcannnnnnnnnnnnnnnnnnnaaaacattttgatctaaaacttacagaaaacttctttgtactctccactttcaaataaatgtgattaagaagctaaattttaaacttcatcacacaacttttgcgattaaactttgcaatccacaaatccgcacctttttctttgaaaaattcataacctttatcataataagaataaaaacttgaagcaggtacctttgtcttcagaaacttactgtaaaaatttcagaaaaaaatattaaaatggaacagagttgtagcgaggtaaacgctacagcgttttacatgtctgctctaatgggatcaaggataagattaactacatagatactttgggtcgaaatggggctaaagaagaaggaacaggcatataaagcttcttgcgatacggcagctcatttgttgtgcggtggcaggtcgtggaatcgttagggggggtaagagggtttaaagaagactaactaccataaccaaaggatacttacacagacttgaggactttcctactatttaaagaaatttggacgccgtttgaaaaatcctcaaattcacatatcgagtacttactggacatattccgtacttgtgggaaccaattgggggacattcatcttagattcctcgtttgggtcaaactgggctattatttaccatcctatggcttctatgccatttctttttctttactctaaaacttatttcgtttgtattagacatctggttaataattctccaaaaaaaaggtacagaaataaaaataggtacattttataatgtttattttaacctttagacnttatttttactctg

SEQ ID NO: 15031 - DNA, 752 bp, Diabrotica virgifera
  misc_feature (200)..(221): n is a, c, g, or t
  misc_feature (406)..(423): n is a, c, g, or t
  misc_feature (430)..(449): n is a, c, g, or t
  misc_feature (640)..(658): n is a, c, g, or t
cccacgcgtccgcgcagtcaattatgccattatcacaagattccataaatgaacaaccctttaaccactgacctggattcgaaatttgtcaaggtagacattattgtgcaaattcttgaacaaaactgataccaatatggatcgatataaagactgttgaacttgaatgccataaaaactgtgctattatgcattaccannnnnnnnnnnnnnnnnnnnnnctaaaattccagttcatgtcaatttttccaaaaataaagttatagacactgtattaatagaatattcaagagattatttaaaataacaattttgattggtgtaattattattatcaacgatacgataggacaaaggtccgcattttggtaggtataaaactgtctgatcactgatcttatataannnnnnnnnnnnnnnnnnacaaacnnnnnnnnnnnnnnnnnnnntaagatgaaaactacgggattattgatttgtgtttgcatcattgcaatcagccaagtatatggtgacgaaaatcttccagatattaaagaaactaatgaacatccagaaactcaagctgcaagaccttttagaaaagaaggtaagcattacattaattttttcataggtacttgacgatgtacaataaacnnnnnnnnnnnnnnnnnnncatataatcaaagatttcctcttcttctacttcatctttctgtctatcagcaattctgcttgatcattgtgatcatatatatgttttgatagat

SEQ ID NO: 15032 - DNA, 904 bp, Diabrotica virgifera
  misc_feature (2)..(704): n is a, c, g, or t
  misc_feature (732)..(732): n is a, c, g, or t
  misc_feature (768)..(781): n is a, c, g, or t
  misc_feature (784)..(806): n is a, c, g, or t
  misc_feature (814)..(834): n is a, c, g, or t
  misc_feature (873)..(873): n is a, c, g, or t
  misc_feature (882)..(882): n is a, c, g, or t
  misc_feature (889)..(889): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagttcnaatcgataataaagattgcgacctcgatgttggatnnnnnnnnnnnnnnggnnnnnnnnnnnnnnnnnnnnnnntgttcgannnnnnnnnnnnnnnnnnnnntgagtttaaccggtgtgagcccaggtggtttctatcttntatttattnatatatnttagtacgaaaggga

SEQ ID NO: 15033 - DNA, 341 bp, Diabrotica virgifera
  misc_feature (2)..(334): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatta

SEQ ID NO: 15034 - DNA, 172 bp, Diabrotica virgifera
  misc_feature (2)..(44): n is a, c, g, or t
  misc_feature (52)..(164): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgt

SEQ ID NO: 15035 - DNA, 944 bp, Diabrotica virgifera
  misc_feature (106)..(135): n is a, c, g, or t
  misc_feature (362)..(380): n is a, c, g, or t
  misc_feature (651)..(669): n is a, c, g, or t
  misc_feature (691)..(709): n is a, c, g, or t
  misc_feature (738)..(738): n is a, c, g, or t
  misc_feature (902)..(902): n is a, c, g, or t
  misc_feature (904)..(904): n is a, c, g, or t
  misc_feature (917)..(917): n is a, c, g, or t
gaacaaagagatcagttacgttgaagaatgtgccaaaaacttaactcgtacttaagttgttttgaacggtaacacattcatgtttgaacatgtcttcaagatgtcnnnnnnnnnnnnnnnnnnnnnnnnnnnnnnaaccaatacaagatctacaagttagtgttatatatgtggagctgcatctaaaaactttaaccatatgactaaaaaattgagtacttagtaaaaaattgagtactgtagttatacggctgttgaatttggtctgtctgtattacaatgcaagaatccgaatgcttgaaaacgtttttcatttggcatataagttacccataaaaaagtatggagagaagagaactaannnnnnnnnnnnnnnnnnngtactcacaaaaaaaaacacattcaggaaagattgagaaaaaaagattgctagtcgagattcgaaaagccaatttcgagaacaataatgaagaatcaactctttgcaaaaagggaggtgcagtagtattgtttttttttactttttcttgtatgataagagacatccatctacctattaccaaattttcttaggtacctcctttatgtttttttttgagattttcagaaacaagatttatttagaatttgttttatggtgtacctacagcnnnnnnnnnnnnnnnnnnntagcaaatttgtgacgttttcnnnnnnnnnnnnnnnnnnnttacacattttacgttacatcgcatatanggcatggatcccgcatacaaaaaaaagttgattgaatgcaagctgaacatttgttaatagcttaacggtgtctgatcggacaaactttgatgtacgggagcactggaacgccagattgcgaaaacgcccatgtattttgtcgtacaaaacttccaattgatttngntagcgttttattnaactctcatgcaaaagtcgaactgcta

SEQ ID NO: 15036 - DNA, 873 bp, Diabrotica virgifera
  misc_feature (48)..(70): n is a, c, g, or t
  misc_feature (198)..(225): n is a, c, g, or t
  misc_feature (828)..(828): n is a, c, g, or t
gtggaatgcaaaggtagtttttgatttgaaatatctcagtggcgtacnnnnnnnnnnnnnnnnnnnnnnnagaccattacccgtaggtgcgcaaatgatgaatataaaattgttatttgtttgccaaaaatgcgcaataactacctcttgaaacccaccaaaagtggttttcatgtctcaaccggtcttaataaaagnnnnnnnnnnnnnnnnnnnnnnnnnnnncgcagtttgaagggagaattttcggcaccccgcaccttggaagcgaagcatttgcggacatgcgtttgtagagcaatctgtcattgtttttacatgtggaattgccccttgaagtttttcatacttacttgctaacaccctgtatatgatagtaaatttatcttgcgaaagtggcgccatcgtgcgttgaaactaagtacttatcggaccgctctcatgtatccaaaaaaacaaatgttatagaaacatggtatacatctaaagttttcgagctaggaagatatcttaattcattatgtagatttaggaaatgggaaaacagaaaacaaaaagggtactaactccctaaaactttgaataaacaatgtagtttaaagaaaatagcttaagtattaatatcgcagttttctcaattactctcattatgcatataatatgtttcagttccatgttccacattcttattatttaataacacatggaaatttagaataatataaggcagaacaaaactaatagtgatatactaaatgaaaagacatataagtacgtgattttattctgcccttttcagtgaatattcatgtttttgcatagtataanaatatttttcagaaatatatagcctcatctctttaacagttagga

SEQ ID NO: 15037 - DNA, 695 bp, Diabrotica virgifera
  misc_feature (3)..(24): n is a, c, g, or t
  misc_feature (26)..(43): n is a, c, g, or t
  misc_feature (49)..(76): n is a, c, g, or t
  misc_feature (108)..(142): n is a, c, g, or t
  misc_feature (166)..(179): n is a, c, g, or t
  misc_feature (182)..(208): n is a, c, g, or t
  misc_feature (220)..(236): n is a, c, g, or t
  misc_feature (239)..(268): n is a, c, g, or t
  misc_feature (289)..(330): n is a, c, g, or t
  misc_feature (335)..(394): n is a, c, g, or t
  misc_feature (398)..(464): n is a, c, g, or t
  misc_feature (468)..(527): n is a, c, g, or t
  misc_feature (529)..(549): n is a, c, g, or t
  misc_feature (588)..(601): n is a, c, g, or t
  misc_feature (603)..(621): n is a, c, g, or t
agnnnnnnnnnnnnnnnnnnnnnngnnnnnnnnnnnnnnnnnngtgatnnnnnnnnnnnnnnnnnnnnnnnnnnnntttagttatttgaaccttgatggatgagagannnnnnnnnnnnnnnnnnnnnnnnnnnnnnnnnnnagataccttagatgaataaaggannnnnnnnnnnnnngtnnnnnnnnnnnnnnnnnnnnnnnnnnngagctgaaaagnnnnnnnnnnnnnnnnntannnnnnnnnnnnnnnnnnnnnnnnnnnnnnttatgtaattcgatattaatnnnnnnnnnnnnnnnnnnnnnnnnnnnnnnnnnnnnnnnnnncaagnnnnnnnnnnnnnnnnnnnnnnnnnnnnnnnnnnnnnnnnnnnnnnnnnnnnnnnnnnnnttcnnnnnnnnnnnnnnnnnnnnnnnnnnnnnnnnnnnnnnnnnnnnnnnnnnnnnnnnnnnnnnnnnnntagnnnnnnnnnnnnnnnnnnnnnnnnnnnnnnnnnnnnnnnnnnnnnnnnnnnnnnnnnnnngnnnnnnnnnnnnnnnnnnnnnggaatgatgatggtattaggattaattaattgcatatgnnnnnnnnnnnnnngnnnnnnnnnnnnnnnnnnnggaacctttctgtcacctgtttattatgaacgtgcctgtttgtatgaccgatatagtgtcgcctgctcactgat

SEQ ID NO: 15038 - DNA, 951 bp, Diabrotica virgifera
  misc_feature (911)..(911): n is a, c, g, or t
gcaaagcaaagtttttttctctcgttaaaacaacaggataacaagggaatggtgaatccagcgacatctgagcggacgaactcgccaacagtgcgcgtcaatattccaccgccgacagtttccgacaaatcacaaccggccaagcaatcgacgaagataaggctgcgacgtcgaataacaattccatttatactcaacgctgttattgcgatctcagccttctagaaaagtggctttccatatgcggatccatcggtttttcgtatttctcgccttactagtcctattggaatatggattcattccgggcaacaagctgggctactactgccaggatcctcaaatatctcacaaatacaccggtgaagtgatctcgccgatggttctgggactaggatctcttctagtacctctaatagctttgttagtgactgaagtattatcgaaacaaagttttaagaagattaacgtaagagaagtatggtactactacagagaatgcgccactggatgcatattggtacttctgttgacagaatttgctaagatcttggttggtgaacatagaccacactttttagatgtttgcgcacctgacacggcgagtagctgtcgtgcgaacgagtatgtagatacgtatatttgcacaaatcccaaatatagcaaatactttctgatagatagttcaaaatcgtttccatcgggcattcttccgtctcatggtttataggagcattttctgcatatgtcattcaaacaagactgtctaccatgtacaccggccgattactgaagcccttcctcatctcagtgtgccttttctggtccattttatgctctctcacaagaataactgacagacgacaccactgggtgggacgtcctagccggatgcgtcctgggacttctangagcattatacacccgtgaaaatagtgcacaagaaaattt

SEQ ID NO: 15039 - DNA, 939 bp, Diabrotica virgifera
  misc_feature (883)..(883): n is a, c, g, or t
  misc_feature (891)..(891): n is a, c, g, or t
cgaagcaaaaagctgttacatgaagaagtagcgcagttattaagcacaacaacaattgcagggtttgcagctggcaaaacaaaaactgataaaaagcgagttcttcttatggatgaagttgatggtatggcaggaaatgaagataggggtggtatccaggaactaataaatctcataaaaacaaccagtgtaccgattatttgtatgtgtaatgacaggaaccaccaaaagatgagatcattagttaattattgttttgatttacgatttagtaagcccagattggagcaaattcggggtgctatgatgtctatttgtttcaaagaaggtctaaagttatctccaaatattttgtcagaaataatatctggaacaggctgtgatattcggcaaactttgaaccatctcaccatgtggtcggcccaaaaagacaatctcactctcgaggaagttcagaacaaagcaaaacaatctaaaaaagatactgttctgggtccgtgggaagtggttagaacagtttttactgaatctgaaaagaagaatatgagcgtagctgataaagctagattattcttttacgattacagcatggggccactttttgtgcaagaaaattatttgggagtcacacctaattgcccaaagtctgaggttatgaaacgggtagcactagctgcagattccattagcagaggtgacctaatagatgcaaaaatcagaggatccaataattgggcccttttagaaagtcaagcgtttttcgcttctgttctgcccggtcattatatgtccggacatgtttccagtaggatcaattttcccaggatggtaggaaaaaattcagcagcaaataaacgtaaaagaatgcttaaatgactacatngtcatacnagaatgagtacatcaggaagtcttttggctatgaaattggactacatc

SEQ ID NO: 15040 - DNA, 544 bp, Diabrotica virgifera
  misc_feature (2)..(505): n is a, c, g, or t
  misc_feature (507)..(522): n is a, c, g, or t
  misc_feature (530)..(530): n is a, c, g, or t
  misc_feature (543)..(543): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnatttatantataaatttattnt

SEQ ID NO: 15041 - DNA, 758 bp, Diabrotica virgifera
  misc_feature (11)..(26): n is a, c, g, or t
  misc_feature (28)..(45): n is a, c, g, or t
  misc_feature (53)..(82): n is a, c, g, or t
  misc_feature (84)..(132): n is a, c, g, or t
  misc_feature (154)..(176): n is a, c, g, or t
  misc_feature (183)..(215): n is a, c, g, or t
  misc_feature (340)..(360): n is a, c, g, or t
  misc_feature (451)..(469): n is a, c, g, or t
  misc_feature (505)..(524): n is a, c, g, or t
  misc_feature (562)..(581): n is a, c, g, or t
  misc_feature (623)..(641): n is a, c, g, or t
  misc_feature (653)..(674): n is a, c, g, or t
  misc_feature (676)..(704): n is a, c, g, or t
  misc_feature (707)..(751): n is a, c, g, or t
attttccttcnnnnnnnnnnnnnnnncnnnnnnnnnnnnnnnnnncagaaacnnnnnnnnnnnnnnnnnnnnnnnnnnnnnncnnnnnnnnnnnnnnnnnnnnnnnnnnnnnnnnnnnnnnnnnnnnnnnnncctcccccggattattacctcnnnnnnnnnnnnnnnnnnnnnnncaatttnnnnnnnnnnnnnnnnnnnnnnnnnnnnnnnnncataaccatttcacataatttttttcgtaatgaaatcgttattcgtttctaaccatatctcattttttaagacataaactaaatttatttattacccctacatttataattaaatatctttctcnnnnnnnnnnnnnnnnnnnnnacggatgagcctaaaaatcccatttcattacaatttaatttttaactcaaaatcacgattaaaaatttccacaccccacaatatgttatcnnnnnnnnnnnnnnnnnnncatttttcttcttcataaattttctcctcaactacnnnnnnnnnnnnnnnnnnnncagcactgctgataatattcgtattacaaaatcgtacnnnnnnnnnnnnnnnnnnnncttaataccggaattcggcaacatcttttcacctgcttatcnnnnnnnnnnnnnnnnnnnctacatctaacnnnnnnnnnnnnnnnnnnnnnncnnnnnnnnnnnnnnnnnnnnnnnnnnnnnccnnnnnnnnnnnnnnnnnnnnnnnnnnnnnnnnnnnnnnnnnnnnnctggatg

SEQ ID NO: 15042 - DNA, 68 bp, Diabrotica virgifera; identical to SEQ ID NO: 7442

SEQ ID NO: 15043 - DNA, 915 bp, Diabrotica virgifera
  misc_feature (878)..(878): n is a, c, g, or t
  misc_feature (891)..(891): n is a, c, g, or t
aaaaatagcaataaatctataaacacaagtgagaaagaaaaggtaccagaagatggacaacaaagaccacaaagaaaacaaagtattatagaaaaacaggtgactttggaagatcagatgatctgcggcgccctccaaaccttaaacgaagaagcctgcgaagacgtgatggaggaaacagaagacaccaaaataaccatcgagcccgacgtgccacaaacgtccgtgattccgcccagtccagaccagaatcaagatttcccctccagaggttaccgttctcgtaccaacagtactagcggcataggtgagacagattttattttgttgcaatcctcgcctgtaggtcacatgcattggcaacctatcagtatcggcgttgccggtaattcggaaagtttgagcgatcatagctcgaggtgcagttctcaaccaccttctccagttccagaaagaaaaatatccgtaggcagtatgggcaaatattcaaatttaaagtccagttccagtgaaaattcatcaaaaggccgccacgtggtcatcaaaactgagttgccagagactaatcctcgaatatgtattagcaccacgaaggcatcagtctcatatgaaactccacttttacaagaacacaagacaactgcttcacagacaaaacaacgaccaagctccttgaatttccacaaaggagaaagacggcttagaactcgatctaagtctatagataatagtcctaaaggagaaaagagagaaaacaagattaaccttgatacattacataggttaaaagagaaattgttacattctagtccagacttaaacgagaccagtgataacgagagcacacctctagtatcagaagtttctacaccatctanatctggacacagntcagagatcaaaacacccagttct

SEQ ID NO: 15044 - DNA, 993 bp, Diabrotica virgifera
  misc_feature (224)..(237): n is a, c, g, or t
  misc_feature (239)..(256): n is a, c, g, or t
  misc_feature (787)..(807): n is a, c, g, or t
  misc_feature (875)..(875): n is a, c, g, or t
  misc_feature (881)..(881): n is a, c, g, or t
  misc_feature (888)..(889): n is a, c, g, or t
  misc_feature (898)..(898): n is a, c, g, or t
attaacatttgctttaaaaagaattagttatttaaatttaaaagtacagaatgatatattaaggcaattcttctgtctataccaataaaatcaaaggcactattaattcgactatatctacattttccttttttaaattgattgcaaaattttgttgtaattttaaatctggctaaaatgcataattttaatttcgtccattttgtataaataataggtactannnnnnnnnnnnnncnnnnnnnnnnnnnnnnnncgtttgacaaatttttgattatttgaagacatctaatgtagacctatttcctcgctagattagcaaaactatacttctataaacaaaacccaaaaggttttttacatcaataatacatctaaaggcttgggtaattcataaacgaatgattgttataacatttaaaatacaatgcctacatttttaatccccatttctttaacaccattaaggaaaactacaaaaatttttaaatgatacataaatacaaaagtttaacaattttataacgacaaaggttctgattatttcgaaggtaaaataagatcacattatttcgacgccacgctcccaaaaagttaatttctctaagaataatcaaaaagcctcaaggtatactctatttttaatgatacagcgaaagcttggaaaattcgtaaaaggttaattattggtaaagtgatattctggtccaaagtaaaatcttccaaaaccatttcaaatacgacgcatatatttttgaccccgtttctaataaaactatattaagcnnnnnnnnnnnnnnnnnnnnnggatgctagagaaatacaaaggtttgactattttatgacatcgaaggtataggttatttcgaaggtancataangtagaanntattcgacngtacatttcccaaaaatatattttacctagaaaaatcaaaatgtccaaatgtagatttcttttatttgaatgatacagcgaaagcttgcgaattt

SEQ ID NO: 15045 - DNA, 864 bp, Diabrotica virgifera
attaccatttgcttcatagagaattaattatttatagttaaaagtacaagaatgaatatatcaatggaattcttctgtctataccaataaaatctaaggcactattaattcaactatatctacattttccttttttacattaattgcaaaactccgctgtactcctaaatatggataaaacgcataaacttaatttcgaccattttgtataaataaaaagcactatgaataataaaattctaaaatttttgaattaatacacaacgacaacattatgtagactatttgcaaacgtctaatgtacacctatttcctcccgatattataaaaactatacttcaatcaacaaaacccgaaaggattcttacgtctataatacatctaaaggcttgagaaattcataaacgaatgaatgttatatcatttataagacaagggctacatttttaatcaccatatctgtaccaccattaaagaaaactacgaaaatactcacatgatacactacatcacaaaataccaagcaatctctctatcataccacaaaggcctcatgcataactttccacggtaatagtaagatcacattatatctcgacgccacgctcccatgaagaaaatttctctaacaataaccatacagcctcaaagtatactctatttccaaagatacacctacatcttgaaaaatacccaataggttacttataggaaaagtgatattctgacccaaagtgaaatctaccacaaccatttcagatacgacgcatacattcttgaccccgaatctaatagactatatgagacataactatctaaacaatctgatatgatatagacaacaaaagtttgactattttatga

SEQ ID NO: 15046 - DNA, 995 bp, Diabrotica virgifera
  misc_feature (901)..(901): n is a, c, g, or t
gaacaatacaagccattttttaaatacatcgttggattcattattattattactggaaggtatgcttttgctgataatatcaaattgaaagatgtcctcagaaacagcaataatagatccggaagcaataattcgagtaataataactataacagcaataatgacgatgatattttaaaatcagaagttacaaaagttgttgaactttgtggttcttcaggaaataacagaaatcaagaaaataacaataacaggtattcgggaaatggtgataacactgatacatatcgaagaattaacagtaacggagactattacaaaaacgtgggatacagtaacgatgattatggggaaaagaattatggtcacaattccagaaacaaccgacaaaactctaataaccgtaataataacagaaatgataggtatggactttctaatagttatagtgataatgatgataacccatacacttcatctaatagaaacaatcacaataacgatgataacccatatacttcgtctaatagaaacaattacaataacgatgataacccatatacttcgtccaatagaaacaatcacgattctgaaaggaataataatccttataacagttttggtaacagtaataatccctattcaagctctagcagttacagcaacaactacaatgacaacaacagaaatagaaacaacggttattccaatagaaatctaaataacatgaacagcagatataattctgacggtcaaaacaatggttatggattcaacaacagacataactctaatggtttcaattataatggtggtggtgatgcttacggaaatgattacaactacggatatgacagtaatagccgtgatgcgatgggaaacagcaatactcaatcaactncagcagaaactgtgtacggatataacagagaatatacacgtcaacatagaaatgataaaaaacgaagggtataaatgatgatgccctactcttt

SEQ ID NO: 15047 - DNA, 957 bp, Diabrotica virgifera
  misc_feature (337)..(349): n is a, c, g, or t
  misc_feature (352)..(374): n is a, c, g, or t
  misc_feature (833)..(833): n is a, c, g, or t
  misc_feature (870)..(870): n is a, c, g, or t
  misc_feature (872)..(872): n is a, c, g, or t
  misc_feature (914)..(914): n is a, c, g, or t
  misc_feature (930)..(930): n is a, c, g, or t
cggacgcgtggggtactaaagtgtcacatttaatccctccgggattaaatattgacgaaactcccggaacgattaaatcacaaacaaacgaatttaagggatattttattgaaaaatataattaattagaatggtaattaacgttaatattcaaattaatattgtgacagttcgtcatattgaccagtctttcctgggttaatgcagcaggtaactgacgagtaacagataggtccttttcatattgaactggtgtttgtttcgaagatcctgcggaaacaggaagcgagaatgaggactgtggcataactatagtggacgaatcggcgacttgacnnnnnnnnnnnnntgnnnnnnnnnnnnnnnnnnnnnnngacgattcaatatatccctcggccacgttggaggatttccatcctccatgtctcttcagcacgtctattgttgctcccgaatcagctaacaaagacgcagatgtgcgtctaaaacaatgtcccgtataagacgtcgcattttctaatttcaagaaagctgctatttgccgtggaattgtaccaaacatgttttttcctactactcgcgtagtacattctttgttgatgtattgaacaaaaaattttgaatgagttgtccctgtctttcgcaatgccacatatttccgaaatatcgccacaaaactgatggcactgttttctgaatttttgatcacaaaatttcggtcaattttatttttggtgtttctaatcgcaattaggaaggaatcgcccaaatctctcacatcgtcgatttctaaatcaaccaactcttttccacgacaagctcccgcaacgccncaaataagtgcaacctacaaaaaaattgatttcttananattctgaatataaacaaatttccaaatttaccttaagcattnaatatttatcatccgnagcctcccgtaagaactgatctacctg

SEQ ID NO: 15048 - DNA, 125 bp, Diabrotica virgifera
  misc_feature (2)..(103): n is a, c, g, or t
  misc_feature (107)..(108): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttnntttagtattaatttatt

SEQ ID NO: 15049 - DNA, 137 bp, Diabrotica virgifera
acaaaatttatcgttttattaaattttgtcatacaatggaagtacacaacgcctcctttcactcatacaagttatacatataaacttaaaaactacgtttacatcatactagagttaaataaagaaaaacataatac

SEQ ID NO: 15050 - DNA, 635 bp, Diabrotica virgifera
  misc_feature (27)..(44): n is a, c, g, or t
  misc_feature (127)..(146): n is a, c, g, or t
  misc_feature (206)..(241): n is a, c, g, or t
  misc_feature (250)..(268): n is a, c, g, or t
  misc_feature (344)..(356): n is a, c, g, or t
  misc_feature (359)..(420): n is a, c, g, or t
  misc_feature (519)..(553): n is a, c, g, or t
gggggggggggcgggtgtggggcgccnnnnnnnnnnnnnnnnnnggtgggggcgggtgggaggggggtggggagggacgtgcgtgcggtggtggggggggagggggcggttttttggtcggggtgtnnnnnnnnnnnnnnnnnnnnggtgggcaggccgttcttggggggtgtgggggggagcggggggggttgggggagggggcnnnnnnnnnnnnnnnnnnnnnnnnnnnnnnnnnnnntggggtgcnnnnnnnnnnnnnnnnnnnggtgtggggtggtgatggtgtgtgggtgtttgagggggtgggggtggggtgggaggggtgggggggagaggaggtnnnnnnnnnnnnnttnnnnnnnnnnnnnnnnnnnnnnnnnnnnnnnnnnnnnnnnnnnnnnnnnnnnnnnnnnnnnntgagtgggaggtgttggtggggcgggtgggcggtgtgtggtttggttggggggggagggggggagcgtggggggcggagggtggcagaagggggtggtnnnnnnnnnnnnnnnnnnnnnnnnnnnnnnnnnnntggtgtggtggggggtggtttgggtgacgggaggggcaggggtgcgggggggtgtggatagagggggggggggtctgggggg

SEQ ID NO: 15051 - DNA, 846 bp, Diabrotica virgifera
  misc_feature (4)..(286): n is a, c, g, or t
  misc_feature (291)..(474): n is a, c, g, or t
  misc_feature (483)..(548): n is a, c, g, or t
  misc_feature (562)..(671): n is a, c, g, or t
  misc_feature (693)..(758): n is a, c, g, or t
  misc_feature (766)..(834): n is a, c, g, or t
gggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgtgtnnnnnnnnnnnnnnnnnnnnnnnnnnnnnnnnnnnnnnnnnnnnnnnnnnnnnnnnnnnnnnnnnnttgtgggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccgggcccccccccggcgtnnnnnnnnnnnnnnnnnnnnnnnnnnnnnnnnnnnnnnnnnnnnnnnnnnnnnnnnnnnnnnnnnnataggagnnnnnnnnnnnnnnnnnnnnnnnnnnnnnnnnnnnnnnnnnnnnnnnnnnnnnnnnnnnnnnnnnnnnnagaaggagaaag

SEQ ID NO: 15052 - DNA, 958 bp, Diabrotica virgifera
  misc_feature (21)..(47): n is a, c, g, or t
  misc_feature (61)..(78): n is a, c, g, or t
  misc_feature (460)..(479): n is a, c, g, or t
  misc_feature (545)..(563): n is a, c, g, or t
  misc_feature (778)..(797): n is a, c, g, or t
  misc_feature (924)..(924): n is a, c, g, or t
gtaatatgtttattacagagnnnnnnnnnnnnnnnnnnnnnnnnnnnaatacaatgatttnnnnnnnnnnnnnnnnnntcctaatcgtaaataaaacaagatattaaaatatattataaagtaagatatataaaggagtgtcggcattcacggcctgtatcttcgttctagtaacacattggtttactgtattcagactacggtctataaagccggaaacaaatgtatccttgtaagacacattttgatgtgaccaatttttttggtaataatttacattttgcaccgcttaaaaaattaatcaaacaacttatcaacttattcctaatatagagcttaatttatagaaaactaactagtcgaaccaaaatttggaaaattgttatttggagagcaaaatcctttatcttccaaatttgttctcaatcctcaaggtccgaaaaagtaacaataagcacannnnnnnnnnnnnnnnnnnnttaaagtgactttaatagttatggaacgatagtaaaactataattttaaaattactttaccatacnnnnnnnnnnnnnnnnnnncttctatttacaaactgtatttcacaattgattgataatttcacaataaatatgatggctttaatagttatggaacgatagtaaaaaccgtatttcagtgatgcggtttttctaatacatcaatttaagagtaaaattaaaagcacaattaaaacaaaaatatatcgttatatttacaaattaattgataatttcacaataaatctattgagtgnnnnnnnnnnnnnnnnnnnncataattaaaacaaaaatatatctttctatttacaaattcattttatttcacaatggatcgataatttcacaatgaatgtattaaaggcttttataagtatagaacgatagtaaaaacatatttcangtgatgcgttttttactaagtactttttactgat

SEQ ID NO: 15053 - DNA, 964 bp, Diabrotica virgifera
  misc_feature (683)..(704): n is a, c, g, or t
gtcatgttgtcaatttatagagttaacattgttgattaaacatgtaaaagtaaaatatttgtaagaattaaagtattctaaaggtatctgataaagtgagtctaaccgaggctcaattctcagcagcaagatggtcatggaaaacagtcttttatcaaaatatgtaacaatattcttagttgttagtggatattggatagtttcaattacaactgtttttgtgaataagacattattaagtaatattaatttagatgcccctatgtttataaattttacacagacactcattacagctgttatttgttattttaagaaaagtctgagtgatgtttaccccaataagttcaaatttccagatgtagatgtatgggacaagcatactgttaaaacagtcatgcctttgtcactcttttacaacaatgatctgcaccaacaatttgtgtctaaaatatgcatctgttgcttactattatataggaagatcattaactaccatatttaatgttatgtttacatttctaatattgggagagaccacttctaaaagttgtatagcttgttgcgcagtgatcatttctggattttggctaggagtagatcaagaaaatcttgcagggagcctatcgataccaggatttgtttttggaatcctgggctcactatctctttcattattctcnnnnnnnnnnnnnnnnnnnnnnccaaaactaaacggagaagtttggccattatcatatgttaataatgtatacgccagtattcttcttttgcctgtaatgatattaaacaatgaaattaaggagctgtataactatactaatttcggcagcccatacttttggtctatcgttgtagcaggtggactatgtggatttaccattggatttttttacacaatgcaaataaaatatacatcagcactcacacataatatatcccggaactgctaaagcctgcgctc

SEQ ID NO: 15054 - DNA, 872 bp, Diabrotica virgifera
  misc_feature (2)..(830): n is a, c, g, or t
  misc_feature (832)..(862): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnattatttatt

SEQ ID NO: 15055 - DNA, 983 bp, Diabrotica virgifera
  misc_feature (836)..(836): n is a, c, g, or t
  misc_feature (872)..(873): n is a, c, g, or t
  misc_feature (916)..(916): n is a, c, g, or t
gggcttcaaagcgtccgatgtgttctaaatttaaactagatcccctaaatagtttgtcttcttcttctttttcttcttcctctttttgtatagtcatgactatatgttttttcaatgtgcctccagtttctatcgtttttgttataattcgacttaaatcttcacttcattctactcttccgtctcttactctgtaattaattttatctacctcgcatctcagtcgcatagcgtcttactatcgattttcgaaatgttttcatctttgctgtttctaattagcaatgttttgtcctctctgcgtcaagtcgtgtttttgacgcatatgtcattattgatctgatgactgttatataaattctgcctttcatttcttttcagatatttttatttctctatattgtttcattcaagcaacctgcggctctctttgctctattcacttgatcttccacttctgtttcgagctttccttagctaaatagtgtgatgcctagatatttaaactccatcacttgttctatctgaccctccagctctaatttacatcttagtagatttgctggtataaccgtgtattttatcttttttcgggaaattaacatgttcaattttctggcgtttatattaaattggtatagcatacgttgtaagtaaatcatcttcattttgaaatattagtattgcatcgtctgcattgcagtttattttaagttgtttttctcccatttgatatcctcttttagtagttacttttttattatttcatccatgaggttgaacaataaaggactcagggaatctccctgtcttatcccattgtcagcgtcaattgngtaagttagttcttcttctacttttacttttattgnntgtgtctggtagatattttcgatcgttctaattattcttagangtacccctctcttgagtacaaacaatggataacgccctttaagttaccctgtcagatgccttgttaa

SEQ ID NO: 15056 - DNA, 968 bp, Diabrotica virgifera
  misc_feature (49)..(68): n is a, c, g, or t
  misc_feature (928)..(928): n is a, c, g, or t
cggcactaaattctatattgatttttattgtggatgaagttggcagccnnnnnnnnnnnnnnnnnnnnccattctcgatgcaaaggtttattcaagatagatagagttattccctggatttgttaatcaagagtaatttgtagttgttagaaatacatattttcgtgatttatagaaaaacgctagataaaataaagtattcagcttgcacatagaaactgaacttattgggtgaacacattatgatgttcgaatttccttttggcaatagtatgtatacctaccgctagaagtaatataataaaattggtaaagtatatcaaaggtatcctgaaatatctaatagtttatatttttatgtggaacttagatttgtaaaacaaaacaagaataaagcattgtaatacaccacaatactttctaccatcactaatcacctcattaaataatgacatgcaaaacttataggctacaaaaatttgagatgtaagatgtaatcacctcatttgaaattcaaaacttataggctacaaaaatttaagatggttaactttacattgtaagaaatttacatttggcaaattgttcataagggcaatcgtagctgcccttgtttaaagtctctgaactatataataggctgttaaataagttttgcggttctccctgaacatcaatacacttgttccttgaagtgtacaatccctgaagtgaaaatctatgtagaaggactgaaatacgattacacttacacagctgttgtgacctattcatttgatgaaaagtgctattcacgcatgatttctgtttttggacatctctgactggatcgtcttcaggcttgtacaccatgtctaaatcagcacccattttctactgtactacttgtaattgaggcgaagagtccttatatactgtcaacattcgntcataaatttcctatgctttttaatcttccaaaataaaaa

SEQ ID NO: 15057 - DNA, 628 bp, Diabrotica virgifera
  misc_feature (15)..(561): n is a, c, g, or t
  misc_feature (563)..(578): n is a, c, g, or t
  misc_feature (580)..(600): n is a, c, g, or t
  misc_feature (604)..(626): n is a, c, g, or t
cctccgggcggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnannnnnnnnnnnnnnnnnnnnnttcnnnnnnnnnnnnnnnnnnnnnnncg

SEQ ID NO: 15058 - DNA, 889 bp, Diabrotica virgifera
  misc_feature (479)..(512): n is a, c, g, or t
caatttttagaaatagtcaatttaggtgcatttagaaacgcagcaaacttcatcactttcgtcggattggacaaacctccggttccctccaacagtgaagacgcctgcggcataaacaggggcaacatcatcttttgcgtcaacctccttctaggtgccgtcaaacgttgtgcttggccagacgatcctgaacgagcgacccgtggtggatttgtggtgtctcttacagaatctggcaaccctgtatgccgaaacccggcagctccccacgttgtacctctactgccacatattctttctttaatcaagatatttaacgaactgttcactcctgagactcaaagtttaattcatgacagttataaaggatgtttagcaatgcaagagactgaacgaatgaacctcctcggattgatgggccacactataggaactgaagcagcggaatcacaagtggtgcaaagcccattagagaggannnnnnnnnnnnnnnnnnnnnnnnnnnnnnnnnnctatcacatgatgggctctctagggccctctttaggaagagatctgtataatataccggatcttggcctggcgatcgtcaacagtgttttgtcatttatacaatatattccagattatcgaattaggccgataattagggtgtatttgaggcagtttattttctcttgccccgcaccattttacgaagtcgtcgttctacctatcatgacacatctttctcccataattttgtcgaggttacatacaaaatggcagcaagttatcgagttccgcaatcgcgaagcccaagaggacaaccaagacacccaggaagtactagaggacattctgacccgcgccataactagagaatacttagatcttttgaaagtcgctc

SEQ ID NO: 15059 - DNA, 914 bp, Diabrotica virgifera
  misc_feature (784)..(784): n is a, c, g, or t
  misc_feature (810)..(810): n is a, c, g, or t
  misc_feature (823)..(823): n is a, c, g, or t
gtcaagtcaaaatagtgaattcgattttttatttttagtgtataaagtattgatgatgttgtaaaccaatactttattgaatgaatacccttaatgaaaaacaaagtattcattttaagacatgaggaccacctgttatttgttattactattgttattgtctacgtctctatgtgaaaattctaaaagaagactgtctagtttagaactagtaaaagacaaagattctagactattagttttttcaactttggatggtactttgactgggattgaacagaattcaggcaacgtaaaatggacagttaaagaaaaacctattgttcaagtcccactgaaggtttccaatgcgattgttcctttttatctgccagatccaagagatgggtctctttatttgattggagatgtgagagagcccttgaaaaaattaccatttaccattccgcagttagtttccacatctccttgtaggagttcggatggaattttatatacaggaaagaaaaaagatacatggttcaaattggatcccaaatctggcaagaaacagctgatcatgggctgggatgattacagccctacatgccctatagacacaaaaagttctgtctacattggcaggacgcagtatattttaagaatggttgatgagaaaaagctgataataagtggaacattactttttatgattatacagctaggcctatgggtatcgaagaactaaacaattatgattttgtccatttcacatccacgtctacaggacaggtggtaacattanaccgccgattaggcaatttgctgtgngagaaagatctgngtagtcctgtcataggcgtgtatttactcgattcggaagggctgttatctctcccattcacttctttagctaaccaacctttatctattgc

SEQ ID NO: 15060 - DNA, 947 bp, Diabrotica virgifera
  misc_feature (763)..(782): n is a, c, g, or t
  misc_feature (913)..(913): n is a, c, g, or t
gtgttgcaaagatatagtgctagcaaaatattttgtagaaatgattaacaaatcaaaagtgactgtgatacttgtgttatatgtgataatttgtgatattgagtgtcgaagatttggtggtggttttagaagtagtggtttcaggagtagtggaagccatatttcttcgcatccatcatatcactactcatccccatcatactcccatccttcctatcacccttccccttcctactctcacccttccccatcctattctcacccttctccatcctattctcacccttctccatcctattctcatccttctccatcctattctcatccatctccatcctattcccatccttctccatcttactctcatccctcgccatcgtattcccatccctctgcagtaagtcatccatctgcgccaattccagcatatcatccacttccagcagctccagtttacaggccgataggatggaacgttggaggatcccatcccgacagccatgcttcgtctggtccgattggaccacctaagcatgtttctggtgttggcagctccaatacgaaccatggtccagaaattacaagaccgataggattcgcaactggaggatctactggacacaatatcgggtcacagcctattggaccaccaaaaactattgcaggagtgggaaattctggagctcactatggagaaaaaccaccagcatataaccccaactacaaccctgctgggtacggacatccaccagcgtataatccnnnnnnnnnnnnnnnnnnnncagtacacaactcaccacaagctggaggcggttttaatttcccgccacctgcctatagtccagcaggccatccaggttatagctcaggtggatatcatgcaccacctgcttacagtgcaaatcccagtggnagtcatgtaacgattatcaacaaatataatcatc

SEQ ID NO: 15061 - DNA, 241 bp, Diabrotica virgifera
  misc_feature (2)..(236): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggt

SEQ ID NO: 15062 - DNA, 846 bp, Diabrotica virgifera
  misc_feature (3)..(627): n is a, c, g, or t
  misc_feature (644)..(667): n is a, c, g, or t
  misc_feature (698)..(711): n is a, c, g, or t
  misc_feature (714)..(736): n is a, c, g, or t
  misc_feature (744)..(765): n is a, c, g, or t
  misc_feature (795)..(819): n is a, c, g, or t
acnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttatggataacagnnnnnnnnnnnnnnnnnnnnnnnntcgataaagattgcgacctcgatgttggatnnnnnnnnnnnnnnggnnnnnnnnnnnnnnnnnnnnnnntgttcgannnnnnnnnnnnnnnnnnnnnnagcttaaaccggtgtgagccaggttggttnnnnnnnnnnnnnnnnnnnnnnnnngtagtacgaaaagatcaaatatataac

SEQ ID NO: 15063 - DNA, 506 bp, Diabrotica virgifera
aacaatgccattggtttgttttcaattcttttttagtttacttatagattcggatccattgcgctgattgtacttccagagattccgagtgggtcatgaataaataaatattagcagagacggcattcgacaaggagatcgtcgcaaatctactactcctgtgccaggcactcacggaccgagctgggatcgtcaaatcggagcatcaaagagttcgaaacggaatgccggtaaacgggtaaaggctcatcctagtgtgcctgggtactcggccaccgcaacgacgagagcgacacagtgcaacaccgttgatatagattggcgcctattactagcagctacataatgtcaatccatctttgaagccactggtcaccccgatctgatagaaagaacgcgatcgctgatgtatcacacgctgagagtcctggactccatgttgccactgcttctggccactttgcagcaggatactcagacgaagcaagatcccacgaacaggcacc

SEQ ID NO: 15064 - DNA, 467 bp, Diabrotica virgifera
gttgtttaccaagtagatgccaaagtgtataccaaatgtggactggcacaggatttggttaagatcggattcgatcggtcaatggttggaaactgggtctgcatggtagaaagtgaaagtggtagagatacatcgaaacagaaagctaaagctaatggagggaaagcattaggattatttcaaataaatagtaaggactggtgtacatttggaaaagctggaggaaaatgtaatgctaaatgcgaagacttccttgatgatgaaattaccaaggatgcaacatgtgctaagaaaatccaagctgagttaggtttccggtattgggatggctggactcaaagctgttacggtagatcatacccgtccaccatagttccattgtgctttccaacagcaggatagatgggattagtaaacaacatcatgtatatatcatataatttgcgtatattaaatatagatctttt

SEQ ID NO: 15065 - DNA, 960 bp, Diabrotica virgifera
  misc_feature (10)..(768): n is a, c, g, or t
  misc_feature (775)..(797): n is a, c, g, or t
  misc_feature (801)..(801): n is a, c, g, or t
  misc_feature (876)..(897): n is a, c, g, or t
  misc_feature (924)..(954): n is a, c, g, or t
gccgctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnntcgnataataagattgggacctcgatgttggatttaagtttataattggtgtagcgctatattaataagtctgttcgannnnnnnnnnnnnnnnnnnnnnagttaaaccgtgggagccaagttgttnnnnnnnnnnnnnnnnnnnnnnnnnnnnnnngaaagg

SEQ ID NO: 15066 - DNA, 688 bp, Diabrotica virgifera
  misc_feature (2)..(568): n is a, c, g, or t
  misc_feature (586)..(623): n is a, c, g, or t
  misc_feature (643)..(656): n is a, c, g, or t
  misc_feature (659)..(681): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcga

SEQ ID NO: 15067 - DNA, 940 bp, Diabrotica virgifera
  misc_feature (374)..(401): n is a, c, g, or t
  misc_feature (533)..(550): n is a, c, g, or t
  misc_feature (569)..(594): n is a, c, g, or t
  misc_feature (850)..(851): n is a, c, g, or t
  misc_feature (901)..(901): n is a, c, g, or t
aaattattttgtagaaatataacaaatatatacagggagtagtattaaataacgagactgacgttgtaaagcattttactttgatcccatattatcctcttcaatatttacccctatcctatcctataacgtttgttgcaaatcttccattattcgaaatagtgagggaggtagttctttaaaagcgtgtgccgttttctctttcatagcttcaaatcttgttctattgtgcagattttaccttgggaaacaacaaataaaaattgcacagcgcaagatccaacgaataaaccatctgtttcaattatggaattctatactgatctagaaacttcgtgacagagaatgcaaaatttgctcaccttttcgcgtgnnnnnnnnnnnnnnnnnnnnnnnnnnnncaattgatacaatttgtaacggctagatacaaattggtaacttgtatttattcatttaatgttccattttagctcgggctttgtggcgggtagttcttttaggacaagatactcagtaaaacacaggttagnnnnnnnnnnnnnnnnnnaggatatttatatacagcnnnnnnnnnnnnnnnnnnnnnnnnnntatcattctattttcgccccgttcccgaacaagctccctaaataaaattgtatttataactatcatcagaaatataataacaacacagtttatataatagcaatcgcgctataaggaatcaatgttctctgtgctcccaacaacaatatacatatagtaggtatttatattacatactagaccgatgccgctggcaatacgtagaacattgccgtcaatattttcattgccaaaaaaagggtttcaatagaactannaacaaatcttcaaaaatcattctaaagagtactgcattctttactattanaaatatataaagtactcatggggatatattatttatcta

SEQ ID NO: 15068 - DNA, 80 bp, Diabrotica virgifera
ataattaccttagggataacagcgtaattttattggagagtcaaatcgataataagattgcgaccctcgatgtggattaa

SEQ ID NO: 15069 - DNA, 987 bp, Diabrotica virgifera
  misc_feature (827)..(827): n is a, c, g, or t
cactcatatactccattttcgatgttctaaccttaagtcctccttcttcaatagcccttctccaacttctcctccaatatttctttgctctcctctactaacacgataacattaagaaccaaaaagtattgaccaagaagtttcctcccttaccttcgctgtcaatacatcaataacgagattaaacaggtatggactcagtaaagagccttgatgcaaatcaaccgtcactggaaaactttcggccaactgaagccatacatctccataaatcttgcctaggaactgtgtcgtgtgtcttctcttcctcttcttcttttttttatatagattttcttcaacggtttctttcattctgtccctaaattgtcattccatcttttccttgggcatcctatacttcttctgcctaacagtgacttgtccctggctattctcactatccttgattcagacatcctgcttatgtgttgattccactattctgttctttacccaggtatttatattgtctgccccacatatgcatctgatttcctcacttcttaccctgtcctgtagtccttttccagcaaatcttcttaagatcttcatttcgttgtttgtgttttgtttgtatttggtcttgtttcggccatgtaagtcataactggctaataactgccttatatattcgggcctttgtttccactcaagcctttcaggcttcgggtctttgtatgtattctcaagatctataaataccaaatgtagcttttttcttcccgccatatttctctattaactgtttcaaagcagacaaggcatccgttgtcgtcctttctggnctaggcccaaactgttcttctcctatagatgtttctcaccttaatgattggatatataaaatgtaattacatacttatatttatgtcacttaggctggtttatgtgtactggttggtaaaaatcaggccagtggaatacattaaaaacttatttcaattc

SEQ ID NO: 15070 - DNA, 945 bp, Diabrotica virgifera
  misc_feature (349)..(367): n is a, c, g, or t
  misc_feature (794)..(822): n is a, c, g, or t
  misc_feature (874)..(918): n is a, c, g, or t
gtcactgtctgtttgaattggtgtagctggagaagtagcggatgtaggtgtagtggacggaatagaaaggctcagatatattgtatgattgaatgtttgtttgagtagctgatgaagcagtctgcatctgtgtagcgaatgaagtgaatgttacaggttttatgtctgaacactctgctctgtagagaatagtatttatgtcaaatttagagttgatttgcaccgatttgctgttaaggttccgcgtactgcttttcttttgttggcttgagttataggcgtacgtgcattagttttaactacagtttctgtatctattttcacttctatttcagtctattcatcgtgnnnnnnnnnnnnnnnnnnnatcaataaatgtatctcatcccatagcaatcccataatactcgttacttacgaaatagctcaattaaatgagtagtcagttcttgcgacaatttcatcgcgtaaataaccctacgtgaacagagcaaagaaaaatctagcacaatcactccagaatgaacaaggcgatatgactccaacggttgctgctcgcgtaggtactatgccagagaaatgtttcaataacatgtttttaggtgtagatcagtcgcggtgcggttttataactttctttgatgtttaccgacatctgttggataacataaaacatgctatataaccagaaaaatgttatacaacactgtgttttaaaacttgtttatttaaaatttgtaacaagttacaaaactttgttatttgacatgttttgttgcatagtctggacccgnnnnnnnnnnnnnnnnnnnnnnnnnnnnnactacaatttctgaatattttttctgaaatttatcgaatggtaccaacacannnnnnnnnnnnnnnnnnnnnnnnnnnnnnnnnnnnnnnnnnnnncttaaatagggaactcctttttttttt

SEQ ID NO: 15071 - DNA, 108 bp, Diabrotica virgifera
  misc_feature (7)..(44): n is a, c, g, or t
  misc_feature (63)..(76): n is a, c, g, or t
  misc_feature (79)..(101): n is a, c, g, or t
taacagnnnnnnnnnnnnnnnnnnnnnnnnnnnnnnnnnnnnnntgcgacctcgatggtggannnnnnnnnnnnnnggnnnnnnnnnnnnnnnnnnnnnnntggtcga

SEQ ID NO: 15072 - DNA, 115 bp, Diabrotica virgifera
  misc_feature (7)..(84): n is a, c, g, or t
aggtgannnnnnnnnnnnnnnnnnnnnnnnnnnnnnnnnnnnnnnnnnnnnnnnnnnnnnnnnnnnnnnnnnnnnnnnnnnnnnataattaccttagggataacagcgtaatttt

SEQ ID NO: 15073 - DNA, 990 bp, Diabrotica virgifera
  misc_feature (117)..(147): n is a, c, g, or t
  misc_feature (332)..(351): n is a, c, g, or t
  misc_feature (801)..(801): n is a, c, g, or t
  misc_feature (923)..(923): n is a, c, g, or t
gcagatcttgcagagtttgatgaaaaccttcctctggatgatcaagagaaagaacctgagatcagcaaggcggaacaggaaattaataatattatagaaaagttaactcccatagannnnnnnnnnnnnnnnnnnnnnnnnnnnnnngaatctgcgtggtctgcagaacagcttgcagctgctgcaagagagatcgaagaacagaaaaaggaatgggagcagaaccgtctggcggcgatgcgagaagaggaggaacgtcgtgctcgagagttagaagaagaatctgatatcatcacgtattcaagagatgacgccaccaaccaggttagctnnnnnnnnnnnnnnnnnnnnaggtataataaaattttaagtaataaaagggttaggctcaaaaaagatggagatgaagacgttgagaaaaaagatgacgtcgagaaaaaagatggagttgaaaaaaggttgaagaagactaggacacgaaggctgtctcaaaaaagcaaagatgtagaggtcgaagaaccggatgcttgtgaatcacaagaagaatctcaaattaacggaggggatacggataatagtgatagtgattctgattctgatagcgaatcttcatcttccatggaatctaaaactaccttaaaccacgttgatccaaattcacctagaactaggtctaggggcacagtggctattaacctttggacactcgatgtcagcccgattttgcctggagaaaaaccgatgaaaaaatacggggagaaccatagaaaaaatattaagagggttagatctgtgtctganaacgataacgatggagataaagacggtagaaagcgattgaggaggaaataccccaccagttttagaacatcagaagaagaaaacagtaaccagtcaagagaaaatctactaagaaacgtgcncaggtagcaccaaagggaaaacttgtaaggtaattttaagtaatatactgaacgataaacgatttaa

SEQ ID NO: 15074 - DNA, 97 bp, Diabrotica virgifera
gcttggagccagcgatatctaacaccctgtacatgatgttgtacatacacagagttaaagtattgataaagcctcctattgaactctcctaattgat

SEQ ID NO: 15075 - DNA, 823 bp, Diabrotica virgifera
  misc_feature (139)..(155): n is a, c, g, or t
  misc_feature (158)..(170): n is a, c, g, or t
  misc_feature (173)..(299): n is a, c, g, or t
tgtcagtgtaccttgatggaatacaagtggcacctgcattttatctcactccttccaaagtagatttttgtaatgttgttaaaaatttagaaactacatgttagatagtttacagtttgaatcaaaatttgttgtatgnnnnnnnnnnnnnnnnnccnnnnnnnnnnnnngannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggctactaaaattaattagattgcagtgcagtataatgtgatcgtatatttttttttcctagagaaatttcatctattactgggccgcactttttcattgtgcggatatgggaaaacactggggaccgacctgattaagaactttgtgagcatgccccatttccttggaggtgtataccattaaaatgccccgaatgcagctttttcccaaatacgcgcactcacatgagtctacatattactttaccacatgggagattaaaaactccttttatggttgcatctggtccaacagtggccgaagagtttcagtactctgattccttacatatgaaattttttcgttattttttacggaaaaatccaaattgttttcatcacttaatcctaacaacgagggtccctctaacggctattgtataagttctagcaccacaagcgcctcgaactgatatgattgatgaatctgaccaagacgggacagtccccggaatgaattttttggatgactttaacgat

SEQ ID NO: 15076 - DNA, 101 bp, Diabrotica virgifera
  misc_feature (2)..(26): n is a, c, g, or t
cnnnnnnnnnnnnnnnnnnnnnnnnntcaattaccttagggataacagcgtaattttattgtagagttcaaatcgataataaagatcgcgacctcgatgtt

SEQ ID NO: 15077 - DNA, 915 bp, Diabrotica virgifera
  misc_feature (3)..(35): n is a, c, g, or t
  misc_feature (198)..(218): n is a, c, g, or t
  misc_feature (432)..(446): n is a, c, g, or t
  misc_feature (448)..(465): n is a, c, g, or t
  misc_feature (893)..(893): n is a, c, g, or t
gcnnnnnnnnnnnnnnnnnnnnnnnnnnnnnnnnncatgaagctagttgtaatattgtataatttaaaaaaaatcgagttaaaaaaccgttattgataaataaacctaaataagatcattatacattttaaccttagtgtatttatatagcgtgtttgttcactagtagaaatcaaattacagttgttgcgatttatnnnnnnnnnnnnnnnnnnnnngagcttaattctttttcgaacgtttcattagattttactatatattccattttcaaacaataatgaaacaaattgaaaaaaatcctagtcatattagcgtttttggagttatctgagtcaagtatattacgaatgaacaatttaagattttttacgtttggagataatgttacatagattaacaaaggagtcaatcatcgtattgcacatatgnnnnnnnnnnnnnnncnnnnnnnnnnnnnnnnnngtacccccactgtcagatctaattttaaagctgccctctgtgggtgttaattagtgattgatttttatatttttcactcttacctactacgatatatcaagatgttactttcagacaaaatatatattaatttcccataatcacaaaccattaaacactggttaaattctaataagtttcgttagtactgagacataagattccacaaggctttgtatattttctaaaaacaatacggaacataaaatatgagagaaaaagaataaactattacaccacaattgttcaaattgtaggtagtcttaaatttttttggtatttcttgagtttttagacataactgcttcgaagctctagctactaaacgggagacaaaatttacaggattctgggataatggaaggcaaatgagacgttcacttacttgntcactgctaatgcagcaaacat

SEQ ID NO: 15078 - DNA, 275 bp, Diabrotica virgifera
gcgtcgcgttcgctatcgcaggcaggcgtcgttacggataagaggcagcgtcacgacgcgattatgggacgataattttctagtggagtttcgtgattttctctcgttcacaggttgtgcccttaattaatcacaggaattaaataatcctgcagtttagcattatcgatacaactaaatacaattgcttgggtcttactcggaaaagaatgtgaagcggctgatgcataactgtttgtgatattcgaacgttgatttactggactagttagatc

SEQ ID NO: 15079 - DNA, 282 bp, Diabrotica virgifera
  misc_feature (93)..(129): n is a, c, g, or t
  misc_feature (149)..(162): n is a, c, g, or t
  misc_feature (165)..(187): n is a, c, g, or t
  misc_feature (195)..(217): n is a, c, g, or t
  misc_feature (247)..(277): n is a, c, g, or t
cggacgcgtgggttcttataatcaaccaaattacgctgttatccctaaggtaatttattcttataataataaattacgctgttatccctaagnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnaaagg

SEQ ID NO: 15080 - DNA, 115 bp, Diabrotica virgifera
ggctcaaaaagcgatggagcatgctatgttgggccacatggatcttttgcactgatctttttcacacactgtataaacaaaatccaaaaacaacagagaatacaaaatttatttg

SEQ ID NO: 15081 - DNA, 948 bp, Diabrotica virgifera
  misc_feature (812)..(812): n is a, c, g, or t
  misc_feature (868)..(868): n is a, c, g, or t
ggccgccctttttcctacataattaacaaatgctgaaattgtttcaacaggtcgttttggatcaaactgggtgctcttcggaaaaccttctttttgtaggtaactgttgaagaaaacttgagcggtcacgaagtacgatttatagacttttggatcagaagcatactgcaaaaactctgctattctatcggttaaaattcgaatccactgccttctgtaagagtgattctccatcaactccccaaacttcttatagctgaaccgtcctttgtcatccaaaaacactttaaacgacttctctgcaccaagagccgctatagtgttctttcccatttccgaatggataaagtgatcaaacataagatgtaatttttccaagaatggaggcattaaggatgagtgcccagcgtgacttttttctctgcttctcgcttcaggtcctacgaaggcgttcatggtctgaagaattgttggaagtagagataagaaattgcttccgcctttctttccatcttgaccagattggcctaggaaactaccagctagtgataatatgtcatttaggttaaagtcagattctgctttagggtctccttttcgtacttttttagaacctactgatttcttcttaggtttctcttcgtcctcagaagcaaaaaagttaagcatcgatccaagatccagcttttgtccacctgcacctccttggtttaagagtgaccccaaaccgtttagtatagctgcagcaccatctccaccttgagctcgaccttcaccttggtcgttggcttggccaagcagagatcctaggncttgcagaagagctgcagcgccttctccaccttgaccttgaccttggccttgctcngtggcttggccaagtagtgaccctaggccttgtaaaagagctgcagcaccctctccacctttgacacgagcttgaccttg

SEQ ID NO: 15082 - DNA, 929 bp, Diabrotica virgifera
  misc_feature (447)..(466): n is a, c, g, or t
ctgggacgcccatgcaagtgtcttgcagagttgcaatcgccctcaaatcgcctggcctgtttgttttctttatatttgaatgtttagatttactttgaagtcgcgtcagtgatgttttttgtaataacaatttttgccctttttttttagctttgggggggatttttggggaaaatagccgctgccctccggccagaccggcatttttgtattgggctgtcatggaggggtcacctgaggaattttcaggttgcctggaatacctgctcaaaagtgtctcacagctcttatactaatatggtaataccgttgattgaaatattacactggcattaaatggaaatattacactgacatattattaccagtgtaatgtgtcaatcaacggtaatacataatatattataattttgtttctgtttatatactttaccaagaaccaatcgnnnnnnnnnnnnnnnnnnnnccattttgtgataatacatcattgccatactaacacaatatcactgccaaaattaaaaagtgtgttcttcttctcataacataatttccaactcttactgccaaataaaacctgtaaaatggttttcaacgctgcatttaatgtttatttagaattacctacttattgtgtatatcccaatcttcatatttttaatacttaaagaacaaaccaaaattcgagaaatacgagggttattcgtgaaaaaaggttccctgcgcccctgagacagaatgtgatgtactgggagaaatatggaaacactgtcttacgcatcaactctcactctctcacgccccaccacttaagccgccctgcattgctcagtgtcggcctagcagccttcgaggatggagcttccgattgctgtaactttaagacggtgttgccagatttgtcggagtaggtcgcatttttttctcat

SEQ ID NO: 15083 - DNA, 466 bp, Diabrotica virgifera
gaatgcccgcgttctacccacgcgaccggacttatcaggtctatggtgattttatcgttgtattagttgccatcatttaccatttaccagcggaagagtatccccggagaggactatttcttaaattatattaatttacctcaatttatatatataagcatgccgcatgaaccaattcacgaagtcttaactgaagccggcggccagatcgcatactccctactgtacatgatggccaagggagatgtctgtcagccccaaccaaacctaaggcctcctgcctttgggatatcccacccatgatgggcgggctacagggactcctactcggaacattactcgattagctgccctatccgacttattatgtaccaagtgcattcccaacatgcatgatctcagctcgtagcgatttgaatggacgttctcatgctagccgttcacttggtaaggaagcacatgcacc

SEQ ID NO: 15084 - DNA, 577 bp, Diabrotica virgifera
  misc_feature (3)..(3): n is a, c, g, or t
ctnttaagggggcccgcgttattctaggatgagaggacactcccttaaagagccctataatgacctggcatgtgatgcgagctagatatactactgcataggacaactttcaactctcaaaaaagcggacatcatgtaattaccagtgtgggcggtcaagatgatgagataagtggagcaaacgccaagataaaacctgccctgagatcagtccggatctataggactgtcacgcagactatgaacaccacaccgaatcgcatattgtctggaatactggcaccgaacagtgtcacgtatcgtatactatgacggtaacacagatcagtagactatacaaatcgagatacctagacaaataccacagaaatattaatagcaacgtatggggtaggacagatcgatatataatatattataatgccgcggcagcataccttggttgcgagatgcaatttaatgcacttcgcccactacccgatcctggatcatcacattcctgcctgcccagaacactgtcacctgtcacaacgaacgtgtgagccagtttccgcgtcaattagaatccccccggtac

SEQ ID NO: 15085 - DNA, 950 bp, Diabrotica virgifera
  misc_feature (793)..(807): n is a, c, g, or t
  misc_feature (881)..(881): n is a, c, g, or t
  misc_feature (902)..(902): n is a, c, g, or t
tttagaatttagaaacatgttaagaaactttatttaaaaaagtaaacacatgtctaaaaatataatcaaataatttgaatatgagttttaacgggtatcaaaatataatcaaagagggtgatacagttatattgtatctcacaataagccaggtatatccaataaaagcgcaatctaagactataaacaagaaaggtgtagaagtagaaaatgtgttccaaacctcttatggggccctaaaatgtgcagatctcatcggtaaaaattacggaactaaaatatcccttagtaaaggttggggatatgctctgcaacctactcctgaactatggacaataactttaccacacaggacacaaattatttatacacccgacataagtatgattattttacaattagagctatcccccggtagtgtagttattgagagcggtacaggaagtggatccctttcgcatgctttgataagggcagtgaaacctcatggacatctatacactttcgattttcatgaagatagagcgaaaacagcctcagacgaattttcagagcatgggttttcggagtatgttacagttaaacatcgagacgtttgtgaaaatggttttggggaagatttggatggtaaagctgatgccgtgtttttagatttacctcatccgtggtttgccataacacatgcacttaaaagtatcaaaacgactggaggaagaatttgctctttctcaccatgtatagagcaagttcaaaagagctgtcttatattattgaagctaggctttcaagaaannnnnnnnnnnnnnntgctacaaacacagttgtctgtacaacaaagaactattccaatagttagtttggattttttgaaaactgaaggngatgaaaatgaacgggagaanaagcagaaggaatattcaaaaactgtagtatctgtacctcctgcaacg

SEQ ID NO: 15086 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15087 - DNA, 159 bp, Diabrotica virgifera
  misc_feature (2)..(41): n is a, c, g, or t
  misc_feature (46)..(82): n is a, c, g, or t
  misc_feature (84)..(100): n is a, c, g, or t
  misc_feature (102)..(119): n is a, c, g, or t
cnnnnnnnnnnnnnnnnnnnnnnnnnnnnnnnnnnnnnnnngacgnnnnnnnnnnnnnnnnnnnnnnnnnnnnnnnnnnnnngnnnnnnnnnnnnnnnnnannnnnnnnnnnnnnnnnngtatggtagcataatcattagatgtttgattgaaagctgt

SEQ ID NO: 15088 - DNA, 63 bp, Diabrotica virgifera
  misc_feature (9)..(48): n is a, c, g, or t
  misc_feature (50)..(50): n is a, c, g, or t
ggtgattannnnnnnnnnnnnnnnnnnnnnnnnnnnnnnnnnnnnnnnantaattttttgatc

SEQ ID NO: 15089 - DNA, 862 bp, Diabrotica virgifera
  misc_feature (464)..(517): n is a, c, g, or t
  misc_feature (679)..(700): n is a, c, g, or t
tctaactatctctaacctcgaaaagctggaaaaatctagatgtttccacatttccaccttttatatcaatttcaaaaaactattacccaagtttgttccacatcctagtcctagtgttacatcaaagctaaatttaaagtagaagatgccagttgttaataccagtatggctttattaccagtagctgaagcttcaaatgcagaacctacagaaaatcaaccaagacaacccatgagtttacaaggattacttagattttctatggaagctacaagggcagaagatgcgccttctaatagtgaattcgcgcctatggacgaagagagaaagaaattccttgaagaagctctgaactcaatgtcagtagatgttgtccaaatcatgcaaaggcagatagctttcttaaaaggagttgaatctgtagatccttcagaatgcaatacgaattatttagaagctatcnnnnnnnnnnnnnnnnnnnnnnnnnnnnnnnnnnnnnnnnnnnnnnnnnnnnnnattggtggattcacaaccatttatccctgcatgaagtccaatgatagcaaaattcgagcagcagggtgtgaactattggcagttctttgtcaaaacaatccatattgtcaaacagtagttcttgataatgaatttatacctaaacttttacatatgatagannnnnnnnnnnnnnnnnnnnnngtcacaaaggctatttatgctttgggtggtattgtaagagacaatcctgaaggtctgacacagttaatccattataatggactcacagtgttactgaactgcctgaaaagtaatcatgagaaatgtattatcaaatcagcatttcttcttggtaccttatgc

SEQ ID NO: 15090 - DNA, 788 bp, Diabrotica virgifera
atacttttaagacatgaaaccattcacttttgctttgagataggtatctattatatcccgtttttttgtgagtgcataaccataataccataaggggacaaattatggaagccaagttccaccaaatcagcacatcggaaaacaacgagggaaccgataaagctgaggttaggaggatatggaagaatgtgatgctgatcaatttagcgtttatggtccactttacggcgttttggggggcttcgaatttacagagctctgtaaacgccgaaggtgctttaggtacctttactctagcgagcatttatggctctttattgatctcaaatattttgttaccagccttagtcattaaatggttgggagccaaaaggacaatagccgtaagcttcataatgtacatgccattcatcctggcccaattccatccggctttttacacattaataccagctggtctcgctgtaggtttcggaggaggacctctatggtgtgctaaatgtacctatctgacgataatagcggaaacctatgcccaaatcaccgacgtagaagccgaaggtgtaatcaccagattctttgggatattttttatgtttttctcgtttgcgcaagtttggggaaatttgatcagttctgcagtactttcatctggagacagcgaaactccattaccactctcaacaactaccgaagctttgatcccaaaaagcttgtttacgaacgcaacaaaaagctgtgcagaaaactgataccgatctatgggatatatgcgtggaaaatttttg

SEQ ID NO: 15091 - DNA, 892 bp, Diabrotica virgifera
  misc_feature (720)..(720): n is a, c, g, or t
cggacgcgtgggtggcagtcaaaggggctgttgtgcaatagatcgattaaatgtagtgattatacgaattttataataaaacgcaaaattttcggtggaagtacaattctatctaaaaatggctttccgactgcgtcgacaagttattcaaaaatattcgtcccatgcttagaggttatatcttctattgtcaaggtataaaaatgataacagcggagcttaaatccttctagtagcgaacaaacaaaacacattcgaggtttgagataagatgacggcctgcccttttcgccgcccgtcggggtcaacggcggtccaaaacggtggaggcggcgcagctctaaaacgaacttttactacgaaacaaaattcgattcaaattaccgacgatcaattcgaagaagaccgcaatactcttaacttaaagcatttaaacgaagcaatacttattcttacgtcaccaacgaatgaagctgtccaacagggtttgacttcattgttaataaaggagggacctaccaatcgttataaatatagttgtctagaccctctaccagaaagtgtcaccagttgttcacattatgcgtacttggaagacctctatgatatggtcaaatgcgaaaacgatatagatataaatacattcttcgataacttgggtcaggaactaatagccgcgtctctcaacagccgaactgaacgtgctttcatctgccttgngggtgatctcaatgagtttttgaccactctggatggcgtctatgatgtcctcaaataccaagaaaatgatcgcgagagcgagcacgaaactgaagcgttcgtttgtacagccattaacgaaaaaaacttgcaactggatttctcaacagaaaaacctgccattgcttatttg

SEQ ID NO: 15092 - DNA, 75 bp, Diabrotica virgifera
  misc_feature (8)..(60): n is a, c, g, or t
ttgggggnnnnnnnnnnnnnnnnnnnnnnnnnnnnnnnnnnnnnnnnnnnnnnnnnnnnnggaatccaatttttt

SEQ ID NO: 15093 - DNA, 952 bp, Diabrotica virgifera
  misc_feature (461)..(491): n is a, c, g, or t
  misc_feature (748)..(748): n is a, c, g, or t
  misc_feature (827)..(827): n is a, c, g, or t
  misc_feature (855)..(855): n is a, c, g, or t
  misc_feature (860)..(860): n is a, c, g, or t
cgaaggcgttgtgtgaaaaatttgtagaatcaatatttgaatttgctcgtttaaacatcagtgtgaattacatttaaaaatggcaatcagtcggttatctattatcaaatttttggaattggccattgccatcgcatgtattggtcttcactacaaaagcaaaaccaatgacttagacaccgacacattatcctcagcagcttttggaggatatgttattattttgataggaggatttgcaggttacctcatgagtactccattcaacaaaaggatcgatatcttcttctccctggtcggctgtgccctcttcgttgccgccggtgcattgaacattaaaatttacgacaaatacggcaaatcagaatggagagacttcggcctggccaaagcttcattggctattgtcaacggagccctattcctgttggactccctcttaacgtggagaggcgatttcnnnnnnnnnnnnnnnnnnnnnnnnnnnnnnncgaacataccaacagataagttagcgatttgttaaagctacctcgattattgattaaatgtgaagcaggatcgcttgagttagagtggtgcctggctagaaatcgaaaagtgcaattgttattaatttacaaagtaaatgaagtacaaaatattattttaacccttttaatataaagtccgagcattaaagttttcttttaattaaattcatcaaatcaatgtttttaagacatttataccatattttttgacaggngagttatcaatgatgcattttttatttggatatttaatgttaaccttttatcaatatgttatttcgttgtacaatattntttcgttgtaaaagttttttaattttanaattngattattcgggactttgctagattgtttctagaaagtagtactatttaatatgtgtaaagctttcattgtcgttttctcgtaattgcgaatg

SEQ ID NO: 15094 - DNA, 52 bp, Diabrotica virgifera
  misc_feature (6)..(38): n is a, c, g, or t
  misc_feature (42)..(42): n is a, c, g, or t
actttnnnnnnnnnnnnnnnnnnnnnnnnnnnnnnnnngatncatttttttt

SEQ ID NO: 15095 - DNA, 829 bp, Diabrotica virgifera
  misc_feature (90)..(105): n is a, c, g, or t
gccgatgccaataatatttttctgatttttgaatagtttatcattatttgttcaaagctgtgagttttaagtaatttaatagtataatgnnnnnnnnnnnnnnnnaactaaacagtgatccagaacctctcattcctggcaagatggaagggagttttgtcaaagcgggcccaccagatgggttggttgggatgaagaatctcttgagctccaccgaaattccagaaaggcctgaaaaccgaaaacctaccgatcaaaaatttcttattgtatttgcagtcgcagtgattattctgcttccgttccttatatatacgttagtgtactctgattttgaccacaataagggctatgaccaatgtggtaacgtctgtggacagaaaaatatgaagtatgataattgggcttgtagtggagaagataacacaaacaaaccgtatttactgtactacaccagtgttcataatttagaaggagaaagaaaatgtgttgaaagatgcgaagatggagattatccaggtaacggtgcgtactgtactaagattacctcaagtgatgattttggggatggcctatctgattacttaaacaaacatgctgggacaattgtattcgcatgttttctatcactaggtgttggattgataatgttgttcctgtttaaatccgctacagatgtagttgttttgggtcggtctagtatgagctctattttctggaacatttttgtactgcggacatggtactgttatttcattttcaccatgtaatgaaagaaagatgggaaacgtgaagtacctgaaaaaggtgtttctatttgccgctctag

SEQ ID NO: 15096 - DNA, 267 bp, Diabrotica virgifera
ctagaactagtccgcgagaaaaggaagctgcctatcaagaacggttaagagcttgggaaactagggaacgacgcaaagccaaagattatgagaaagaaagagagaaggaaagaacaaaggaagaggaaagagaacgcgacgctaaaaggttaaaagaattcttggaagattatgatgacgaaagagacgaccttaaatattacaagggcagagagctgcaaaagaggttagctgagcgtgtaaaagaagcagatggagatggacgcg

SEQ ID NO: 15097 - DNA, 915 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (804)..(843): n is a, c, g, or t
  misc_feature (852)..(910): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattcnnnnnnnnnnnnnnnnnnnnnnnnnnnnnnnnnnnnnnnnctcatcccnnnnnnnnnnnnnnnnnnnnnnnnnnnnnnnnnnnnnnnnnnnnnnnnnnnnnnnnnnnaataa

SEQ ID NO: 15098 - DNA, 238 bp, Diabrotica virgifera
  misc_feature (2)..(184): n is a, c, g, or t
  misc_feature (192)..(192): n is a, c, g, or t
  misc_feature (194)..(237): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttntnnnnnnnnnnnnnnnnnnnnnnnnnnnnnnnnnnnnnnnnnnnng

SEQ ID NO: 15099 - DNA, 251 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(250): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattannnnnnnnnna

SEQ ID NO: 15100 - DNA, 933 bp, Diabrotica virgifera
  misc_feature (110)..(127): n is a, c, g, or t
  misc_feature (202)..(254): n is a, c, g, or t
  misc_feature (257)..(271): n is a, c, g, or t
  misc_feature (381)..(395): n is a, c, g, or t
aattaataactgaagacaagttgaagggtctatgtgacaaatttttcaaaacatgttttttatgttaaaagtaagttatttgaacctaaaaatctttcaatcaaacacgnnnnnnnnnnnnnnnnnnctaagttactagagtataaaggatatgtacacagtaaattttaaaatgtaagttaataaaggatctatgtacacnnnnnnnnnnnnnnnnnnnnnnnnnnnnnnnnnnnnnnnnnnnnnnnnnnnnntgnnnnnnnnnnnnnnngttttaggactacctattctataaatttagtctatttagatcttatagtaaaaagttctagtataaaaactttaacttcatttttctcaataacctgcaaatgtcacatnnnnnnnnnnnnnnnttgtgtcttcaattatgaaaaaagaacaatatgaaatttttagctgtaaaggtaataagaacaaatgttaacacatttcttgttatcgttataaacattaaataaaacttttctatgtttattggttgatacgcatataaaggataagcaatccatgacaaatttatactcatgttggagcgtattggattgtctttcaaaaagtatattccttttttggtacaagtatctaattagtttcagaaatagtcaaagtcaaaagttagaagtgggccgatttctatgcacgcaagtttattttctcataaaccagtaatgtttacttcctcttatgggtttcccatgtaaaaccattccactgatcgaaccctatggctgtagcgagactgacgagccaaaatagatgttagaaatcggcccattttaaacttttcactcgaactacaattttaaaaaagaactatcggattaaaaaagggatacactgtttgaaggatagtttgatatgctttaatatgagtacatttttgaaatttta

SEQ ID NO: 15101 - DNA, 847 bp, Diabrotica virgifera
  misc_feature (589)..(614): n is a, c, g, or t
agctcttaacgaggtgtggagacacctacaagacgaacgttctcctaaaagtatcttcaaaatgtgatacctataccccacctagctacctattatcgagacactaggaaataatactgtatatagacatctggaaaacctactttcacctaatggattctttcaaatgagcaactataccccccctgggatcactatgaccgacatcagcaagagatccgataaagggtaggagacgcaaccaaaacaaacattcccctagaagcaactctaacacgtgaaactatacccgctcgtgacaccactattaacgttgccactaagaaacattcagggatgtaaacacatacaccacgagccttcacctcttagtaactttatcacgagatagtattcccgaatagacaccactattataggaaccagcacgaaatacgagaataggcaggccatccactgcactcggagtatcatatgtaacactctgatcacgtgctcatctacgagatgttactcatcatatcttgatgatacccgaagtggaggacatagttcactggttaggtactgctttacccattttctccannnnnnnnnnnnnnnnnnnnnnnnnntgcttcagagggcatgtgattactgctacaccgactacgtaacagactatacactacaaactgaatcataatattgactactacctcacaactagatatcgtacttctatagaatatattgatcatcctctatgaatttgtgccccaatgagatatggcatgatacgatgtaacttcatgatgtgcgctgctatgttgatatatgacatgctatagggtatgacagtatatac

SEQ ID NO: 15102 - DNA, 801 bp, Diabrotica virgifera
  misc_feature (2)..(797): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaa

SEQ ID NO: 15103 - DNA, 955 bp, Diabrotica virgifera
  misc_feature (58)..(133): n is a, c, g, or t
  misc_feature (482)..(507): n is a, c, g, or t
  misc_feature (517)..(542): n is a, c, g, or t
  misc_feature (926)..(926): n is a, c, g, or t
ctttgatgccctctcagtggcccctgttctacgtttcgcttgaccgaccgcagtgtgnnnnnnnnnnnnnnnnnnnnnnnnnnnnnnnnnnnnnnnnnnnnnnnnnnnnnnnnnnnnnnnnnnnnnnnnnnnntctccgtctatttattacgtttggtttttccaaatcgtttgcactggttctcttattttgaactttcaataatcagttttttaccttttgtaaacatcagtttttgcttcacaggattcacagtattgattaacctgtgtacacatctttattacaaggtaactaacactgaacctgttaaaaaaaggaactacgtctgttaatgaaaacaagggctacactgtaaattaataagtcaattaaattaaatcatatgatttcaaatggatttcggtaaattatttattcggccgtctgctgtgcaaagggtcgataatttggtataaattttaaagaaatcatacatatnnnnnnnnnnnnnnnnnnnnnnnnnnatataaacannnnnnnnnnnnnnnnnnnnnnnnnnctcaaatcatttcactgagtgtctactgttgtaaatattataatgtgtgcctattttcattggaacatcctgtaaatgttatacacgatgtagagtatacttttgataaaaattcgggttatatatttaggaaatattcgctgccgtagatttttatactctttttgagaatttatctggtcatttagcccactcggcaagattaaatatatgtatactgcaacctaatatttttcgaagtcatttttaaaaactgtatcatatatttgtacttagtagagcaagtcactattcctcgttaaatgtgaacttaattatatgataatgcagtacgagtttctatactacgtcacattttttacaaaccatttaatagaccaaatnaacaaacttcttgtttaaaaaaagtactg

SEQ ID NO: 15104 - DNA, 75 bp, Diabrotica virgifera
  misc_feature (4)..(46): n is a, c, g, or t
  misc_feature (48)..(49): n is a, c, g, or t
  misc_feature (53)..(74): n is a, c, g, or t
ggtnnnnnnnnnnnnnnnnnnnnnnnnnnnnnnnnnnnnnnnnnnnanntaannnnnnnnnnnnnnnnnnnnnnt

SEQ ID NO: 15105 - DNA, 94 bp, Diabrotica virgifera
  misc_feature (3)..(93): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 15106 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (161)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttggttnnnnnnnnnnnnnnnnnnnnnnnnnnnnnnnngaaaggga

SEQ ID NO: 15107 - DNA, 894 bp, Diabrotica virgifera
  misc_feature (882)..(882): n is a, c, g, or t
gctagaattgggcccagcagtaagaagatttttaggtctacaagttaaatcaaagcaacctccacataaatgcaagaagtttataaagataaaaaagtatttgaaggcctactttacagatatattgaagcttctacaaggtgttacatcttcaaatatacaaacagtgcttttaaagcatctgcattatatgtcctctcttttaacttcattcccacacataaccaaatccatagtgaagaggctagtaactttctggggaaccgcagaagactccgtccgagtagtagcattcttctgcatcttaagaataaccaacaaccagcaatcaaccattttggacacagttttgaaatcgatgtacatgacttacgtcaagaactcaaaattcgtcagcttcaagggcttgcctgtgattaacttcatgaggaggtctttagttgaaatgttcgctttggatgtgaattttgcctatcaacatgtgtttttgtacattcgacagttagctatacatctacgaaatgccataactgtgaataagaaagagaatatacaagctgtgtataattggcaattcgtaaattcgttgaagctgtggggaaatcttctagcagtgacttacaataagaagataatgcaacagttggtgtatcctttggtgcagatttgtataggtaccatcaaattaattccaactgcacagtactaccctttaaggtttcatatagttcagattttaatggatttgtcgaaagaaacaggggtttttattcctgtattgccgttttttgttggaggtgctgacatctttttgatttcaataagaaacacaaaaaagtgtcaatgaaaccactacatttcacttgcctgctgagactgtcnaaatcgcaacta

SEQ ID NO: 15108 - DNA, 946 bp, Diabrotica virgifera
gtttcctattctatttttttaactaaaacagtataattaagtgataagtgtgattttagtgataagttttcctagaactatttttcaacatgttggatgacataagtgaaacaaaggcaacaatgcaagccgatgaactagaagcggtaatttgtaagaaggttgaattccccagcgaaatgacttttaaaagtgaggatcttaaccattccataataaaagaagagccacaagtagaggaattaagttctgagattgacagcatcagatacaaaggaataaacttggaagacgatatagaaaaagttgaagttactagccatgactcgtcagaagaaactgaggattttgaaaatactccatctcctaaagaagacgatcagaatgtatttagtcaaatcccaacgcagagtcctaatgaatcaattaaaagttggttgcaaaggataactgaagtacaaagtgagatgcagaagaagtactttagtgaattaggaaacagtggaccaatagcatccaattctgccttaaatagttcctcgagtcttacgaactcttctacgtcgacaagccagaattccagccgagttgtaaaataccaagaccttccgtacatgggcgaaatgaccttagacaactcaaagccgcgtagaggtagaaaaccgaaaaaagccgatatctgccatcttatttacaaaaattacggcaccattttccccggaactcccaatcctggaaattatttagaaaaagatcccaatctttttaaaaagtctgctttggtggatagtaatagagaggatagtttgaacagaagcgatgttcacaacagaatcatatctagtttactcgaaaaaagactgacccaagatttagtacgactaatgatatcaaaaagagttcaaaagaggataaatctaatcatgatgagcctcttaacctttgc

SEQ ID NO: 15109 - DNA, 894 bp, Diabrotica virgifera
  misc_feature (438)..(466): n is a, c, g, or t
  misc_feature (592)..(614): n is a, c, g, or t
cccagattcgagtttgatgatgaggatgacagaccagtgtgggataaaggtaccaacgacataaacgacaaagaatataacaggcctgcacgacctccctcaaatggcgccaccattccactttcagcccaagacgaagataccctaaatgaaatctttaccacaaaaacaacgcaatctccacccaacaggcaaacccgtccaactaggccaactaggccaactcgtccaacaagaccaactcaacgtacgagacctacaactcccagaactccaactccaactccaaccaccagacgtaccccaaagactgatggtcctagtgactgtgtttgggcagttgtttcatgctgctctgcgaatagtgatatgtatcccgaaggatgcttcgaagcaagaggttgtccgggtccattttggggtaatagtccttgtggnnnnnnnnnnnnnnnnnnnnnnnnnnnnncggctttaaaatattacaggccatcagcaagaaaatgatgacaagaatatgtttttgattgattaagtgctctcatggtgatgtattataggcgagcgactaaagatacagcgaggtggaattgannnnnnnnnnnnnnnnnnnnnnntaatttttgcataaaatttgattttttaacatgttccaccaattctgtaaaaaaataaacttcatattcggattcagcgacgtctaaaacataaagattgactaaaattggttattcaccttaaagtttactttcgtggtcggtataacgtaattttagggggtgctgccgctcccttaggaagtcactgccatactgtacatcactgagaataaagtgaaagcacataaatattttgaagtttaacctcggggaacactattttgcaatgtattctgat

SEQ ID NO: 15110 - DNA, 838 bp, Diabrotica virgifera
  misc_feature (2)..(50): n is a, c, g, or t
  misc_feature (52)..(497): n is a, c, g, or t
  misc_feature (499)..(533): n is a, c, g, or t
  misc_feature (535)..(833): n is a, c, g, or t
gnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtg

SEQ ID NO: 15111 - DNA, 62 bp, Diabrotica virgifera
  misc_feature (8)..(48): n is a, c, g, or t
  misc_feature (53)..(54): n is a, c, g, or t
gtttatannnnnnnnnnnnnnnnnnnnnnnnnnnnnnnnnnnnnnnnntatannattatttt

SEQ ID NO: 15112 - DNA, 242 bp, Diabrotica virgifera
  misc_feature (10)..(40): n is a, c, g, or t
  misc_feature (45)..(215): n is a, c, g, or t
  misc_feature (217)..(217): n is a, c, g, or t
  misc_feature (219)..(219): n is a, c, g, or t
gttggatgannnnnnnnnnnnnnnnnnnnnnnnnnnnnnngattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnantaaattttttgatcccatttttt

SEQ ID NO: 15113 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15114 - DNA, 783 bp, Diabrotica virgifera
  misc_feature (193)..(223): n is a, c, g, or t
aacaaaaatcataaatgaaactgatgatcattgctgctgccctcattgtgcaccgcaaatgctcaaactatctgcattccaacactgcaccagttttacacgcaacacataataaatcttacaacctaattgagaaacaacttcgtttctgaactttccaaaagaaccttcgcaaaatccaaaaacataatannnnnnnnnnnnnnnnnnnnnnnnnnnnnnntctcaccggtaatcaatttgacgattgacccaacgctgaatttaaagctatgatagactctcaaatggctcaaaggccacaactattgatagctgaaacattccaagccgattctaattgacaactaccaacaaacgatgattggaggaataaaaatgttgattggggagctaggaaccaccgaagctgtggatcctgctgggctatcaccagccgacagacacatcgaaggtcaacttgctattcacaaaaagcaacacgcctcaactaagccgaacaagaattggtagattgagacccagcatagacaacggatgcaatgatacgttaaatgacagatgctctttaactacgctagagcgccatgcactagcaatacaaatgaaatataagaacacaccgtaaacgtcgataaatgcaataacgtacacaaacaagtctcttccctcagcggattcgtaaatcttgctataactgaaactgcactacataatgctcttgctaatgacactccaatatctatatatgctgatgcagatacatgacagcattatggaagt

SEQ ID NO: 15115 - DNA, 810 bp, Diabrotica virgifera
  misc_feature (2)..(14): n is a, c, g, or t
  misc_feature (16)..(28): n is a, c, g, or t
  misc_feature (30)..(100): n is a, c, g, or t
  misc_feature (102)..(214): n is a, c, g, or t
  misc_feature (222)..(236): n is a, c, g, or t
  misc_feature (238)..(251): n is a, c, g, or t
  misc_feature (253)..(270): n is a, c, g, or t
  misc_feature (274)..(309): n is a, c, g, or t
  misc_feature (311)..(357): n is a, c, g, or t
  misc_feature (375)..(430): n is a, c, g, or t
  misc_feature (432)..(485): n is a, c, g, or t
  misc_feature (492)..(507): n is a, c, g, or t
  misc_feature (509)..(521): n is a, c, g, or t
  misc_feature (523)..(559): n is a, c, g, or t
  misc_feature (570)..(618): n is a, c, g, or t
  misc_feature (620)..(637): n is a, c, g, or t
annnnnnnnnnnnngnnnnnnnnnnnnncnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttacnnnnnnnnnnnnnnngnnnnnnnnnnnnnncnnnnnnnnnnnnnnnnnncgcnnnnnnnnnnnnnnnnnnnnnnnnnnnnnnnnnnnnannnnnnnnnnnnnnnnnnnnnnnnnnnnnnnnnnnnnnnnnnnnnnnggctaaggtatcataatnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnaagacannnnnnnnnnnnnnnnannnnnnnnnnnnngnnnnnnnnnnnnnnnnnnnnnnnnnnnnnnnnnnnnngatttatttcnnnnnnnnnnnnnnnnnnnnnnnnnnnnnnnnnnnnnnnnnnnnnnnnncnnnnnnnnnnnnnnnnnntattcttttgattataagaatcagttaccttaaggataacagcgtaattttattggagagttccaatcgataataaagattgcgacctcgatgttggttgtaagagtataattggagtagcagctatattattaggactgttcgacgtttaaaattttacatgagctgagatt

SEQ ID NO: 15116 - DNA, 851 bp, Diabrotica virgifera
  misc_feature (809)..(834): n is a, c, g, or t
gactcgaataaaataatacatcgatgtaatgagaacgctgctattgcttgtcttatattggcacttactgcccccttgacctcttatgatcgctgttatctctttcaatggctaaacattcaaaacaatacaaactactaaaaaataaactaagataccctattttcccaaaaaaccttcacgaaatcaaaaagcacaacgcgaaatacaccaaaggataggtgatatgcgcccagggaatatctacattctcccattgcaccaaataagaaatcaaggctctattaaagcgccaatctgcttcaaaacccaaactagacaacagattgggaatgtatactgcccatccaatacgttaacgtgcctgcgtctgttgataggaggaccgacaatgcaatactgcctggaacgtaccacggatcttgagctactggctgggtattcttcatgggtatatctctacaaggacaaatatccatccactacaaccaaagagtgcctttgaaccctcaatatcttgtcgactgctctgaggaaaacgatggatgtggcgccgtataccctggatacctttcacgtctcatagacataaccgtatgacctcccaacactattatactatatactatgcaacatgatgcttgcctgtaacaagtccaatgtcactacgacccatcactagatcacgcatctgaatggagcgtacaactatcatttgcatctctctacaggaatactgtcgaatgttccgctagaaccatatatgatgtgtacaggacttcgagaattacaaagtggtgtctatcaannnnnnnnnnnnnnnnnnnnnnnnnncatgccgtcagaatttt

SEQ ID NO: 15117 - DNA, 161 bp, Diabrotica virgifera
  misc_feature (12)..(112): n is a, c, g, or t
  misc_feature (120)..(151): n is a, c, g, or t
catttttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaatcnnnnnnnnnnnnnnnnnnnnnnnnnnnnnnnngtttttttga

SEQ ID NO: 15118 - DNA, 216 bp, Diabrotica virgifera; identical to SEQ ID NO: 10770
  misc_feature (6)..(28): n is a, c, g, or t

SEQ ID NO: 15119 - DNA, 860 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(841): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnngctcatcccctaaaatatt

SEQ ID NO: 15120 - DNA, 70 bp, Diabrotica virgifera
  misc_feature (2)..(69): n is a, c, g, or t
gnnnnnnnnnnnnnnnnnnnnnnnnnnnnnnnnnnnnnnnnnnnnnnnnnnnnnnnnnnnnnnnnnnnng

SEQ ID NO: 15121 - DNA, 907 bp, Diabrotica virgifera
cgattatgatgtttttgaatggtgataccgatggttttagacgacggtcccgatggttttagacgacggtcccgatggttttagacgacggtcccgatggttttagacgacggtcccgatggttttagacgacggtcccgatggttttagacgacggtcccgatggttttagacgacggtcccgatggttttagacgacggtaccgatggttttagacgacggtcttgatggttttagacgacggtcttgatggttctagacgacggtcttgatggttctagacgacgatcccgatggttctagacgacgatcccgatggttctagacgacgatcccgatggttctagacaacgatctcgatggttttagacgattttctcgatggttctacacgacgatgacgatgctgatggatttcgaccacgatgccgatggacagatgtccccctgtgactcggcctttctcccatggcacctatgaatctttctacgatggtctatgcccttctaccatgggtccttgtcccttttgatgatggtccccatgcccttttcgacgatggccccgatggtattagtctacgttcccgatggtgttagacgacgttcccgatggttttagacgacgttcccgatacttttggtgcatttcgaccatgacatcgtgaaactttctacgatggttcgatgcccttctatggtggctccatgtgccttttgacgatctgtcccatgaccttttcgacgatgtacccgatgtcccttatgacgatgactaacatgccctattctactatggctccggtgccctgacgatgggcgaggtgctcttttcgacattggcttccttacaccattacctcgatgccattcgacaatgaccctattgcccttccatatctcgat

SEQ ID NO: 15122 - DNA, 435 bp, Diabrotica virgifera
tcccggccaagagtgttctttgcaaatttagattttggacaaaaatccgaaatcgaagctcatagtccagtataattttagtaattttaagtaaattaataatatatcacaatgcttatcaaagtcaagaccctcactggaaaagaaatcgaaatagatatagaacctacagataaagttgaacgaataaaagaaagagtggaagagaaggaaggcattcctcctcagcaacagcggcttatattctcaggaaagcaaatgaatgatgaaaagacggcacaagattataaagtacaaggtggatcagttctgcatttagtcctggcacttcgtggtggcaagcctgtataattgtaatgtagctccataaaaactaggatactttaaatcatactttacctgtattctttaagtcaaaatattgcaatctgaagg

SEQ ID NO: 15123 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15124 - DNA, 924 bp, Diabrotica virgifera
  misc_feature (45)..(67): n is a, c, g, or t
  misc_feature (428)..(445): n is a, c, g, or t
  misc_feature (722)..(735): n is a, c, g, or t
  misc_feature (737)..(754): n is a, c, g, or t
  misc_feature (790)..(808): n is a, c, g, or t
  misc_feature (830)..(830): n is a, c, g, or t
  misc_feature (881)..(882): n is a, c, g, or t
tttttggtttaatagaatatcttaacgccacctgttatacataannnnnnnnnnnnnnnnnnnnnnngaaaatctaagatggaagtagcactacattttaagaaaagcattgaatacactttgctatgatattgcgcaatctcattatcgtcgtactgtattataggtattagttcccttattacgaatatgtagaaagtagtgttagttttaagttatatgagaatataaatatattttgttttgcattgcgttattgttacttaataaaattatatggccgaaattggctaagagtattggcttgtgaaacaaaatatcgtccatttttgaaaataattagaatacattaataaacttaatacttactgatgatcttataattaataattattgtaatgaacccatttggcagaaaaatgtatagnnnnnnnnnnnnnnnnnncgattagtaatataacttaaaaagtattttaagaatgcggcttgatctttttaactatattacacaattaagcacaaactaatacacccaaaaatgataaaatacacatcaaattttatttattcttttctgttaagacatattttctagctaataagctatttttcacaaataattgtttaaataaatataaatgaaacaatcctggtgtcaaaagatttgatgcagaggtaacgttatattaaacttgacactagattttatttatggtttttgnnnnnnnnnnnnnngnnnnnnnnnnnnnnnnnntaaaatttaacgtgtgaacgcagtaatctttgcgcnnnnnnnnnnnnnnnnnnnattgtatagatactgacactanacaaatgtcggtaaaattgtagatgggtttataattttttactgaactttnncgtgattatatattttttgggtataatactttcttgtactga

SEQ ID NO: 15125 - DNA, 919 bp, Diabrotica virgifera
  misc_feature (27)..(52): n is a, c, g, or t
cggacgcgtggaaatgttgtggttgtnnnnnnnnnnnnnnnnnnnnnnnnnnagttagaggaccaatgtcagttgaagatgagcaggttcatgaaatcgaagacgatatccctgtaataccaaaaccggagagcacagaaggcagagacttattgaaagaggtgcagatcaggtgcagcttatcgtggaacatcgatgctagagaattaggaactttgctcaatagccccgagatcaagactcttatagattgccacgacgacatagcaaaaatatacgaaaatcccaaacctgaaaaagataattcgccgaaattatttccaaacggaatgactggagaggagtacagaatggtgggggtccggaaaaaaccgggagaacctctaggattaacggtgcaagttgatgaaaacggaaatctaacaatagcgctaataattgaaggtggtatgatcgaaaaacaaggccttttacacgtcggagacattattttggaggttaacggaactccagtagctacccccgaagatttgcaaacggaaatcgcaaaaacgaaggaccacgtgaccctcaaagtacacagtgataccggaaacggtgaagtgacacattcaaatattgttatggccaatggaaacaatggagtaactaaaaaactaacgtgctatatgcgagctctctacgaatacatcccacaagaagacacactcctgccctgtaaagaaataggccttccctttgatcgtggagatatcttccagatagtggatcaacgcgacccaaattggtggcaggcgaaaaaagttggtggagatggaacaactggtctcattccgtcttttagagtagaagaacgaagaaagccttcgtaccccagaagcagactttgtacataccataagcatttgcggagctagaa

SEQ ID NO: 15126 - DNA, 212 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagcccagttggttnnnnnnnnnnnnnnnnnnnnnnnnnnnnnnnngaaagggaccaatatataa

SEQ ID NO: 15127 - DNA, 237 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(192): n is a, c, g, or t
  misc_feature (201)..(228): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnngaaaggacnnnnnnnnnnnnnnnnnnnnnnnnnnnngataatatt

SEQ ID NO: 15128 - DNA, 972 bp, Diabrotica virgifera
  misc_feature (75)..(98): n is a, c, g, or t
  misc_feature (515)..(536): n is a, c, g, or t
  misc_feature (574)..(629): n is a, c, g, or t
  misc_feature (908)..(908): n is a, c, g, or t
  misc_feature (941)..(941): n is a, c, g, or t
caaaatcatattgggttgtgttggcaaaaagtttaaagtttctgtttaattaaaaatacatgaatgaaacgctcnnnnnnnnnnnnnnnnnnnnnnnngaaatctaaaaatgtcgtggtttaattttaatgacagtttaaatatcgtcaaggggcaaatttcgaatctggcaaataatgttttggctgatggagaagaagatcaagaaattaaggacggtgactataagcagcttcaggagctctgccagcaacaagaattggaaatcaagaaactacgtaaaatcaacgaggagctgaatgatagacagacccaacctcacaatgcatcttccaatggatcttggaactgggcagaggactcatctaccacgaccccacatgatactatatccgacctgagaaagcaaatacatgttctagaaaatgaaaaatccgaattgttgggtcaactggatcaactcgatgctgacaatcaagagaatttggccaacatcatggagatgaaggaaaaannnnnnnnnnnnnnnnnnnnnntcaaagaaaatcttctcaaagtaaaaaaagataacaannnnnnnnnnnnnnnnnnnnnnnnnnnnnnnnnnnnnnnnnnnnnnnnnnnnnnnncagaaaaaggtgaacatgtcgaaggggataacgaggaagttgatcaaaaatccagagagcttgaggaagcgaaccgtaagctaattagtgagctcgaggatctaaaaaaggaaaaggtagaaaggcttcaacatacagaaaaagctgaacatgttgaagggcacaaagaggaagttgatcaaaaattcatagagcttgaagaagcgaaccgtaagttaattagtgaaatcgaagagctaaaaaaggagatgagtattttacagacttcttaccaaactngtgagaaagctttagaagatactaaaacatcangcggatccaacaaaaatgaaacacctcaaaa

SEQ ID NO: 15129 - DNA, 443 bp, Diabrotica virgifera
  misc_feature (420)..(438): n is a, c, g, or t
tataggtttgagatttggaaagctacacatgttctaggaccctcaccaaatggtaaataagcaaacggatgtcttttggctttattttcttcgttgagggtcctagaacatgtataggtttgagatttggaaagctacaaagtaaagtaggcttatgctatgtgttaagaaactacaaggttactctgaatgaaaaaacaaaattgccaataagatatgaaagcaactttatctcaactgtgaaggacggcatttggctaaacttagaacccgtttcataggacgaaaaattttgctgcaaggtttaatataaatcctgatttgctgccaacctacggcagtgaaaataccagcatttatttaatttattgtgatcattacaacaaatatttaaattgttactttgctgtttttgtattnnnnnnnnnnnnnnnnnnnttaac

SEQ ID NO: 15130 - DNA, 941 bp, Diabrotica virgifera
  misc_feature (393)..(421): n is a, c, g, or t
  misc_feature (523)..(541): n is a, c, g, or t
  misc_feature (629)..(648): n is a, c, g, or t
  misc_feature (874)..(874): n is a, c, g, or t
actataaaataaacaatttattcaaacaaaaaggtaacacaatataaaaaattttgcgtcttatactaaaaaccatttcattatttttccctaaacatttgcactggaaaaattacctgttgttttgaataagataggctctgtgactgccttgtaaaaataataaacacccccaaagatatattagtaaaaattggtaactaactttttatacaggaagtcccaacggctagaacgccaatcacagtctaggaaaatgttttgtaaaaaaagcaagagaatggtatagtgatgagcgcgctaataaccggcaaaatagcacaaaagatggaaaacgtattaagttgtgagataaaaagaaattaaactagtcgagctgggaaatttagggcnnnnnnnnnnnnnnnnnnnnnnnnnnnnncactaactaaagtaataaaccacagaaatttcgtatttattttatcgttcctcctatgcaagtgaagataagagcttaatggtcttaacacctcatacgtcnnnnnnnnnnnnnnnnnnntgaccagtccaaaaaattgacaacaatttgacaggtccaaactggtaaaaaatgtcaatttgttctattaaggagacttttacattcnnnnnnnnnnnnnnnnnnnntgttttctttttacgtaaaaacatcccttattctacattcataatcaagatgcagtagagtagtatcatagaaatactgtcccaaaattttattaataaactcgaagtagaaacaaagttatataactcgtttgtataaaacaacgcgcgcgacgcctaacctgtgcagctgcaactcgacagctggcttctcaaacttttaatgggagcaacatttatattattngaatttatcgaacattattgttttgaaaatcggaaaaatgtctcgaattaaagagcacttgtatgct

SEQ ID NO: 15131 - DNA, 59 bp, Diabrotica virgifera; identical to SEQ ID NO: 8339

SEQ ID NO: 15132 - DNA, 935 bp, Diabrotica virgifera
  misc_feature (183)..(206): n is a, c, g, or t
  misc_feature (219)..(236): n is a, c, g, or t
  misc_feature (270)..(292): n is a, c, g, or t
  misc_feature (518)..(538): n is a, c, g, or t
  misc_feature (617)..(636): n is a, c, g, or t
  misc_feature (701)..(749): n is a, c, g, or t
  misc_feature (882)..(882): n is a, c, g, or t
tatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttcttttattgnggtattattcttaaattttattatttgagaagctttttctttttcaacgaaaa

SEQ ID NO: 15133 - DNA, 71 bp, Diabrotica virgifera
  misc_feature (9)..(62): n is a, c, g, or t
  misc_feature (65)..(66): n is a, c, g, or t
aaagcttannnnnnnnnnnnnnnnnnnnnnnnnnnnnnnnnnnnnnnnnnnnnnnnnnnnnngtnntttag

SEQ ID NO: 15134 - DNA, 958 bp, Diabrotica virgifera
  misc_feature (896)..(896): n is a, c, g, or t
gatgacatcaacaactgtaactaaacggcacagagaaaaaaacagtgcaaaagctacctcacaagaaaattggaaaggaaaagccaaagatgaaattacagataagaaagacaaagaaagccagccaaaagattttaaatatggacctttacctagattcccttcacaaagggtgtggagcagaggtgtgatgattataggtgttcttgtttatctttggtatttctcaaaaagtaccaatgaaacagttctagcaaaacaaaatactgtctacaatagacgatcccaagtcgtggagtgtggccctgaatttgtagaagatataaaacagtataaatcctgtattccagaaaagtgtggaaggtttgtgagtgacaaaatcgttactgaccaggaggcagacattttattgagattagctgttagaataatggcacaaggtggatcttcaggtggagcatccataattgatttacacacaggagccctatcctacaaagacaggtttataaatatctatgaacagagtggcagcaaaaatattttgacagaatctgaaaggacaatttaccatttagtaagaagcaaaattcaagaagcgatcgctcagaattttggtattcaagccgatagtttatatttaacctatcccacatttttctctagacttaccaatgttgacccaaaaactagacatgacgagtactggcatgaacatattgacaagcgtacctacgaatcattccattatacatcactactctacttaaacgactatgggaaagacttcaaaggaggcagatttattttccaggataacattgcaaaacctaccaaaaacgtaacggttgaaccgcgtaagggtagggtgtctatgtttacttcgggctcagaanatccccactttgtcgagagggtagaagaaggtatgcgatttgctatcactgtttcgtttacc

SEQ ID NO: 15135 - DNA, 935 bp, Diabrotica virgifera
  misc_feature (344)..(362): n is a, c, g, or t
  misc_feature (438)..(457): n is a, c, g, or t
  misc_feature (767)..(767): n is a, c, g, or t
gaaacataatgggaaccgagtcagtattatgacaacatttaagattccagatgaccaggttgataaatatgattatatgatagaaacgatatcgaagtatgtgaatccgagaatgaacgaatgttttgaacgttataattttttaaagaggacccagaaagagggtgaagtattcgaacatttcctaacagattgcagacacttggtaagaacatgcaactacaatcgtaatgatccagatgagacggcagaagataaggcactccgtgataaaattgtaatgggtatcagagatacaactagagaagcccttcttaggatagataaactaacactggaaaagnnnnnnnnnnnnnnnnnnnccagtgagcaaagtaaaagtcaaaatttacaatttcagagtacaggaagcaatgaaacaggttttgaagtaaatgnnnnnnnnnnnnnnnnnnnnatatgtatattgtctcagcttccaccactattaagttccatgagtttcctgatggcaacgttattcacaattaccagcctggaaaagtagagggcccaatccgtagcgtctcttggagccaagatggtaattggttagtcgtagttcctcactcgggtcagactgaaatagttagtactaaggaccaactcaagcttcttaagactatccatgaagtagatgagcccacagtagcttgttttcaaaacacgacaaagaaacttgtaggtataggaacaaagagtgggttagtgctaatatatgatattanatctagaaatgtaaagaagagatttgccagagcctctacacaagttactcatgtggcgtttacagctaaggatactcattgtgttgcaggttgtaagaacggggaaatattagtttacaataatgtaacgaacagtccacctagtaaccttagagtttcaaaatcaaa

SEQ ID NO: 15136 - DNA, 72 bp, Diabrotica virgifera
  misc_feature (6)..(65): n is a, c, g, or t
gtgatnnnnnnnnnnnnnnnnnnnnnnnnnnnnnnnnnnnnnnnnnnnnnnnnnnnnnnnnnnnnttttttt

SEQ ID NO: 15137 - DNA, 790 bp, Diabrotica virgifera
  misc_feature (3)..(38): n is a, c, g, or t
  misc_feature (41)..(67): n is a, c, g, or t
  misc_feature (74)..(102): n is a, c, g, or t
  misc_feature (127)..(146): n is a, c, g, or t
  misc_feature (160)..(222): n is a, c, g, or t
  misc_feature (231)..(356): n is a, c, g, or t
  misc_feature (367)..(426): n is a, c, g, or t
  misc_feature (436)..(588): n is a, c, g, or t
  misc_feature (590)..(604): n is a, c, g, or t
  misc_feature (609)..(664): n is a, c, g, or t
  misc_feature (669)..(699): n is a, c, g, or t
  misc_feature (734)..(776): n is a, c, g, or t
ccnnnnnnnnnnnnnnnnnnnnnnnnnnnnnnnnnnnnctnnnnnnnnnnnnnnnnnnnnnnnnnnnccccccnnnnnnnnnnnnnnnnnnnnnnnnnnnnncgggcccttctcccttccccccccnnnnnnnnnnnnnnnnnnnngggggtgtggggtnnnnnnnnnnnnnnnnnnnnnnnnnnnnnnnnnnnnnnnnnnnnnnnnnnnnnnnnnnnnnnngacagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggggcggnnnnnnnnnnnnnnnnnnnnnnnnnnnnnnnnnnnnnnnnnnnnnnnnnnnnnnnnnnnnctgggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnccctnnnnnnnnnnnnnnnnnnnnnnnnnnnnnnnnnnnnnnnnnnnnnnnnnnnnnnnngggannnnnnnnnnnnnnnnnnnnnnnnnnnnnnntagttgtttattttgtttttccttcgaaccttaannnnnnnnnnnnnnnnnnnnnnnnnnnnnnnnnnnnnnnnnnngggaaggggtggtt

SEQ ID NO: 15138 - DNA, 55 bp, Diabrotica virgifera
  misc_feature (6)..(31): n is a, c, g, or t
gatccnnnnnnnnnnnnnnnnnnnnnnnnnnaccttaggggatacagcgtaattt

SEQ ID NO: 15139 - DNA, 963 bp, Diabrotica virgifera
cgctagcgagtgatcaagtgaatagtaattttatattaacgtggttacagcagtattgtgacatattacacaactttgcatccagctccatcagcatctttttggattacagtgcagtgtaaaacaatttctagttttgagtttttaaattgttcaaaagtgtatcgatcgattagattgagttcttctaccagttctttaaaaatgtgtgtggaaactgaaaaccaaaaatcagaaatgttcaacagaactaaactaagtcgtgctatgcacgccatgctaacccaagcaaaatcaaacagtcgcctaatttgtggactacttcctaccataacccaccttgaaagttcacctgaagatgtaatattttgtctacttcctcaaaccagaccaggcgatgccagtgcccatatgcagacagtattgttacaggccttttgttatgaaaactacataccagtcattcaggtggacagcagtgaaaaattagctgattattgtggagaaacctactccgaaaaacaaaccaattgcacttgtgccatagtaaccagagacttcagcttgccatctactccagaggatgagattcctatgtcgcccacagagaagatgttagcagatttttatgattttaccttggagcagtcaacaaaaccaattattgagttgcccagttgaatttattctgattgaacataccacaaagaatatattcaaaaaatggtcaaaaaacctgcagttggcagctacagtgcttctggagtgataggtgtcaccatgatgtcttgaatggcataaaatgcatttattgtaaaggtgtcctcttgaaaatctaaattaaatttatattggacacaagatcctatcttgtttttcttttgctttgctgcaggaagcaggcattgcaatggttctaggattgattatgtatagattgtttgacattactttaacagttga

SEQ ID NO: 15140 - DNA, 954 bp, Diabrotica virgifera
  misc_feature (2)..(19): n is a, c, g, or t
  misc_feature (630)..(653): n is a, c, g, or t
  misc_feature (831)..(831): n is a, c, g, or t
cnnnnnnnnnnnnnnnnnngttgacttcgattacattggacatcaccttgattgaaaaaatacacaataccgagctgttgggagtacccaaactgaatgtactgaatttaagacgaaataagaaacttaaaattatagagacttacgtcttcgctgatactccttttctgaacgaactggatatcagcggcaacaatttaacgttcctaccgcaatctattgcgaatctaacttatttaactaagctaaatattagtaacaatccatgggcgtgcgattgtcgcatgtactggtttgctagttgggtacccaacatcaaaatgaagggcaatatggtcctgtcagacctaacttgtcctgatgcctacacaaacgacatgttgcctactttacagcatcttaattgcacttcccctagaatagtatataaaacacccactagacgctaccgacttaactcggatgcattactcgagtgtagatttgcagctaatccttctccttctataacgtgggttacgccgaagagagaagtctaccactggaatccggatcaaagtattccagacgcctttaataaacatccccacgcgcacgaccagctgatgatacctctaagagtgatccctnnnnnnnnnnnnnnnnnnnnnnnnggaactctttgggttaaaaacgtaactagagaagattgtggaagatacacctgctacgccagtaatccgatagcaaatttaacggataatgtgttgctgcacatcgatcccacggattggaaccacgtcaggatcatttccttgattgtgggaacgcaaagcgctgctggattcctgnggctgaccctgatcatacagttcctacgatatttagcagccaagttcggcgtcttcataacttctgcagcttctgcaaacgggatagagtgtcgccaagagcaagacaaatatacgctatgct

SEQ ID NO: 15141 - DNA, 937 bp, Diabrotica virgifera
  misc_feature (852)..(852): n is a, c, g, or t
  misc_feature (870)..(870): n is a, c, g, or t
  misc_feature (880)..(881): n is a, c, g, or t
  misc_feature (891)..(892): n is a, c, g, or t
  misc_feature (901)..(901): n is a, c, g, or t
gaaagaatttacattaagatggaaaagttgtatttgtggtttgtgtgtgtattttattttgaagtatttaaaatagctgatgctcaacgcggacagccatgtcttacgcccaacggaaacttagaaatatgcaagtcaatcgacgactgcagacactttgttagagcaattagaaggcaaaatccatctgaattaaattttgtaaaaaaatcacaatgtggttacgatacatcttctttggtttgctgtggtgccgatgccgattttgtgacatctagaaacccatcttctatacttagaaaaagagcacttccatctggcaattccaacactttaccggaatgggcatctatttctgacagaaacatttgcggttttcaggaatatgataatgaggcttatatatttggccatggaggaatagaagcagctatcaatgaacacccttggatggctttacttggttacacaacgcgttttggaagaattaagtggtcttgtggaggcagcctcattagtaatagatatgtcttgacagctgcgcattgtgtaacgggtgaggtagaagtccaggttggaaaagttacatacgtcaaattgggtgtacatgacaaaactaaggaaataacttgcactaaaggaggatcttgtactgaaaaagctgtgactgctggaattgagagttttttcttccatgaaaattatgatgccaataataaagttagtagtaatgacatagctgtcataaagttaaatcaaaccgtagaatacacagccttcataaggccaatatgccttcctgaatcaaataatgaattaagcagaaatgacgaccttgaaatagctggctgnggtgaaacagaatatggntctactaatnngtaaatcaannagtgaattnaattttcgtacgagagatgaatgtatgactgcttac

SEQ ID NO: 15142 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15143 - DNA, 674 bp, Diabrotica virgifera
ctgagaagagacccattccgcattaaaaatgaaaatttatgttattttactgattggtgcaataacatgtttttgaagtacaacgcttggataggaacactatagtctgatcctggcacacaggatcattggggactggtattcatcctctgactgggtaagagctatgatatttgtcgaatagacccatcacaacgagaatgcgttcaattatgctgtccaacaaatagagatatacaaaaaataagatgcgcatctggaagaataacacctccctgctagacaatgccaacagattagtctaaaccactatccaaactgctgatatgaaatatcctgccctgacacctttcctcttcctaaatgaacggcttaacaaggccttacttaccgagtatgaactacttgataactaattgcaactataagattactgttggaaccatctccccagcctactgatttgaacccgtatcctgtgtgacaataccgactgtgatctcaactccctatctcagcatctcgtgttcgaacggaaagacgcctagatagggcaaagcatgtcttatggacaatatgacgcgagcctatgactcgccttactgatgagaatgaatcgtatatctctcagaccactagacaaccgcgcccaagaggtctgccaacactgatct

SEQ ID NO: 15144 - DNA, 117 bp, Diabrotica virgifera
  misc_feature (2)..(116): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 15145 - DNA, 733 bp, Diabrotica virgifera
  misc_feature (649)..(723): n is a, c, g, or t
cttctccatcactcttcctgtcgtccatttagaatttagacaatagttttggcttggctttttagttacaatacaaattttcgaattgttttgtgtgatcaatttatatttcgttattgtaggatattattatggcgtttatactcccagataatatcctagagactttactttgcagtttttgtcataaatacttatctgtgaaacccacaaaagtttatcccaacaggcttatacaatgtggaagatgtgttgataaaaaggaacaggaacaatctatccatgatttcgaagcagtagaatcacagtatggaaaaattgctgaaaacattttatttaaatgtgtcaacagatttgatggttgtcgagaattgttaacatactctcaagttaaggatcatgaacaggtgtgcttggaaaaaattcacgaatgtccaatttgtggtgaagaaatggcgagtttttttctgcttcgacactttgattccaaccataaggatgctatattagattgtcccgcgtttgttttcaagttaaatgatcttttagaaatgcctagtgtttatatctatcaagaagaagataatttgttttttctgtatattagctatactaagtcggaaaatacaataaaattatatttggtttnnnnnnnnnnnnnnnnnnnnnnnnnnnnnnnnnnnnnnnnnnnnnnnnnnnnnnnnnnnnnnnnnnnnnnnnnnntaaaataaaa

SEQ ID NO: 15146 - DNA, 784 bp, Diabrotica virgifera
  misc_feature (5)..(552): n is a, c, g, or t
  misc_feature (559)..(596): n is a, c, g, or t
  misc_feature (616)..(629): n is a, c, g, or t
  misc_feature (632)..(654): n is a, c, g, or t
  misc_feature (662)..(684): n is a, c, g, or t
  misc_feature (714)..(745): n is a, c, g, or t
  misc_feature (752)..(772): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnttatatttagat

SEQ ID NO: 15147 - DNA, 608 bp, Diabrotica virgifera
  misc_feature (582)..(600): n is a, c, g, or t
aataggcttatttagtgattgctgatgaaaagttgggagaaaatggactatgttaactcgagagaaatgcatatgttttttccatgtggcagcatctggtgattgagctgagagattagatagtctacttgctctctgatgtatcatcaggagcgccatctggactttatagttacagagacagccgtaaccatcctttccgtgatgagaggaaagtagtgttcttaaatagattgtaatcttggttagcagagaagtaaatgacaatatctactatatgatttttgccacttaaccactagttatttcattatattgaatattcataaggatgatgatggaacaaaaaatttccatattcttcggtttaactgtaaccttaagactggaaatagtgcgaataatgagagacgatcttacatactttgagtattcctcaatacttcttcatgactgattactctcatgactgctatttgtggcatggctataggaactcgcgctattccgtgaagagttcgcgtagagaatgactcagtaaatttgtacactgcctaagcagggaattgggcaagactaacnnnnnnnnnnnnnnnnnnntggggctg

SEQ ID NO: 15148 - DNA, 889 bp, Diabrotica virgifera
  misc_feature (146)..(165): n is a, c, g, or t
  misc_feature (473)..(488): n is a, c, g, or t
  misc_feature (587)..(608): n is a, c, g, or t
aaatgacctagagaaggatatcggtgagtcgccctcgaattcacatcaaattcaccataagcttaagacataactgaagaacagtacaaaattaaacacgaaaattcaaaatgttccgaacgatcatattacgaaatgatgttgcnnnnnnnnnnnnnnnnnnnnctctccgatccaagactttgagaaatgtttccatagagtgctgcaaacgaagacattatcacagagctttatttggcaatgaacattcacaagttttacaacgatgggtgaaagcagaacacaattttgtcagatattatgccgccgatcttccaagtcataccaaagttacactgccagccctttctccaacaatggaactgggtactattgtaagttgggaaaaaaaggagggcgacaaactgaatgagggcgatctactcgctgaaatcgagactgacaaggcgaccatgggcttcgagactccnnnnnnnnnnnnnnnngcaagaattatcataccagctgggaccaaggatgttcctataggtaaactggtgtgtatcatagtcgaaaacgaagcagatattgcagctttcaaagannnnnnnnnnnnnnnnnnnnnngctccagctccaccaaaggcagctgcacctagtgctcctgcaccatcgccagccgctccagtagctgcagcaccacctgctccagcaatggttgctgatgtatcttccacaggtagggtctatgtcagtcccatggcaaagaggttggccgaacagaggaatatcagattgcaagcagccctagaagccgcctcagcagcacatcccatggcagcagccttgccttcggctggtgcttcggcatctcccttcgtagacatcccagtcacaggaaatgagag

SEQ ID NO: 15149 - DNA, 211 bp, Diabrotica virgifera
  misc_feature (6)..(28): n is a, c, g, or t
  misc_feature (108)..(131): n is a, c, g, or t
tcgtannnnnnnnnnnnnnnnnnnnnnngatagaaaccaacctggacaagaaatgctgatgatataacccaagaagaatatggtgaattttacaaatcattgacaaannnnnnnnnnnnnnnnnnnnnnnnaaaacattttagtgttgagggtcaacttgagtttagagctttattgtttgttcctcgtcgtgtaccttttgatttgtttg

SEQ ID NO: 15150 - DNA, 531 bp, Diabrotica virgifera
  misc_feature (60)..(81): n is a, c, g, or t
  misc_feature (363)..(461): n is a, c, g, or t
  misc_feature (471)..(471): n is a, c, g, or t
aaatgttaccttcactgtaactttacaaaaatctacgcgggactaaacaatacatctagnnnnnnnnnnnnnnnnnnnnnnggtctccaagtacatactttggttatagagcattgtgacataatgttaacattgtcgttaaatgggacgtcatctcataaatatagccttataaatattgatccagaacgctagctcagactactatgaatgaagatctaaatctctgcgaaaccatttgatcactgtagtgtcaagatgataataatgttatttacaaatatcctttggatatttaatttcactcaactgtatttcaatgcaaacataaattaattttaagtcaacttaaattcagttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtactangttagcgttagtatctttggtaactttagttttagtgtttctccttgtatggaattacat

SEQ ID NO: 15151 - DNA, 930 bp, Diabrotica virgifera
  misc_feature (856)..(856): n is a, c, g, or t
  misc_feature (868)..(869): n is a, c, g, or t
  misc_feature (890)..(890): n is a, c, g, or t
cttgcaggtgttccatatttcaagtttgtaatatgttgttcctgtttaaacgattccggacaatgttatcaactcttaagccggactcaaatgactcgtgtacttggcgaataatcgtcacttgcgtatacttgccatgtcgtctgagtgggttactcgtacaattatttgtcactcgttcgtcttccaactgttgtcggtaaaaatgacccgagtcaaagggatcacgattattcgcacacttgcgaagtacatacttgtctgtacttgcagaggcggtcaaacgaaatgtataaataattggcatttactgcgactattcatttagaccagtgcatttagcactaaaaacacaaggataaattgatttttaaatacactacctagagacttgctagttttgcattgtgttcagaatgatgtcaggaaaaaagtctacaatagaaaaatgggtggaaatgcctaattaataattgctttttgaagttcttaacatgcattaaaaagtgtcaaaatgtcaaaataagcataaaaacaaagggataaattgatttttaaatacactacctagaaatttgctagttttgcattgtgttcgggatgatgtcagggaaaaggtctacaatggaggaatgggtggaaatgcctaattaataattgctttttaaagttcttaacatgcattagaaagtgcataagcatgtcaaaataagcatattaagggccgggttttgttactcgcgaggtttttgaggtcgctgaacatgactacgctatcaaaacctaccaccggagcacctggtgcccagggtcactgctagagcacgtcattatctggaggtcaagggctaacggncctaattgatgnncatcagttacttggaggtttngtgagtcgctgaatacgaatatgccatcagaaccgacccc

SEQ ID NO: 15152 - DNA, 172 bp, Diabrotica virgifera
  misc_feature (2)..(171): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 15153 - DNA, 940 bp, Diabrotica virgifera
  misc_feature (819)..(819): n is a, c, g, or t
  misc_feature (881)..(881): n is a, c, g, or t
tttaaggtcacctttttagtactccaaatcaagataaatataaaaccaaatcttcttctatcgttattgatcaaaataagtaccttagaaccttaagtatgactactaatgagttgttattaacggaacattctaaagtgcgccaacaatggggtaaatcttcaaaggatgtcctccaagatattcagatattaagggagtggtgtgaaactcaaaaacattttcctgaaattccagatgacaacatgatagagttttttcttactaactgcaagtatagcatagaaaaagcaaagaagaatattgatatgtattacacacttcctccattaataccggaggtatacgaaaagaggaatcccaatttaccaggttaccaggaaaatgttgagaaatctggaatgatagtgaccatgccgaaactaacagaatctttacaacgagtagcaatatatgcagttaaagaagactctactcattttgaccccatgacactggtatctcatctacaaaatgtgtacgaaataaggatgcacgttgatgttgtaatgggtgaatttcttataatggatgcaagtaatttaaaaatgggccacgtggtcaaatacacaccaattgtgtttaaaacaatggttttaattttgcaaaacataatgagaaataggataactcaaattcatatttttcattatcccccatatatcaatatcataatggcagttgcgaaaggtattttaaagaagaagctatatgacaggatatatttacatgaaaacttagagagtctctacaaacatatttcaccagagtttctgccanaagattatggtggaaaacaaaagtcaatggaggaacttaatgaattatggaaagaggagttngttaaatggtctgatagatttgacaaaaatcaaaatgcgagtagatgaaagtctaaggc

SEQ ID NO: 15154 - DNA, 937 bp, Diabrotica virgifera
  misc_feature (111)..(137): n is a, c, g, or t
  misc_feature (251)..(272): n is a, c, g, or t
  misc_feature (876)..(876): n is a, c, g, or t
  misc_feature (890)..(914): n is a, c, g, or t
cagacaggattataagtcgacttccaccaactgttctttatcgaaccattatttttaaacacgagatttgatgactcagaaaatgtacaaatgtacaatgtacaaataggnnnnnnnnnnnnnnnnnnnnnnnnnnngaccacaaaagtgttatgccactaaaattactacagtaaaaataaagttgtgtcgaaggattgaaaatgtaggaaatttagaaaatatttttgtgatgaaaacatgagtttggnnnnnnnnnnnnnnnnnnnnnngttacacttatatcttctggttgcttaaaaaatacaaagatttaaaaaaaattacgaattgtcaaaaaaaatctacaaaaaaatggtgcgttttcgcaccgttggcgctaaataggttaagttgacccaactaacaatgcaaaatgtaagctcgtgcgttagaattcaaggagaaaactcgacattctttgacattaataatggtctaagacaggggacgcgctggcgtgtctcctctttaatattgccttggaaaagtcagtgagaaacataaattagaatgaatggaactatttttaatagatcgacgcaaattcttgcattcgctgacgatataattatagtgggcagaagtgtgaaagacatggtgcagtgttttacaagacttgcagacgcggcaagtgaattaggacttgtggttaacgaggaaaaaaccatatatatgttggtttctaaaaacttccgaaatatcgaacagagaattcaaattatcaaccatacctttgagcaagttaaggaattcacatatcttgggtcgctagtaaactcaataaacacgacaagcgatgatataaaaagcatagcaatagcaaacagaattctnaaacgtctccagannnnnnnnnnnnnnnnnnnnnnnnngcgtgcaataaaagctcatatat

SEQ ID NO: 15155 - DNA, 890 bp, Diabrotica virgifera
acgaagacgacctagaattcgaagcattagctgctgaaagtttatccaggccaattgtagcaaatcagagttttccagtaggtacaggatcagttgttcctgaaaatatcaagtggggtgcatttggagacgagctaaaagaagaagacgaagacgttcttgcagacgatcctttcgacacaacttttgctgagatagttgtaccagattttaacagggaaatcgtaaccactggtgttagcttaaaaactaactcaacaaatggaaagaactttgcagatcctatctctcgagtcccagaaactggtttaaacctaatcaaaccagaggaccgagacctccttggaggaagcaacagtgatctcgccaccagtgtttcaatatcaacacccgcatttaaacctgtaacagaaattaaagtagataacgagagtgatgacgagtttgatccaagagctgatgaagaaccacgatctagaacagtttctcgaccagatgtgctgaatataacaagttcaaagactgtatcttttgatctaccgtcgccagatctaaatactctaaataccgaggcaaagataataaaacctttgactccgttctacacacgaaaagtatcgatagctgaagcgccagcttctgaagatccttttgacacttcttttgcgtctaacgttacaccaggaaagatcgagctgcgattgatcgaaaacgagttatttgatccgaatttagaaaagagattgagtataaatgataatagctttaatccaagagacgaagctcagactaaaatcgataaagttgttaacacaataaaggagatctccaaacgaaacctccagcacctctgaatctatcgatatagatctattggcgattgacaatga

SEQ ID NO: 15156 - DNA, 935 bp, Diabrotica virgifera
  misc_feature (242)..(256): n is a, c, g, or t
  misc_feature (259)..(274): n is a, c, g, or t
  misc_feature (453)..(472): n is a, c, g, or t
  misc_feature (686)..(715): n is a, c, g, or t
aacaacaccgcataagtaatgtctaccaactttacaggagacaaaaaaaactactttttgaaattaagtattttctatgggaaataaaccacaattttactaaaaatgaattttactttttgaaacaccgccagcttttgagccagagattttgcaccagctttcgcattctatttttggaataaataacgtcagttgactaattttgaacaacaatgaatatcttgggcaaactctgtccnnnnnnnnnnnnnnnagnnnnnnnnnnnnnnnnttctcaaaccgattgcttcacggatcgaggtatcgccattttcaaaatcgtcgccttcgataataaaatcaaaaacttccaaaagctgttcacgaaaatctgttactaaaactaccagagataatctgcttagataaaactaacctgagatttaaaatttcatcgcgtctgacaaactnnnnnnnnnnnnnnnnnnnncaaatttgttctaaaccagtaatccgtttaggtgagctaaactggcaagaaaagacgatattctttatttttttacacttatgcaaaactaaattcattatatgcgcataatattgaataaataaagcttgtaatgcaatagttttaacttttgtctggagaccattcaattcaccacacatcacagcaacgtcgtcataagattgccctaccnnnnnnnnnnnnnnnnnnnnnnnnnnnnnnctgttctttaaaacaccaaaaatatattttgccttattgcttttactcacgtctctaaaacctaaaaacgtctcataaatattaccacgtaacgcgtatcgaaaaacaataattattgataattgtgaatgacatgataatcagaagtttcatctacttcccagcgaaagcaaatggttttataaatctcagattcaataaacgtatttcaaatgtaact

SEQ ID NO: 15157 - DNA, 85 bp, Diabrotica virgifera
  misc_feature (11)..(11): n is a, c, g, or t
  misc_feature (13)..(79): n is a, c, g, or t
ataatttattntnnnnnnnnnnnnnnnnnnnnnnnnnnnnnnnnnnnnnnnnnnnnnnnnnnnnnnnnnnnnnnnnnnntttttt

SEQ ID NO: 15158 - DNA, 604 bp, Diabrotica virgifera
cctgattacttgagaactttcattgatctatcttacctttgtgtcgcccctttggcctgctcttactgttgcaatcatcacacatgtaccgcatgctaccgaactgctggctgctatgatgacatatgccctcgctctacctgatttgaagctatcaatgcggtttggactcaccgacaaacctacttatgccaacatgtcatattacccttcgacaatctactcctggacaccaccctcgccccatacgaacgattcgaaacaagatgcgaaaggcttttgcaagaatttgactgtcggcagaagagaatgctcgatacggatctttctttctgccttacttctcctgaagttcacgctccctccggagaatgtaactcagatgtcggattggaataagcataagctcctggatctgactggctcgtccttactgctattgctatagctctggacctacaaactattactgtccacgaggatcactcagacccccatgtgactaaccatgatcgatcttcgagtcaactcactcgctgaaatgttcctgctacttagtggaactacgagtagcgctgactgggagaacttctcataaggtcaa

SEQ ID NO: 15159 - DNA, 964 bp, Diabrotica virgifera
  misc_feature (260)..(275): n is a, c, g, or t
  misc_feature (802)..(802): n is a, c, g, or t
  misc_feature (873)..(873): n is a, c, g, or t
  misc_feature (908)..(909): n is a, c, g, or t
  misc_feature (913)..(940): n is a, c, g, or t
acgtttgatgttcaaggtttatgcgaaaagtctctctggggtttccaagtagaaaaataaagaataaaatggcagatagtggccaagcaaaaacctttccccagtacattgcggcattgtccgtatgtctgggagctgtagcagctggtgctgtattgggctggacatcaaacatttcgaaagacctacagaagggaggattaaatgaccttgtcataagcgatgaccaattaggatggattggttcctttgtgactctnnnnnnnnnnnnnnnntgttttccaatcggctacatttgcgatttaatcggaagaaaatggggatgtcttctaacactcataccatttacagttggctggcttttagtgatattttcttccagtgtcagtgtaatttacgtcggaagatttttgacaggtttagcaggaggatctttctgtgtagctgctcccatatacactgcggaaattgcacaagccagtataagaggagccctaggaagctatttccagttactcttgacagttggaattctcatagtttatgttggtggagcttggatgcatccaaaggaccttgctatactctctgccgtgataccaatcgtttttgcagtagtcttcttctttcaacctgaaacacctatctatttaatgaagaaaaatcgaccagaggaagccaaaaaggcgttgcaacgattacgtggaaacgcatacgattgcgatgcggaactaaaagaaatacaactgagctttgaacagggctcatcagaaaaatctttcatgacagttctaaaaactanagctgccattaaggcttgcttgattacgtttagccttatgtttttcccagcaatgagcggtatcaacgctngtattttttacactggaaagatatttgaagcttcnntggnnnnnnnnnnnnnnnnnnnnnnnnnnnnaattgtaggaattcttcaacgtca

SEQ ID NO: 15160 - DNA, 734 bp, Diabrotica virgifera
  misc_feature (3)..(16): n is a, c, g, or t
  misc_feature (21)..(535): n is a, c, g, or t
  misc_feature (542)..(579): n is a, c, g, or t
  misc_feature (599)..(612): n is a, c, g, or t
  misc_feature (615)..(637): n is a, c, g, or t
  misc_feature (645)..(667): n is a, c, g, or t
  misc_feature (697)..(728): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15161 - DNA, 659 bp, Diabrotica virgifera
  misc_feature (16)..(127): n is a, c, g, or t
  misc_feature (146)..(203): n is a, c, g, or t
  misc_feature (209)..(278): n is a, c, g, or t
  misc_feature (287)..(374): n is a, c, g, or t
  misc_feature (390)..(499): n is a, c, g, or t
  misc_feature (501)..(533): n is a, c, g, or t
  misc_feature (535)..(657): n is a, c, g, or t
ggggggaaaaaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtggggggggggtaaannnnnnnnnnnnnnnnnnnnnnnnnnnnnnnnnnnnnnnnnnnnnnnnnnnnnnnnnnataaannnnnnnnnnnnnnnnnnnnnnnnnnnnnnnnnnnnnnnnnnnnnnnnnnnnnnnnnnnnnnnnnnnnnnttctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctctcctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntg

SEQ ID NO: 15162 - DNA, 713 bp, Diabrotica virgifera
  misc_feature (4)..(712): n is a, c, g, or t
gccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 15163 - DNA, 821 bp, Diabrotica virgifera
  misc_feature (99)..(116): n is a, c, g, or t
acacattttacgttaggttatagtttaaaaaatcaatatgacaaatacgccaactctcgataaaccaggtcttcctcgatttggcgagagacatcgacnnnnnnnnnnnnnnnnnngtctcgcagcagttgccatcgcaatgagggttcagctttcagttgcaatagtagcgatgaatgatccagaagcctcgccaaatccaagcgttccagtctatgactggaagaataaaagtgttattttgtcttcatttttttggggttacattggactgcaattatttgcagcggattggggcagaaggtatggatctaaacgatttcttttaggagccatgactataaattgtacagctttagctttggtcccacttctcgcagaacattttggatcaataggtgtaatgtgttcaagagtggtgcaaggcttatgccaaggattcgtttacccttcaataagtaatttacttggtaggtggactcatatttcagagagatcgagactgggaagtttaactttatcaggtgctccatttggaacaattatgagtttaccagttaatggatttatagctgcttcttggcttggatggccatattgtttttacatctatagtatagctggttatctatgggttattatgttttattttcttggtgctagtactgccgcagagtcataaagaatatcagctgctgaaagagagtacattgagaagtctaccaatatcaaaggacaaaataagttgacagttccgtggaaagaaattgtgaatgtagacattttaggggctgtttttggaacaaggtggccaaatttgg

SEQ ID NO: 15164 - DNA, 594 bp, Diabrotica virgifera
  misc_feature (18)..(39): n is a, c, g, or t
gatagttgatgaaattgnnnnnnnnnnnnnnnnnnnnnnctccctccaatttcatatttggttcctttacgtagatagaatatctttaatatttatatgatttgttatatttatttcttcgatagtactttattatagtgaagaatatataagaggtgatatatctaaaaatcgattgattttactagctgtactatttgttttttcccactaacattaatgcataagtcctacattaatttcccttttataacgctgagatggagctacagtttaatcccactaccgcctagcaatggatgatccacatacttactcatatttttggctggtatattaactgctttatcataaccgaattggtgatgtagcatggattgataccgattgcttgaatattatattttgggagttgaaattttgagtttttatttagatgtgataaaaaatgattttactatacaagttaatcacctgataacttatttgacctgctataactaaaagtgcctccagttcctatatcatctctgcctacctgccacactcagctgctccctacccccgcttcttctatagcaccctcttcccctt

SEQ ID NO: 15165 - DNA, 799 bp, Diabrotica virgifera
  misc_feature (481)..(546): n is a, c, g, or t
cccacgcgttcggtcggtgattttgctattgtggtccctttggtgcaccaaaatggacagcagcaactgcacacgctgatggccaccctgatcccaatttccatccgcttgaaatcccacaagatcatccaaaacataacaatgtccatgaaaatggagtacgccaccaattacaccaagcttgaaagggaactgcccgttgtgcaccccattagcgatgtatataaccaagtttatgataaacctgaaattcatcccttacctaatgtgcctcttaatataactattgatataacttcatacggaggtctatgcgccgctgttccccccaacgtctctccttactttcgtacagaattgcgcaacaatgatcagaacattaaagtggattgagcccgatatatctctcgaccaatctatcaacgaatctatgtgatcaacagtatggtcgcctgacatgagcccccacctttgccccccnnnnnnnnnnnnnnnnnnnnnnnnnnnnnnnnnnnnnnnnnnnnnnnnnnnnnnnnnnnnnnnnnnaacattgtgaattccgaagtttcatctgatgcatcttacttcactatgacattgtctatggttagctcggctgctgctacattctcaccatatttatcagtctatgattcattagatgacaaataactccagatctacctagaattctccttatcctatcttctgatctattccgtgagagaaggagcttgctcccaaatatctcccctgatgactgccatggacaatgccagcaagatcgttgacgagatga

SEQ ID NO: 15166 - DNA, 667 bp, Diabrotica virgifera
  misc_feature (11)..(468): n is a, c, g, or t
  misc_feature (475)..(512): n is a, c, g, or t
  misc_feature (532)..(545): n is a, c, g, or t
  misc_feature (548)..(570): n is a, c, g, or t
  misc_feature (578)..(600): n is a, c, g, or t
  misc_feature (630)..(661): n is a, c, g, or t
cccctcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15167 - DNA, 976 bp, Diabrotica virgifera
  misc_feature (119)..(136): n is a, c, g, or t
  misc_feature (751)..(778): n is a, c, g, or t
  misc_feature (859)..(859): n is a, c, g, or t
agccgaaaccacttttaactactgaaccttcttggcaaaaacttcaacaatattatgatagtaaaggcaataaattagtcatcaaggaccttttcgcaagtgatcctgcaagattcgannnnnnnnnnnnnnnnnntgctactcctaatgatggcgacatactcattgatttctcaaaaaaccgcattgatgaagaaggtttgaagctattgcttgacttggctcgttcaaggaaagtagaagctgcacgagatgctatgtttaatggatccaaaatcaacttcaccgaaaacagagctgtattacacattgctttaagaaatagatcaaaccgacctattttagttgatggtaaagatgtaatgcctgatgtaaatgctgttcttaatcacatgaaaagctttacagaacaggtgttatctggtgcatggaaaggatactctggcaaaaaaatcactgacgttgtcaacattggtattggaggatcagatttaggaccattaatggttacagaagctttaaaaccttacagcaaaggactcaacctacattttgtttcaaatattgatggtacccatctcgcagaagtgctaaaaaaagtcaaccccgaaactgttctgttcatcattgcatccaagacatttaccactcaggaaacctgcacaaacgctaaatcagcaaaagattggttcttggcaacagctcaagatgtaagaaatgtatatatgtaaatatatgatcatatatatannnnnnnnnnnnnnnnnnnnnnnnnnnncagtgatacttcagtgaaatttatagcagaataaaataatggcaaccatgtttaggaacatctgtcttgctctcctccttnttttgtggagtgggcggtatgtgttcaaaaactcccaagaacatttttcaatggaacattttagaattatgagtttcccacagaaagctaatccgaaaggaatgcttttacctgaca

SEQ ID NO: 15168 - DNA, 71 bp, Diabrotica virgifera
ccccccccaggacccaccccaaaatccccccctcctcccccaccccccccgcaccagcataacatctctac

SEQ ID NO: 15169 - DNA, 71 bp, Diabrotica virgifera
  misc_feature (4)..(60): n is a, c, g, or t
gggnnnnnnnnnnnnnnnnnnnnnnnnnnnnnnnnnnnnnnnnnnnnnnnnnnnnnnnnntcccatttttt

SEQ ID NO: 15170 - DNA, 881 bp, Diabrotica virgifera
  misc_feature (782)..(782): n is a, c, g, or t
  misc_feature (832)..(832): n is a, c, g, or t
gaaaatattaaacactgtactgggcctttaaatttaacaaaataatgggtgatactagcgatttggatagacagatagaccaactgaaaaggtgtgaagttattaaggaaagtgaggtcaaagccctgtgtgctaaagctagggaaatactggtggaagaaagtaatgtacaaagggtggattcaccagttacggtatgtggagatatacatggccagttttatgacttaaaagaacttttcaaagtgggtggagatgtacctgaaaccaattacttgtttatgggggattttgtagatagaggtttctacagtgtggagacgtttttgttactattagcacttaaggttagatatccagatcgtataacactaattcggggaaatcacgagtctcgccaaatcacccaagtatatggattttatgatgaatgcctgcggaaatatggttccatcactgtttggagatactgcactgaaattttcgactacctatcattgtctgccatcattgacggtaaaatattttgtgttcatggaggactttcaccttccattcaaaccctagaccaaattagagtaattgatagaaaacaggaagttccacatgatgggcctatgtgtgacttgttgtggagtgatccagaagatacccaaggatggggagtttctccacgaggagcaggatatttatttggatctgatgtagtagcccaattcaatgctgccaatgacatagacatgatatgtcgcgcccatcaattagtaatggaaggatacaantggcattttaatgagactgttttaactgtttggtcagctccgaattattngtacagatgtggtaacgtggcccgcattttagaaactgacgaacaccta

SEQ ID NO: 15171 - DNA, 665 bp, Diabrotica virgifera
  misc_feature (14)..(59): n is a, c, g, or t
  misc_feature (81)..(102): n is a, c, g, or t
  misc_feature (159)..(184): n is a, c, g, or t
  misc_feature (192)..(214): n is a, c, g, or t
  misc_feature (218)..(252): n is a, c, g, or t
  misc_feature (296)..(315): n is a, c, g, or t
  misc_feature (317)..(405): n is a, c, g, or t
  misc_feature (418)..(443): n is a, c, g, or t
  misc_feature (459)..(494): n is a, c, g, or t
  misc_feature (503)..(597): n is a, c, g, or t
  misc_feature (604)..(631): n is a, c, g, or t
  misc_feature (649)..(664): n is a, c, g, or t
ggggttcttgcggnnnnnnnnnnnnnnnnnnnnnnnnnnnnnnnnnnnnnnnnnnnnnnctctcttttggggtgggggcgnnnnnnnnnnnnnnnnnnnnnnggggggtgtccaacacacaaaaaaagaggaaggggagggaggggggggggcgcggcnnnnnnnnnnnnnnnnnnnnnnnnnngggagggnnnnnnnnnnnnnnnnnnnnnnncccnnnnnnnnnnnnnnnnnnnnnnnnnnnnnnnnnnnatgtggtgtggggtgggggggggagaagggaaaacacaaccccnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggggtgtggnnnnnnnnnnnnnnnnnnnnnnnnnnccgggggcgggggcgnnnnnnnnnnnnnnnnnnnnnnnnnnnnnnnnnnnnaccccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtnnnnnnnnnnnnnnnnnnnnnnnnnnnnaacaccacacccccacannnnnnnnnnnnnnnna

SEQ ID NO: 15172 - DNA, 862 bp, Diabrotica virgifera
  misc_feature (377)..(446): n is a, c, g, or t
  misc_feature (780)..(801): n is a, c, g, or t
gaacaatatcgtcagcgaatctcaataaatgactaagtatttctccgttgacattaattcttttttcactcagatttacgttcttaaacatatgctctaataatgtagtaaacaattttggcgatattgtgtctccctgtcgcactccccgttttattttaaatgcttggtctttttatctgccagtttcacgcttgctgtcgcattttgatagatgtatttgatcatgtttatatagcgatgatctatacggcactccattaaggcttttaacattttttgatgactgatggtgtcaaaaactttttcgtagtcaacaaatatcaggactaatggcttgttatattcaacactcttttctattcttaattatttgnnnnnnnnnnnnnnnnnnnnnnnnnnnnnnnnnnnnnnnnnnnnnnnnnnnnnnnnnnnnnnnnnnnnnnttgcggtgcctgatgttatatccgggaatattgtggacatcacttttattttaacataataatgtaaatattttgtggttgtatgggatttgaagtgctttcacccacatatcttgagggctcaagggtgctataaagctctataacgcactgatggtgaactttttaatcctaaaaccttcttgaggtgtagccattaaaggatgtttaaattgtgagggggcttgtcgatagaaatattccgttaatagtggatcagaccgacgatgggagattacctaaggaaaccgtattttaccctggataagaagaatttgtggggataattttactnnnnnnnnnnnnnnnnnnnnnncaacacagcgaaacatcctctaagcaaagcctcacgcaagaaaaattgactcatattgcca

SEQ ID NO: 15173 - DNA, 855 bp, Diabrotica virgifera
  misc_feature (68)..(81): n is a, c, g, or t
  misc_feature (83)..(95): n is a, c, g, or t
  misc_feature (766)..(787): n is a, c, g, or t
  misc_feature (828)..(828): n is a, c, g, or t
  misc_feature (834)..(834): n is a, c, g, or t
aatatgtacaatataaagtgattataaattaagctgtagaagtaactagttaacttactgataggcannnnnnnnnnnnnncnnnnnnnnnnnnngtatctttgttgtgttgtataataatagaaattagaaaaatgttcaaagtagtctccagttcaataaaacgtttctacaaatctccgaattcaattttaaaaatgagtgttagatcagcatcagcatcttgtgataaaagtaattctattgatcaaaagtttggactgcccaaaagatatgcaggaagcaaagaaagtgtctggactgaatatatacaaatggcaatcgatcttaaacctctcaacctgggacagggatttccagattttcctgccccacaattcattatggatgctttagcaacagtttccaataaatcagattatatgttgcaccaatacaccagaggattcggacacccaagattagtgaaggctttagcaaagttctattctaaattaataggtagagaaattaatgaaaaaactgaagttattaccactataggagcatacgaagcactaaatgctgctattatgggacatactgaagttggtgacgaagttattatcatagaacctttttatgattgttatgaacctatggttaagtatgctggtggggtcgctagatatattccgttaagattgaatcaacccgccgatgggagattacctagttcagcggattttaccctggataaaaaggaattggagggattatttaacgnnnnnnnnnnnnnnnnnnnnnncaacacaccgaacaatcctctaggcaaagtcttcactgaangaagangtgactcatattgcccgatct

SEQ ID NO: 15174 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15175 - DNA, 947 bp, Diabrotica virgifera
  misc_feature (2)..(19): n is a, c, g, or t
  misc_feature (383)..(401): n is a, c, g, or t
  misc_feature (907)..(907): n is a, c, g, or t
cnnnnnnnnnnnnnnnnnncaataaaatggatgaattacagaaattggaatatctttccttggtttctaaggtttgtactgagttagaaaaccatctcggtatgaatgataaagatttggccgaatttattattcatctttccgagaagaatggtacatttgaatctttcaaaaaggcacttatagaaaatggagccgagttttcagattccttcatctcaaatttgctaagaatcattcaacatatgaaaccgaagaaaaataaatcgaaagttgaagctgatgtgtatcaaaaagaaactctcgctaccaaatttcctggtttagctttaccaaacgaaaaacaaaaacctttgtttatagatgaagaagcacctgctgannnnnnnnnnnnnnnnnnnattgtagccgacctaatgaaacagtttgaagcggacgctccctcaaacagtcaaatccaaacaacaactaaatctggaagtgcaagtcctatagaaagaaaaagatcgtcaagaagtaggtctagatctaaaccaagaaaaagacggaaatctagatcaagggacagggactctagaaaggacaaaagacgaagtagatccagagaccagaagaaaaacagaagagatagaagtggttctaggaacaaaagaaataaagaaagaagtaggtctaggaataggagaagcagatcaagggatagaagaagtagatcgagagacaggagaaacagatctaaggatcgaaaatacaaaaattattctagagataaagataggagagaaagaagcaattctagggatataaaacgggatagaagtactgagaagaagttcaaaagtgaaaaagataatccagagtttgaagatgatcctaccccaggaaaatatataatgggaaagtatcnaatattgtaccttttggatgctttgtccagctggagggac

SEQ ID NO: 15176 - DNA, 369 bp, Diabrotica virgifera
cttttttgcttttccaaaatatgcaaaaatattgttaaaagttggtaagtatttaaacatttgtttgcgtccaaatacctttaatatataacacgcaatatgaaatatgttaaaaatgtttatcctgatgctgattcattaaattgataaacataatttcaattatgtataactaataatagttagtttccatgttaccaaaaataaacagaacaactcaacctcgacgttacgaactgtaccgttacgaatttgcacagttacgaattgtcgtcgttacgagttagccgttacgagttagccgctaccacttgtacggctacgaaatgtcgcgtcacgagatgccatggaaccgagattactagatat

SEQ ID NO: 15177 - DNA, 1108 bp, Diabrotica virgifera
  misc_feature (67)..(81): n is a, c, g, or t
  misc_feature (84)..(99): n is a, c, g, or t
  misc_feature (130)..(149): n is a, c, g, or t
  misc_feature (337)..(355): n is a, c, g, or t
  misc_feature (366)..(388): n is a, c, g, or t
  misc_feature (624)..(624): n is a, c, g, or t
  misc_feature (660)..(684): n is a, c, g, or t
  misc_feature (718)..(771): n is a, c, g, or t
  misc_feature (780)..(825): n is a, c, g, or t
  misc_feature (827)..(839): n is a, c, g, or t
  misc_feature (843)..(860): n is a, c, g, or t
  misc_feature (871)..(924): n is a, c, g, or t
  misc_feature (928)..(1031): n is a, c, g, or t
  misc_feature (1041)..(1072): n is a, c, g, or t
ggcacgcggccgcgggaacccccgccctccctctccctcccgctcgtctcgattctaaaataatacnnnnnnnnnnnnnnnaannnnnnnnnnnnnnnncttaacgcgaggttatatttatcgtgagagnnnnnnnnnnnnnnnnnnnnaaacactaattctttgttccctgcctcgctggaaccaggacatattgtttataaattaaatatctattattacccaagatgaagaaagctcaaaaacttgaatagttcttgtgtacacaaatctttatgaatgcaattcgtatgcaatagaaaaggtgtctcttaactgaacaataatctacactttnnnnnnnnnnnnnnnnnnncttatttctannnnnnnnnnnnnnnnnnnnnnncaatacttactccgatggactgacaactactcttcagttatcagctttacatataacattatttatgacataagttctcgacatgactcttatgacaaaatatttcctcattcatgatgaatcttatttccaagtgtctctatattagtgtaaatactttcgttcatcgttaacttatcaccttagacgatttcaacgactctaaaacgcagataatctatgatcaacatacttangttagattaggggggggggagaccacaaaatatatnnnnnnnnnnnnnnnnnnnnnnnnnccacgaaaaaaacccccccctcctcccccccccnnnnnnnnnnnnnnnnnnnnnnnnnnnnnnnnnnnnnnnnnnnnnnnnnnnnnnccttgttgnnnnnnnnnnnnnnnnnnnnnnnnnnnnnnnnnnnnnnnnnnnnnntnnnnnnnnnnnnnaagnnnnnnnnnnnnnnnnnnaaaaataccannnnnnnnnnnnnnnnnnnnnnnnnnnnnnnnnnnnnnnnnnnnnnnnnnnnnnggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccttcnnnnnnnnnnnnnnnnnnnnnnnnnnnnnnnntcccccccccactcacccaccaccccaacaaaagaa

SEQ ID NO: 15178 - DNA, 90 bp, Diabrotica virgifera
  misc_feature (11)..(11): n is a, c, g, or t
  misc_feature (14)..(76): n is a, c, g, or t
  misc_feature (82)..(82): n is a, c, g, or t
tataatttatntannnnnnnnnnnnnnnnnnnnnnnnnnnnnnnnnnnnnnnnnnnnnnnnnnnnnnnnnnnnnnngatccnattttttt

SEQ ID NO: 15179 - DNA, 52 bp, Diabrotica virgifera
caaagttgaaaactcgcccgatcaaatgcgccggtactactcgcactattct

SEQ ID NO: 15180 - DNA, 109 bp, Diabrotica virgifera
  misc_feature (7)..(44): n is a, c, g, or t
  misc_feature (66)..(66): n is a, c, g, or t
  misc_feature (80)..(97): n is a, c, g, or t
  misc_feature (100)..(100): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnaangtctgtcga

SEQ ID NO: 15181 - DNA, 920 bp, Diabrotica virgifera
tactagtaggacatgtagaaggggatgtaagtctattggaagtctacatatacaatgaacaagaagagtcattgtatgttcatcatgatattatgttatcatcctttcctctgtgtttagaaccgctaaactatgaaccgaagatgcccaaaggaaattattgtgcagtgggatcaatgtcacctgttatagaggtctgggatgtagatattatgaatgttattgaaccttcatttactttagggagacctgctagtaaaaagaagaacaaggaacatataggccatacggatgcagtgctttcattagcttggaacaaaacctttgaacatgtgttggctagtggatctgtagatcaaacaatacacttgtgggatatggaaatcaaaaaaccaagtacaaccattaaatccttccaagaaaaagttcaatgtctcgaatggcatcctttagaggcacaaacacttttaggtggaggttgtgacaaatctgcaagagtatttgatggcaggacccctgaaacccaccaaacttggctacttgatggagaagctgaaaggctatgctggaacccattagaacctttcacatttttagcaggtaccagcagtgggtctgtacagtgtttcgactgtagaaaaggacagctatggtcagttaaagcacacagcaaggaagtaacagggttagtccttagcaaacaatgccaaggattgttgattacttcttctacagatgaaacagttaaaatttgggacttggctacactggaagctgaacctaagcttgttaatgaaaaggagtttaatatggggaatattcactgtttggatttatgtccagacttgccgttttgtatatctgtaggtggagataagaaagtcaataattttactgtttttgatgtacagaatattgat

SEQ ID NO: 15182 - DNA, 683 bp, Diabrotica virgifera
  misc_feature (7)..(7): n is a, c, g, or t
  misc_feature (53)..(76): n is a, c, g, or t
ccggccngccatctaaggcgcgccgaggttttaagaatcggagttgtttcatnnnnnnnnnnnnnnnnnnnnnnnngtgtgaatttgtaagtcaatgatgtggtctgttatttagattttatcccccaccgaattctatcattttccaatcaccgagagaattgaattagaccaaaaaatcaagatctgaaattgccgtgatgtcgcacatgacgtcattagtttttatataatatccttgcaattatttatagtctggtatagtagacagcgactgaatgttataatatgtgaaaacgaagataatatccattattgacctatatatgaattagaagctcttttagaatattttatggaaatcataatataagtctttctctgagcaataaaagtaccgctatcttcatggaaatttatccatctagaaagacggttcgcacaataggattaggtcgactatcgtatatagtacaaaatgatgttaagcgatatattaccatcctaaaatatctgtctaaaacattgacctcaatgatttaaattctgttcacaggtgaccaatgaatgcattgcctgaactagaactctaagattttataatcaatgagctattctagaattagtatgctttgctcataacataactaattagtattgttaggtatcggagaaagcatatt

SEQ ID NO: 15183 - DNA, 1072 bp, Diabrotica virgifera
  misc_feature (13)..(33): n is a, c, g, or t
  misc_feature (192)..(217): n is a, c, g, or t
  misc_feature (231)..(476): n is a, c, g, or t
  misc_feature (534)..(558): n is a, c, g, or t
  misc_feature (625)..(647): n is a, c, g, or t
  misc_feature (712)..(729): n is a, c, g, or t
  misc_feature (805)..(824): n is a, c, g, or t
  misc_feature (949)..(968): n is a, c, g, or t
  misc_feature (998)..(1016): n is a, c, g, or t
  misc_feature (1040)..(1058): n is a, c, g, or t
ttgaaacaaaacnnnnnnnnnnnnnnnnnnnnnatgtacataattatatatcaaagtacactgtgaacttaccatttattactgagatatacggaggtgttaacgatattcatagaatgttggtggggagttcagtggttaaagaatacgaaattatacaataatattttggttattatatacaaaatatgnnnnnnnnnnnnnnnnnnnnnnnnnngtattgatatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggattaaccccatttaaagacaattaaaaagaataccccgttttcccccccctnnnnnnnnnnnnnnnnnnnnnnnnngcggccccttttcaaaaaattgcccccccgaaatggctattgggacgccgccggagggggggttttnnnnnnnnnnnnnnnnnnnnnnncgccaaaatggagcccataactttgtcccccccctttcgccccccccttccgggttaggcctgtnnnnnnnnnnnnnnnnnncctgtttttccccttttgttttataaaggcgggggccccctttagggttccccaaattaaaggggttagccgggcnnnnnnnnnnnnnnnnnnnntgattaaggggggccgggggctcccgaaaaggggcccccccccgcgcgggataaaaggtttttttcccccttttccccggggaaaaacccgggttttttccttgggggaacttttttttccccannnnnnnnnnnnnnnnnnnncccctattttcgcggcttttttcccccttnnnnnnnnnnnnnnnnnnnttttggggaggttttttggggggnnnnnnnnnnnnnnnnnnncacccgcccccctc

SEQ ID NO: 15184 - DNA, 652 bp, Diabrotica virgifera
  misc_feature (375)..(398): n is a, c, g, or t
agtaaaccaagcgacatcgtgtctcgtttatcgtgactcacgttaaggggagagaatgctgtataggaatcccggatttaagacatgaaaagaacacccattactcactatagttggatttttccacaccgtacttggaaacattaatggtgatgttcaaaagataatacatgaccctgaacgtggtgctgcaccttgactcgcatcacttttcttagagacctactggtaacagattatcttggaattgcgtgttgtcgccgatagagtgcaccctggagaatttttggaatgtgcatctagagcttatgttcagagtggtgatgttttgcctgctggtcctatggcagatagcactattgctggaaaattaannnnnnnnnnnnnnnnnnnnnnnntcctagctggagtctcggaaacttatgcgacggtagttgctgatactcgctatgcacacaaaactatagctgaatactttctggagacattaacagttttcgatctgagaactagtgcttgtcgattatcgttggtggaggtggccattttgacaaaccactcttactcgcacggcatggttacactgagtacgaatttagactaaactgctgctctaacgtacaggaagcattgcaccctgtagaacatgctc

SEQ ID NO: 15185 - DNA, 934 bp, Diabrotica virgifera
  misc_feature (27)..(45): n is a, c, g, or t
  misc_feature (126)..(145): n is a, c, g, or t
  misc_feature (796)..(818): n is a, c, g, or t
  misc_feature (886)..(886): n is a, c, g, or t
caaaaatacagtaaaaggttaaactgnnnnnnnnnnnnnnnnnnnctttagaatataatttctgcatattggaaacagtaattgaatttaattgaaatggagttaagtgaagattctatagagttnnnnnnnnnnnnnnnnnnnngtgacaaagatggagatggagattctctagtgcaccatgttaatgtacaaatcaaatcagaactggaagaatgcacgattgaaagtaataattattacacagaagattctttatcagactcatattcgaataatattaaaatagacgaacatatgttacaatatgatataagtaacccattccctgtcattaccaagcaagaagttaagacagaaatcaaagaagaactggatgaacataacttacaagtaaatcatgggtgtaacactctatttaacagtacagatactgaaaaattagacttagagagagatgttaaattgcagataggagcttcaactgagatagatgatgaaaaacgttgcagaagtatgaaaacagaaaagttattgcctagcattgaaaaaaaaggtgtacgtcagaacgagattaacacgaaatgtgaaggatctttgataacaccaacacgagaaagttcgtacaagtgtgaaatatgtttgaaggaatttactgtgttaagatatttaaagaagcatttgcaaatacacactggggacaaaccttacaagtgcaaaatttgttctaagcaatttagtagaaatgaaaatttgaaagtgcatgtaaggctacacaccggcgaaaagccttatnnnnnnnnnnnnnnnnnnnnnnnatttaataaatcagatagtttgaaaacgcatttaataaaacacactggcgaaaaacctttacagtgtngaatttgtttgaaacaatttggtgaagcaaaaactttgaagaatcatt

SEQ ID NO: 15186 - DNA, 495 bp, Diabrotica virgifera
atcctatttttgaagccctccccctcatcgaccgacacttttacgaaattgctgtgcggccggacatgatacgtgggccatatgaagtatgtaaatcaaacaggaaaataaatgattgtggacctctcgtcgggcgaatacttactctactaccctaaataaatgacttccatggcccttacgagcatgaacgaatactagtattgttatgtatgaaataatgttgccaactttgtcgtcgcagtgctcggctgttccaatgaatctataccgctagctaccaaggatgatggactcttctgccgagctcccataattacccattattatacttatcactgctggagtcatcgacccatggtagagacgataggggcctcgaatgacgtaacgatatcattttcgatcagggaggtggaacttctgatgtaacctcttaacaaatgaggatggaatcattgcaataaaacaaccgctggagacactcaataggta

SEQ ID NO: 15187 - DNA, 932 bp, Diabrotica virgifera
  misc_feature (131)..(151): n is a, c, g, or t
cgggagttgtcaattgttttttgattaacagcgaatattcgcatacattcatggcttttttaaccaaccacccttaagttgctccagcctttgccagggcgaaccacaatttttttcctaccctcgtaccnnnnnnnnnnnnnnnnnnnnnggaaatatctttgtttacttttttactgaggggatcaggagttgcatggtcgccttggagcataccacgtcacaaaaccaaaaccaatcgacgctgacgaggcatggaaacaccacattgaccgtgtaaaaggacgcgagccatcacaatggcccagcagcattttccacacatcttacccattctctcgctatccattgtacttagtgtacagtaagagacctgctccagctgctgacaaatacgatccacaccgctcctggttggatcacatggaccgtcttgccgagctcgacaaactctatccctccttatggccatccgttggaagcagaagaccaactccaatcaaggctggtgaatttgctcctcgtccaaacgaagtagcctttaactacgctggccaaccaatttatacccgtggagggttgtatccaagtaagaaactattcgacgacattttaaacccttctccaaatctccctgtatccgctgtatctcgtgatcccttctggtgggactctcctctcaaacccgcttctgtgcacaacccatggggcaaatccccattctatctccgcgactcatatctttccccagtcaagaggacgttcctgtgggacaaacaccccgttaggccgttcgctgccgtttactaagtggaagaaaaaagaatgacacaacgaggagtcaacataaaatcagtataccacaagcgactgactgaacaaaaaagcattgaaacatctgtttgcacttatttaaactatgtttcacccga

SEQ ID NO: 15188 - DNA, 811 bp, Diabrotica virgifera
  misc_feature (12)..(810): n is a, c, g, or t
aaaataataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 15189 - DNA, 617 bp, Diabrotica virgifera
  misc_feature (20)..(418): n is a, c, g, or t
  misc_feature (425)..(462): n is a, c, g, or t
  misc_feature (482)..(495): n is a, c, g, or t
  misc_feature (498)..(520): n is a, c, g, or t
  misc_feature (528)..(550): n is a, c, g, or t
  misc_feature (580)..(611): n is a, c, g, or t
ccctccccgcgcccgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15190 - DNA, 75 bp, Diabrotica virgifera
  misc_feature (55)..(72): n is a, c, g, or t
ccccgattaaatattacatttaactgtttgtatattattatatcaactattaagnnnnnnnnnnnnnnnnnngtg

SEQ ID NO: 15191 - DNA, 916 bp, Diabrotica virgifera
  misc_feature (818)..(818): n is a, c, g, or t
  misc_feature (845)..(845): n is a, c, g, or t
  misc_feature (870)..(870): n is a, c, g, or t
accgcgatgaaaaattaataaactaaatagtacttaaacaaaataatataagaatattttcattgttccaagttgttaagtgcgtgtttcttcatcaccactttatattctgcacatttgaacctttgataacaatgggtcctatttggagtgcctttggagctactaacacaggaaggacagatgatgctgactcaacgacgggtttaacctccagagatagatatttactaaaatcatcatgggctggtgtaatgaaaaacccgacagacaatggagtagctttacttcttttaatgttcaaaaaattccctgagacgaaaaccgtctttccttttaaagacataccaaacgaagaactagcaaacaatgttaggtttagggctcactgtaacagcgttgtttacgccattacttccatggtagatgctatagatgacccatccttacttgtaggcatactcgaaaaagttggccgggaccataagaggcgaagtattccccaaaaatattttgaaggacttcaagagacaattatcgaattgttttccacgttcatgaaacccaatgaaattaactcatggaacaaagctttgggtgttattcttaaagtagttgctgataatgttaaataattttagatgtgtcattggtgtatcattatcagacgttttacaattaaaaaatcgcaattattgcttatctatatgttcacaaaaatatagaatcgctatatttagattgttattttttatgcatctttagaaataaggttttatttttctatctttttattataaagggtcttatctatttanacttatttctaacattatttccaattnttttttgctctcttttgatttctgntaacgccatttcaaaatactttttatatagcgttttcacgtattat

SEQ ID NO: 15192 - DNA, 949 bp, Diabrotica virgifera
  misc_feature (21)..(39): n is a, c, g, or t
  misc_feature (805)..(805): n is a, c, g, or t
  misc_feature (834)..(834): n is a, c, g, or t
  misc_feature (844)..(845): n is a, c, g, or t
  misc_feature (902)..(902): n is a, c, g, or t
  misc_feature (908)..(909): n is a, c, g, or t
attaataacaataataattgnnnnnnnnnnnnnnnnnnnatacatatatcttctaaaaatgaattctcttaatacatttagtaagcgattgcagaggcctgttttctgtcatattaagaggtgcttatctgatgatacaaagcaacaaaatgatatatttaacatggaacaatcacgacaaagagaagctgttggacggatagaaaaaaattgaaataaactatgttggtgcaccaaaaaatgaaattctccttatgaacaaaaatgtatccacaccttatgattgtgcaaaacatatgggtgatactgttcgcaataagtcagtagtaggcttagtaaatggagaaactctttggcatctacataaatgtttaccaggagcctgtaaattagaacttcttcactatcactctccaaatccaacatttgttaataaaactttttggagaacttgtagctttctcatgggagcagtagcttcacaagcttttaaagataatgttagggtgtgcctacatagttttcccagtcctaatgtaaaatcaggtagttttgtatatgatattcaattggaattagaagactggaaacccacaacatcagaactaaaagttttatcaatagaaatgataaaaatgtgtcaacaagaacttccactagaatgtttggatgtatcaaaagatatagcatttgacattttcaaaaataatccccacaaaacaaaacagatacctagtatagctgaacacaatggcgggaaagttacattattcagagctggcactcatatagatatatctaaggngcccatgataccaaataccaatcatatgnggaagagttnnacatagccacgtaaatcaattggaaactgatctttgaggtggacccatttatagatntcaggnngtagctttacccaaccacttattttaaccattttgcgtat

SEQ ID NO: 15193 - DNA, 910 bp, Diabrotica virgifera
  misc_feature (868)..(868): n is a, c, g, or t
  misc_feature (880)..(880): n is a, c, g, or t
ggaaaatacttatacggaatgaaatataatttaaatatcttccagaatacgacatctaatatagggtatgcagtttaatataaacatattcaatgtcacatgtaggccaaaatcaactaaaataatacagcactctgtgtgattacattatagcaatgaaaattttattaatgacagtatctacataaccacgacataggtacttggttctaatttttaaagcttacaaattgggagatctttaaatgtttgaaaaatgaagggagatgggtgtgggaggccctaataagaatttaaagctgggtaagttttcttcgcgatggactggtgggatacggggtgttccatttgaaatacgtaacttgttacagcttgaatttgttaatggaacaatctcgtattttgaccgccctgtaagaagttttgttgcagtaagcatatgtttaagtgtgctgaatggtttactgttaggatccaggaaggagtttgttactgattcttagattcgtggatgtttgttttttttctggaacctcgcatttttgtaggagtcgaaatggatcggagcaccctgtatttaggtatagggggaacacttatgaaagtgtagcttgttttttggggtcaattcaatagtgtcatcagatatagggcattccatgggaagggatataactttgatataccattcttttttggagcaccctgtgtaattcacattatttttagattgtattattagtggctctgtatatttctgtgaagaatttttttttgaatgtcgggtggttttccgtgcagacaccgaggcgaatgggatgaaccaccctgtattcattattttttatttctcttacttactcttccnagtattcttccnatatttacattttcccattatttagtacac

SEQ ID NO: 15194 - DNA, 926 bp, Diabrotica virgifera
aaagtggtgaaattttctcttattggtgtaaaaaaggctgttaacgtttgaaaagtctgtcttttccagtcgaaaattttattggtgtcgaaaatgtatctcgaccgatgatagcctttcccgccaacatgacgtcggccgatacgatttccgtctgctcagaagcgtcgacgctcatagatggcagcgtcatttcgacggtacccgatcggcacgggttcctgggaggcgcgcagtactcccccgaacccaggaacggccctcccgccgaaacggtgctaagacgagagagaaaatggcttaagatgttatctcaatggagtttttatatggattcgaattataggaaggtgaaggaacgctgcaggaaaggaatccctcaatcgatgaggcctagagcatggctttatctgtgcggaggaaaagtattattagaaaagcaacccgataaatacgaagaatgcttacgagccgaagcggatcctaaatgtatagacgacataaagaaggatatacacagacagttccccttacatgagatgttttcttctgaagataaaccaggtcagcaagaattgtttaacgttctgaaggcatacacagtccatttccccgacataggctactgccaagcgcaggcgcccgtggcagcttttctgttgatgcacatgccttcaatccaagcgttttggtgtctagtgtcgatatctaacaaatacctcgaggattactactcgccttccatggatgtcgtgaaaagggacggactcattctagaaggtcttttgaagaaagtatgtcctccagtgtacaggcatttaaaaaaagttaacgcagccgatgttttattgcaccgaatggtttttatgtgcgtttactaggacgttaccgtgggatacacttttaagggtctgggatgtttttct

SEQ ID NO: 15195 - DNA, 110 bp, Diabrotica virgifera
  misc_feature (4)..(5): n is a, c, g, or t
  misc_feature (16)..(100): n is a, c, g, or t
aatnntattatataannnnnnnnnnnnnnnnnnnnnnnnnnnnnnnnnnnnnnnnnnnnnnnnnnnnnnnnnnnnnnnnnnnnnnnnnnnnnnnnnnnnncaattttttt

SEQ ID NO: 15196 - DNA, 102 bp, Diabrotica virgifera
  misc_feature (4)..(47): n is a, c, g, or t
  misc_feature (59)..(96): n is a, c, g, or t
ctannnnnnnnnnnnnnnnnnnnnnnnnnnnnnnnnnnnnnnnnnnngcttttttagcnnnnnnnnnnnnnnnnnnnnnnnnnnnnnnnnnnnnnnggatta

SEQ ID NO: 15197 - DNA, 132 bp, Diabrotica virgifera
gctctttccacgcgtccgggttaatggaattttaatactttgctgaaagtgatacagaggtaggtgtatacatcttttagcaaagtattaaaattccattaaacaaaaatactccaacatttataagtgagt

SEQ ID NO: 15198 - DNA, 400 bp, Diabrotica virgifera
  misc_feature (16)..(17): n is a, c, g, or t
  misc_feature (27)..(27): n is a, c, g, or t
  misc_feature (30)..(30): n is a, c, g, or t
  misc_feature (32)..(33): n is a, c, g, or t
  misc_feature (60)..(79): n is a, c, g, or t
  misc_feature (87)..(87): n is a, c, g, or t
  misc_feature (97)..(120): n is a, c, g, or t
  misc_feature (182)..(201): n is a, c, g, or t
tcccaccaaaggcgtnnggaaggttgntgntnntggggtagcccctttgagttaaagtgnnnnnnnnnnnnnnnnnnnngaataaanagatatatannnnnnnnnnnnnnnnnnnnnnnntggttatagaggatagaaggttaggtaggggtgaatgggaagtaatagtttttatatagtgnnnnnnnnnnnnnnnnnnnngggggtagttttaaaatgttgtgaatgggaaaaaattggtgttatagaatttaatagttttgaagaaaatgttattttatgaagttggtgtaatagagaagaggattgaattgatggaatttaaaaatagttgtgttgtttgaatggtgaatgggaggtgtgatgtagtggtgaattaagagtggtggttgtggtggta

SEQ ID NO: 15199 - DNA, 757 bp, Diabrotica virgifera
  misc_feature (28)..(45): n is a, c, g, or t
  misc_feature (50)..(69): n is a, c, g, or t
  misc_feature (116)..(132): n is a, c, g, or t
  misc_feature (323)..(337): n is a, c, g, or t
  misc_feature (535)..(535): n is a, c, g, or t
cattggtgaatcgcacacgtatttatcnnnnnnnnnnnnnnnnnnactgnnnnnnnnnnnnnnnnnnnngtttatagccccatatgtatatattagttttaatgaacctcttactnnnnnnnnnnnnnnnnncaacatgtataagaagaaattattgccaatgacctaaggatcagaacctctccaacatatgagtatttcacaaactcttaacatcttatcttatatgcagtctatatccatttatttcatgaaccccaataacacaattattgatgccaaacaacgtattgaacatcactatgatgacagtgctgatcagnnnnnnnnnnnnnnntggccatttgagaatacaaatgatgcttgtacacctgagaataaagaagcttactatgtggattacaaatccttctacccctaaccaactgattccatggaccgtacgaaaatgaatgacacagctaaagcatacttatgataaaatgtctccatcgctgtcttcacagaacctgcatatgacaatgactctcgacgncatagctaccatagatgctggaaccattgctggactccagttattacgtattattaacaaacccacacctgatgccatcgcctatgatttatactaaaagggtctaggatgaagaaacgtcctcattttcaatctgtgagttggtactattgatgtatcaatcttaccaattgaatatgatatcattgaatactaatcatctgctgcagacactcacttgat

SEQ ID NO: 15200 - DNA, 552 bp, Diabrotica virgifera
  misc_feature (70)..(87): n is a, c, g, or t
cattaacaaaacaactatgatatctgatttaacaaagaaaaaaggtcaacattctgagttatgtatgtcnnnnnnnnnnnnnnnnnnggtcgcttttttaaacattagcgaacaataccgaggacacttctcgaaatacaacggttttcgtgataaatatcaatacgttcacgtcgaacgttatagcataacttaaaaagtgtcattgttcttgaataaagatattcattttacctaaatgaataatgacactaccgacatcttacgaaagtaaacatctatgtgacacttttcctggtaaaaggattctctgagtcaatttaacaagataactggagttatggattttttgagttgtgtcacttttcttccgaacgagcgatatatgtttttttaattatatttgatgtacataggcgtaaccaggataatcctaaggggtgggggggttacaactactggaaagggtggggttacaactactggaaggtctccgaggggtatggtgttaagcgtatagagctcaaagtacatccatgggggggggggggg

SEQ ID NO: 15201 - DNA, 850 bp, Diabrotica virgifera
cggacgcgtgggtttctcagtaattccttaatgtctgtcaaaatagtttgaaaagtattgttttttgtttattctaacctttacaacaatataacatgatgatattttgatttatctgttaactttttttgataacaacaattattactagtatcacgtcatgtatcttacaaatgaaggcgactaacacactaaaaaacttattgtcccatatacattttaaagaacttttctgtaaagaaatgttactcgcttaactctatatctcaactatctaaaaaataaactaaatatatccattatcaatatatttataactaaacattttgataccattaatatgaactacttttaaggatgagcctaagaataaaattttattcgcactttatctctccaataaattcatgagtcatatttgtcatatcttggaatctgtcattatttatttctatataccattgttgttattctttatcaattttttatcagaatacaaatttaaattattccaatttctcaatgacgataatattagtattgcattattggatattcaataaaaatatatagactcaacaaaagaactccgggacctttctttcccctcttaataataaacatgtctttacgcattaatatataaagtctcacctgcccactcgtttcatatcaatggtcacggatttttcacagcgcttacgtacaacaaccatcagatcctttattcaaaactgtctagatggattaacctgaaaaaaaaaccgcttcattctattaatcagaaattctatttttaagataaaaaatctcaaatctttttcaaataagaaaaaaccccaacaacccc

SEQ ID NO: 15202 - DNA, 558 bp, Diabrotica virgifera
cttacagatcttgtatccaccagataataagattgactaaagtcatttcccagtgtctgaatcctgttaattggagagaatttgccatagttggtgtgatagtgttttatagaaaatatgggcatgtctctaagaattctagtgctacatctaaagttgacaagacttaataaatcaaaacagtcggtggtatggtcaagtagtttatagagaaaaattaaatcacatttagttctgtagtcttctaaggaactgatatttagccttgaccttaattccaccgaagacatgttctttaagtttaatctgtaagcacaaatccggagaaacttattttgaattttttcaagggtgtaaatatggttaaaataggatggggaccatactatagaaaaatgagactggattctactgacaaaagtagtatgtaagagtcgatatgcgagaacgaaataataggacttagtctattcgctgatattgctagatttgcagcctacccaagattatggagtacgtattccaggtggtagggctgtatgtgacttcatgttaatc

SEQ ID NO: 15203 - DNA, 726 bp, Diabrotica virgifera
  misc_feature (14)..(40): n is a, c, g, or t
  misc_feature (47)..(62): n is a, c, g, or t
  misc_feature (64)..(102): n is a, c, g, or t
  misc_feature (104)..(127): n is a, c, g, or t
  misc_feature (132)..(154): n is a, c, g, or t
  misc_feature (169)..(187): n is a, c, g, or t
  misc_feature (207)..(224): n is a, c, g, or t
  misc_feature (235)..(267): n is a, c, g, or t
  misc_feature (281)..(306): n is a, c, g, or t
  misc_feature (405)..(422): n is a, c, g, or t
  misc_feature (486)..(505): n is a, c, g, or t
gagaggttattcgnnnnnnnnnnnnnnnnnnnnnnnnnnngagaaannnnnnnnnnnnnnnngnnnnnnnnnnnnnnnnnnnnnnnnnnnnnnnnnnnnnnncnnnnnnnnnnnnnnnnnnnnnnnngaacnnnnnnnnnnnnnnnnnnnnnnntaaacacacattatnnnnnnnnnnnnnnnnnnngtaggacatgttattattcnnnnnnnnnnnnnnnnnngattattcttnnnnnnnnnnnnnnnnnnnnnnnnnnnnnnnnnctttacattaaagnnnnnnnnnnnnnnnnnnnnnnnnnncttgaagatttagaaacaatatataggtgtatttgcggaattcggcaacattattttctcccgcatattacaaacatgtctttttgaattacgtatccnnnnnnnnnnnnnnnnnnggtacttggaatggccgcggcattatgaccgcagctaaggaagcatactcattactatttttcnnnnnnnnnnnnnnnnnnnnatggatgaaaccaaaactgcctgtatttagtttacaaaggattttattgtttactactgaagattagattctgttaagggacgagaataccctatcgagccctataccattattaatcagctattttcggactagatttctttatatatgaactttattcaattgatctgattatacaatagaattatcgctgttgatattatgataatagttactaattt

SEQ ID NO: 15204 - DNA, 885 bp, Diabrotica virgifera
  misc_feature (118)..(136): n is a, c, g, or t
  misc_feature (841)..(841): n is a, c, g, or t
tcaaaatgatctaactttcgcaataatacatcactttcaacaatttattatttattgcaacattactctatgtatcaaccaatataattattgttgatatcaaaaacaatggcccaannnnnnnnnnnnnnnnnnntaggaagcagcctctctcaaatttgcaataacaaagaagtttggagttttaatgtttgtcctgttaccgtttcgaagaatcatgccgtattatttagacttccagtgaccttaaaagatgctccggagccgtacaaaaactcagagccccattattgggacaatgaccatgttagaatgccttattcagaaaaaagtttgtttccagttgaagaagacggcgtagaagttgttaagttacgctggaatttgattgaagaatctcttcttcggcctattcgtagtagcctagaactagaagctgccattcgcacatacaattcatctctacctgaatttacagctcttcacagttactttgaacaattagaggaagaagaaagcgacggatttttcaaagagttattaccaaaaatgatatcattggcattaaatttaccacaaatattaccagggaacttgcccttgttgacacaaaatcacaataaatctgtaagtttgtctcagttacaaattgcttcactactcgcaaatgctttcttctgcacttttccctggagaaaatctaccgcaaacacataccctggcgttaatttcatcacattattcagagctgatagacgaccaaatagactattttgcatttatgaaaagtttaagtgtatgtttaattatttccgaatggtaacttcctcagtgccagtgngtgttgtgaccttcgaaaggaaagtatgtccctaaactgaaata

SEQ ID NO: 15205 - DNA, 617 bp, Diabrotica virgifera
  misc_feature (21)..(56): n is a, c, g, or t
  misc_feature (63)..(100): n is a, c, g, or t
  misc_feature (106)..(118): n is a, c, g, or t
  misc_feature (120)..(158): n is a, c, g, or t
  misc_feature (238)..(272): n is a, c, g, or t
  misc_feature (275)..(292): n is a, c, g, or t
  misc_feature (297)..(316): n is a, c, g, or t
  misc_feature (336)..(354): n is a, c, g, or t
  misc_feature (384)..(437): n is a, c, g, or t
ccgggaattaaaacagttccnnnnnnnnnnnnnnnnnnnnnnnnnnnnnnnnnnnnacccaannnnnnnnnnnnnnnnnnnnnnnnnnnnnnnnnnnnnnccattnnnnnnnnnnnnncnnnnnnnnnnnnnnnnnnnnnnnnnnnnnnnnnnnnnnngggattttgggaaaagttcccaaaagacccgggggacccccaaggggggggggaaaaatcttcaaacccccccctcgggnnnnnnnnnnnnnnnnnnnnnnnnnnnnnnnnnnnggnnnnnnnnnnnnnnnnnntaaannnnnnnnnnnnnnnnnnnntttttccaaaacccttggannnnnnnnnnnnnnnnnnnccaatttgggacccccaaaacccccttcgnnnnnnnnnnnnnnnnnnnnnnnnnnnnnnnnnnnnnnnnnnnnnnnnnnnnnntactccctggggggttttaaccccaaacccagggggccctttgttttccccaggggaaaaaaaccccttaaaacggggaccttgcccaccacgagtttgtttcgggaaggggatgattttcaaacccccatctttcaaggcggacccaaggaaagggccgaggttttcaaatttgggggg

SEQ ID NO: 15206 - DNA, 542 bp, Diabrotica virgifera
ataagcgtaggagtacctgtcttaccctttccatcacataatcccttcgtcgttattagaaacgtattatggagtgatgccaatcgatgctgcaagcaccctatcgatctcttgcaccttgcggtcatggattataaatagtaataacatatttattctattccaacgtcaaaaagctatcaaggcagtagttttatttagaaataagtactttaactcattattttgtaatgacccgttaaccgtctttaagcatgtctcgggtctctcaataaatccaccaaatgcttctattccctatctatatataacacaccaggtttatatgcactaatattaaccaattatagggaggaccgccaagtagcacaattttattactagccctccgtatcacactaactacgatgaaaaatgttcatatactactcgacgacgctatatattttgatatattacgtattttcagtttttatagcgatcgtatcaaattataaactaatgcgatttcaggttcctagtgatgacactcttcgtgttaa

SEQ ID NO: 15207 - DNA, 946 bp, Diabrotica virgifera
  misc_feature (884)..(884): n is a, c, g, or t
  misc_feature (929)..(929): n is a, c, g, or t
aaattaatagaggaagtgaagagatatcccgaattgtatgacagttcccagagaaacttcaaaaataaagttctgaaggcggcgttgtggaaagacatcgctttcaaaatgaggaaacaaacggacgagtactcaattaaaacagtccgcatgagatggaaaagcctacgagactcttacgtcaaagaaattaaatacaaaatggcagtcagcagtggacatatccttaagcctcgtaaaaactggcgttacagcaactgtatgacatttcttgctccgttcctagcaataagttttccaaacaccagcaaaataaaagacgaatcctgcgaaataaaagaagaagttagtgatcaaagtgagccaaccgatccaacatatttcttgaatgtaagttcgggcccagaggaaaactacggccattttctaagtgctttattggactattctaataatcataattctactgtgttcaaaactgatgatggtgatatcgattcgttctttaagggtgttgctgatacagtaaagaagcttagtgctgtcaaccaggtttttatccagaggagtgtagtaaatatggtattggatattaaacttagagaagctcatgaaaaagcaaatattcttagagaatctggcgacaatgattaacttgcgtttagatcccgttgattaaacaaaatatctaaagctcctgtatcaatagcaagtgcgaatgggacctcttcgaattctccattaaataatagaaccggttccccgccagaagctaacatggctggtgcgacaccccaggctcaacctactaccggttctggccaaagtcccatggcagctttgatatcagtagcagacaatctaccacccggaagtcctcgatncactggaggaagtccgcctacaaaacgtgccccctcgtctgcatncagagggatctcacatt

SEQ ID NO: 15208 - DNA, 443 bp, Diabrotica virgifera
aagcaagcatccagatagaagagggcaacaaataaaccaggctgctcctgctggtccacctgctgctgatcctattggtccaggcgcccctgaaagatatccaatgtaatgtgttgaacctccaactttaccccatcatcaccccaaaactcaaacagacggaagcgcgctcaatacgaaacagctttaccatctcgtgaatgaaaactaatacatattctataatgccgctgataaccacactcccgccccgcgatttaccacagcaggtgtgaaatacccctgagcgttaccatacctatagtcgccattgccttatatcccacctctactccatatggataacctaccgaaaatccacgcacagatccaccatcccgaccccatcgagaacagaatgagtaccgtgacaagaactgcatctcgatctaatacgcgtaggt

SEQ ID NO: 15209 - DNA, 942 bp, Diabrotica virgifera
  misc_feature (315)..(330): n is a, c, g, or t
  misc_feature (332)..(346): n is a, c, g, or t
  misc_feature (577)..(596): n is a, c, g, or t
  misc_feature (792)..(792): n is a, c, g, or t
  misc_feature (849)..(867): n is a, c, g, or t
gaattactggcttgaaaccagaggaatacagtttactaggtttatttgtcttatagctgagtcacaatgctctgtgactttgaatgatgaagacttacagttgttcagtcaatgtaatatacaatttgaagcaatcaaaagaagcaacttactgaaaagtatttgtataggcgtaggggcaactgcagctgttattattatattgagtttcttgatatttttatactgccgaaaaaatagaaagcataaaaacaaacagaccaaaacactggagagtattggggatgattctcctttacggagaaaaactgttgnnnnnnnnnnnnnnnngnnnnnnnnnnnnnnngggctagttcagacacagcggattccgcgatatttcgaattgatgttcatactaatccgtgcggatcgtgtcacgcggattccgcttggatatccgctcgaatatccgcacggatataaatatagtacgcgaaaccacgaacatcgaattaaataactttatgcgcagacagaaaccacgtgaattttgccgtgtttgaacttgctcttggcggttatgcggttatttacnnnnnnnnnnnnnnnnnnnnggtactaatcgaccagaatatgaatggttatgggatacatggagactgacctagatctctaaaggtctcgtttgggctaaaatcacaatattacaattcatttagcaatatttctgaaagttcctaatatatcgttatacctattcacatcaaatccccacaactattcatatcctgttcgcaaaatagtctccanaagaataaaatttctttttctcgtttaaataattatgtagagtaatcagaagatcgnnnnnnnnnnnnnnnnnnngctctcttaaattacctctagactacagaagtaaaatattttttaagccataatcctattaggatcatctatgtg

SEQ ID NO: 15210 - DNA, 908 bp, Diabrotica virgifera
  misc_feature (342)..(375): n is a, c, g, or t
  misc_feature (617)..(642): n is a, c, g, or t
  misc_feature (805)..(805): n is a, c, g, or t
  misc_feature (825)..(827): n is a, c, g, or t
cgtgtttctgccgcgtatgtcattattggtctgatgactgtcttgtaaattttgcctttcatttcttttccgatatttttatttctccatattgtgtcattcaggcaacctacggctctgtttgctctattcacttgatcttccacttctatttcgagctttccgtaggtagctagtgaaaaatcatagttgttattttaatactgttgcactataacttatatgccaagtatttatatccatacctaacatccaatatggtgtagtaggatacctggcttttacccaggaggctcgggtttgatttccgctatcggaaatcctttttgtttttaaaattgnnnnnnnnnnnnnnnnnnnnnnnnnnnnnnnnnnctttttatattgtgtcctattaaataataaaaacttggtatgtattataaaaagttctttttctaaagtacaattattttaaatttatgacataaataacttccatctaaacaaaatgggatatcaaatcttttttatatgctaatagtgctgacgctcaaaatctttaggactaatgtgcaatatttttaagtaatatttcaatcgtgttcagagaaatttttgttgtcgctttcaaaatnnnnnnnnnnnnnnnnnnnnnnnnnngttatatatatcacttttgcattaagttttgtaaccttaatattatcttcgcaatttactaaaaatgtatgtattggtaaaaatttgtcaatattttataagatttatacagtagcgggaattgtgatattcgatttacaaaatttacagatttagacacaanaataatcattttattcatannnagggtagttttgagtcttatattgatgtcttctgagtctttgatgagaaataattttaagggagcaagtatgaatttagga

SEQ ID NO: 15211 - DNA, 893 bp, Diabrotica virgifera
cccacgcgtccggctctgcgtacttcgtagagcggggccggtcgtcggaagttgcagtggatgattgagagtgcttttcttttacttcattcaaaatgaactctcacatgcaacccattcaacccttattagagtctgccactgcttctgtgaaggctttttcgacgtataaattgaagaacattggagacagtatacaacttgccttactccttttttaattgagaaatcttgtttcgttgaaagtttgaaggcctactgttgctgtctggttctaacacagattggagatcattcttatgtccttggcatccgatcccaattctttctaggtacctattttatcatcagttcgtgtttttcattatcgaatgctttcctttaatcgctgaagcagataaaaacatcctttccttgatctaaacaattctgtattaatgtttgcataattaagatcgattctctcgtgccaaatccattttgaaaccaaactaactctagccacaaactaagttggtgaacatacttgttctctcaaaaacatctttgagcgctttcagcatttctttggtggtattggcatattttacaatgtctaaaatttagatgtctaacatttaatgtttatctgtaaaaatccacgaggaaaaagttttcctgtagttggctgtataccatgtatatcaaaaaacgataggatcctttataaaaggtgtatttgttgggatccctgtggagggctgcatcgcggagcagaactggttttcgatcggatgaccgatcatcatcagtgtttgcctagggtgtgtatagcctgataagatggggcagagttgtttaaagttttgactaccattttaaaagggttataggtgaattataagttacagggt

SEQ ID NO: 15212 - DNA, 528 bp, Diabrotica virgifera
  misc_feature (17)..(37): n is a, c, g, or t
  misc_feature (116)..(135): n is a, c, g, or t
  misc_feature (200)..(248): n is a, c, g, or t
  misc_feature (388)..(408): n is a, c, g, or t
aacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 15213 - DNA, 176 bp, Diabrotica virgifera
  misc_feature (7)..(74): n is a, c, g, or t
  misc_feature (105)..(167): n is a, c, g, or t
cacgctnnnnnnnnnnnnnnnnnnnnnnnnnnnnnnnnnnnnnnnnnnnnnnnnnnnnnnnnnnnnnnnnnnnncaagtcatttgatatataaattatttagtcnnnnnnnnnnnnnnnnnnnnnnnnnnnnnnnnnnnnnnnnnnnnnnnnnnnnnnnnnnnnnnncattttttt

SEQ ID NO: 15214 - DNA, 965 bp, Diabrotica virgifera
  misc_feature (192)..(214): n is a, c, g, or t
  misc_feature (784)..(810): n is a, c, g, or t
  misc_feature (859)..(859): n is a, c, g, or t
atatatatcacaagaaatatatatttacacataataatgttaataaaaacaaagtgttgaattattattaacattattatgtgtaaatatatatttcttgtgatatatatatttacacataataatgttaataaaaacaaagtgttgaattattattaacaaaaatacactgaatatcttaaagaacattannnnnnnnnnnnnnnnnnnnnnnatggtacaagtatgatgtagataacagaaaacaagtagcaaactcaagaaaactaaaattcattcaataaatatagatatatataataagctagatctgtttatcattaataatcgtattaacacaatacctattaataagcatccctttatttacaacgacttcatttaaatagctagcacaccaacatgttacccgaagtactgaatcccccaccaccgcaattcggagggggcggttcatcgtttctattatgtcgaaaattaaatgattttccagtttgttgattcttttccgcttcgaactcggactgatctttagttaggactatttgtaggctagtaggaagtattgttggtgggagattttctggttctttgatgtcctcccgactatagaaaagaatgtatgctgtttccggtggtttaagcctttttaaatcatccgtcgtcgctctacttacgaaactatcgttaaatttgtaccactgagccttatctttggctagagtgtaatagtgtcctgaatctacgctggagccacaatgtaccactgctgcgtataattcannnnnnnnnnnnnnnnnnnnnnnnnnntcatctaatacgacagtctgaagcagctttgtacgctggtgtgacgtangatcgtatctgaagtgcttaagtgtaaatattaatctcgggggtgcttcacaattcgtgtaatttttcacatccgtcagtctactacatatatcacagtggtactg

SEQ ID NO: 15215 - DNA, 807 bp, Diabrotica virgifera
  misc_feature (68)..(85): n is a, c, g, or t
  misc_feature (728)..(728): n is a, c, g, or t
agagcattgggtacgtgactgacaacgagatattgcgattatatctccattatctattggttgctttnnnnnnnnnnnnnnnnnntagcctcactatctgcgagatcaattcggacacatgattagtaagacatgaaaacaaatatgttgcgaccaactcctgctcttatgttactttctcaatcttgattacccgctgctcgattgaatttccattcgcttcattatgccgttagactcgtacgatttcctgctaccaggttacaacaggctgcatgaaatccctctgaacagtatgtatatcgggccatagcaaggcggattagtaaattatgatgataactcaaccatgaatatcttgaatcacatgtgttgctacagggtgatagtactgggttttcacctataaacattgaaagatgttaaacactcctcatactatgatcaaaggttatcacattcacagatacaacaactgaattaagactgattacaggactgaacatctacttcgactctcatggagtacactaccatctaggacatatattgcgaacaatagaaaaacaaccttacgctgtatcagactacgaacagcatatcaacttcgatatcgacctgattgagcaataaacctttcccattacatctatgatacaaggataccgcctatagtctatatgaattcgagattttgtaatcttaatttctgaacgagaccatacagnatactttattactggaatgcttgtatctacgatagaactgcgttaaacatccaggacattctcagtgatcctccactac

SEQ ID NO: 15216 - DNA, 913 bp, Diabrotica virgifera
  misc_feature (804)..(804): n is a, c, g, or t
  misc_feature (884)..(884): n is a, c, g, or t
aacaattcctgatgtcgcgcaacaatacatatcacaataaatctcgcaaataccatgattaaaacgtcaacggcccctgccgaagaaactgaacctagtgtcgtgttttctgaacgctttcctgaaaatttgtggtccaaatcatcaccattctggctccagacgtgccgaatttgcaacagcctcccaagtctaccattaacttcaatagatcaaatagtggaaaatcagatttcgacaccattcacaacttcaagcctaaaacaccctttttggaccatcaatcggtgtctttcgacagttattgtcggaggtcaactttgcaaaaaagttatttcgaacatgaaaaatataggtcgctcgagactttccacccaaaaagagactatgaagaggaaagtcaagagaggccttggatgtatacatttaagtctccgatagaaaatttagcctcctgtcacaacgagtatgatctaaaaggacgcttcaagtaccgattgaactacaaagatcgtaccgatttcctttcattgtctttatcaccacctggatctcgaaataattttacgtttcgggaatttccttctctctcgccttcgaaagacacaagtcttttagatttagatgatatacaaaaaattcgatatatagaaaatcgggaaagtcaagaggacgaaaaagactataatactggtgggtatatgcctatcaatattggagatattcttaaaggacaatacaaagtttgtagaaaacttggatggggacatttttctacagtttggttgtgtcagaatttattanatgatgggcctacttatgttgccctgaagatttgtaagagcgcgcaaatgttcaccgtagtggctcaagaatgaataaangtacttagagacacgaaactgatagaccc

SEQ ID NO: 15217 - DNA, 62 bp, Diabrotica virgifera
  misc_feature (2)..(49): n is a, c, g, or t
  misc_feature (61)..(61): n is a, c, g, or t
gnnnnnnnnnnnnnnnnnnnnnnnnnnnnnnnnnnnnnnnnnnnnnnnntataatttattnt

SEQ ID NO: 15218 - DNA, 134 bp, Diabrotica virgifera
  misc_feature (8)..(105): n is a, c, g, or t
  misc_feature (109)..(131): n is a, c, g, or t
gaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcnnnnnnnnnnnnnnnnnnnnnnnctt

SEQ ID NO: 15219 - DNA, 289 bp, Diabrotica virgifera
  misc_feature (2)..(259): n is a, c, g, or t
  misc_feature (261)..(261): n is a, c, g, or t
  misc_feature (269)..(287): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnantaattttnnnnnnnnnnnnnnnnnnntt

SEQ ID NO: 15220 - DNA, 681 bp, Diabrotica virgifera
agctaattaactgtgcctgtctgcctatatgcccaaagatgcaaccacccccgacaagatgagatgacatacgaaggagcccttcttgacaataacgaagcagcccccctgcgctgacatgaaatcgccctatatgacacacccctaagtacgccttcccctctatcccacatcacccaaagcctacaggcgacgtgcatgacatgccaaaaaaagagtcatacgtgggagaagaagaccttacttaacaagggatcgctctcgttactagtaccccatagaccccttgatcttcgccaactgtgatgacaagtacaagatctgccatcacaccttctaccctgaactccatgaagctcctaaaaaacaaccacacctccacactgaatatccactcaaccccaatatcctatatacaaaataacccaaatcatgtaagaacccctctgctctacccccatgcatgcatactaccaaaacgaactctcctagtactcttcagatctcacaactgccatcgtattagacacctaaaactccgccacccactccaccccaatcaacaaaagaaacgatcttcccccctccatccacctatggtactagtacactagagactatacaaactaccacattagaatccgtactgaaacaagctacacaatcaccaccaccacctat

SEQ ID NO: 15221 - DNA, 942 bp, Diabrotica virgifera
  misc_feature (50)..(104): n is a, c, g, or t
  misc_feature (120)..(141): n is a, c, g, or t
  misc_feature (296)..(330): n is a, c, g, or t
  misc_feature (484)..(503): n is a, c, g, or t
gtaaggatgtagtggcgtcatgtaagtcgtttgactatttctgtccaatnnnnnnnnnnnnnnnnnnnnnnnnnnnnnnnnnnnnnnnnnnnnnnnnnnnnnnnaccgttctaacggagnnnnnnnnnnnnnnnnnnnnnngatatccgacgacgatgtaaaactttcggagaaagttgaagcgttagaaaagtaggccgtgtactgaatgcattcacgttcaaccagtggcgcctcgtcaagaattatacattcgactaaataaacaatacttcaatttaactcaataatatgcnnnnnnnnnnnnnnnnnnnnnnnnnnnnnnnnnnnacttatacatttgtaatcctgtgcttaataaggaaatattcatgaaattaatttacaactttttatttttgaattacgacccgatctataaataagacactctacgttagggttatcataattgcaattatgtagagttcaaaacagttatgannnnnnnnnnnnnnnnnnnnatgtaataaaaacaaacttattttttatgataatatataaaacaatattacacaatgtttgtacagtacaatacagtacattttacacaatatgttggtgtctggctttacaatttgttccttgacatcgtctctgccttgaaattttccatgaagtgtccttttccatctaatcttactactactactatcggtttacagcgttctccgatggcttccaagaccaaaccgccatttttctctgtttaatcacagacctggagggatttctctttcctctagttctttttcaattccctctctccagtttcttctaggcagtcctcttttccttctcctttgtggtgtccacgccaaaaatctgttttgtatcctgtcatctggcatcctctgtacatggccatctaatcttacgtccataaaaacttttgataatgat

SEQ ID NO: 15222 - DNA, 922 bp, Diabrotica virgifera
  misc_feature (26)..(41): n is a, c, g, or t
  misc_feature (348)..(412): n is a, c, g, or t
  misc_feature (416)..(437): n is a, c, g, or t
  misc_feature (791)..(791): n is a, c, g, or t
  misc_feature (801)..(801): n is a, c, g, or t
ggtatcaaggaccttgtctctttttnnnnnnnnnnnnnnnngaaataggcatggtattcgtagggtgcagcaaaatagtgctaaaatttgttgattgacgaaggaccgacgtgttttttacacacttgtttaaccaaaaactcaagattccaccgaaaacctttatcgaacccagagggtggctaccgaagggtcgtaacttggacgaagctagcccagatactagcagccttcttttaccctacaactggaaaattttcctaaacggcgaaccgccttggcagtgctgacaaaaatctaggagatactaagtcacacctaccttaataaacctgtgtgaatctgagnnnnnnnnnnnnnnnnnnnnnnnnnnnnnnnnnnnnnnnnnnnnnnnnnnnnnnnnnnnnnnnnnaccnnnnnnnnnnnnnnnnnnnnnnccaagtgttgaagaacgcattcacgttttggatgaccaatcaaacgtatggacggtgatccgggaaatcgtaagcaacaacaatcaggaagatgccttttacgtcttggatgtcggagatatcgtcagaaaacatcaggaatggcgcgaaaaactacctcgagtcacgccgcactacggtaaacacttttggttatcgttttatgattttcttccagtgtccgtccatacgttatgactataatattggaaagagcattttgaatgtttttgatttacgattttcctggttacgaagagattgccgtcttaggctgtcaaatgcaacgacagccttacagttcttgaaaccctncacgccttgngaactaacttcgactgcgcttcaaagggcgagattaacaaagttctcagcatggggtgtggagcccgaaagaatcatcttttgcaatcctgcaaaccttccagtcatatcagacatgctgc

SEQ ID NO: 15223 - DNA, 97 bp, Diabrotica virgifera
  misc_feature (2)..(41): n is a, c, g, or t
  misc_feature (53)..(74): n is a, c, g, or t
cnnnnnnnnnnnnnnnnnnnnnnnnnnnnnnnnnnnnnnnnccccattttttnnnnnnnnnnnnnnnnnnnnnncttaagggaaaaaacgggaaatt

SEQ ID NO: 15224 - DNA, 194 bp, Diabrotica virgifera
  misc_feature (7)..(67): n is a, c, g, or t
gcctttnnnnnnnnnnnnnnnnnnnnnnnnnnnnnnnnnnnnnnnnnnnnnnnnnnnnnnnnnnnnnggagatacaaacaagtctatttttaaaaagtactaatatattcgacataacaaaatacgatggattttaacaaacaaataacgataagtactataacatttcaacaaatatatttaagtttctaagt

SEQ ID NO: 15225 - DNA, 750 bp, Diabrotica virgifera
  misc_feature (8)..(123): n is a, c, g, or t
  misc_feature (125)..(475): n is a, c, g, or t
  misc_feature (482)..(519): n is a, c, g, or t
  misc_feature (539)..(552): n is a, c, g, or t
  misc_feature (555)..(577): n is a, c, g, or t
  misc_feature (585)..(607): n is a, c, g, or t
  misc_feature (637)..(668): n is a, c, g, or t
  misc_feature (675)..(711): n is a, c, g, or t
cttctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattcaggattcgatcagcaatcctcctctcaagagatat

SEQ ID NO: 15226 - DNA, 768 bp, Diabrotica virgifera
  misc_feature (102)..(159): n is a, c, g, or t
  misc_feature (600)..(637): n is a, c, g, or t
gatgatgttaaaatggagctggtgcgttatagtgattattctattatctaacgtatatcatagtcagtgtattttctcgtctcgatcgtctagatctggatnnnnnnnnnnnnnnnnnnnnnnnnnnnnnnnnnnnnnnnnnnnnnnnnnnnnnnnnnntctgcgcagactccaggttcctattgtatacttcgtggagcactcatttgggatctaggtgaatacgcgtgattattacatttggatccactgtatcgcgtgtgtagcacatttggatttgaggcgcgagcttcaagttcctttggatcatccggatcttcatttgaatctcacggaacttcattcatatctggatcccgaggatcatgttcctctgtatcttttgtggtgcactaaaccggatcgcatggtgcatgtccatcacacggatcctctggatcttagggatggaaagacactgccaaacctggtacttcgagaccctttaccaattatcatcctgttactactacatttcaatctgtaactaatagagtgaaacatgattcaagaggatttcatacacctgcaccttctcacgcaggttattctactgaaccnnnnnnnnnnnnnnnnnnnnnnnnnnnnnnnnnnnnnnttacccctgctcctgaatctcaccatgccattacctaacagccagagtataatcccttctttacaacagcttctcatggaagtgccccgaatacgacactacatagtacattctttacttcttcatgtaat

SEQ ID NO: 15227 - DNA, 744 bp, Diabrotica virgifera
  misc_feature (15)..(15): n is a, c, g, or t
  misc_feature (20)..(414): n is a, c, g, or t
  misc_feature (421)..(458): n is a, c, g, or t
  misc_feature (478)..(491): n is a, c, g, or t
  misc_feature (494)..(516): n is a, c, g, or t
  misc_feature (524)..(546): n is a, c, g, or t
  misc_feature (576)..(607): n is a, c, g, or t
  misc_feature (614)..(650): n is a, c, g, or t
  misc_feature (695)..(711): n is a, c, g, or t
  misc_feature (714)..(742): n is a, c, g, or t
cttcccccgacgcgntccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattgaaaagaaggaccaaaaataggatagaaataaacaggaacgnnnnnnnnnnnnnnnnncannnnnnnnnnnnnnnnnnnnnnnnnnnnntc

SEQ ID NO: 15228 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15229 - DNA, 540 bp, Diabrotica virgifera
cacaaaggaaacgaaagactggaacttcatggagaaactattcaaattccaaacgtaactcccgaaaatggaggtatatacagatgcttggccgacaatggcttaaaggaacccagtcacaaacacatcgccataaacattgaacatgcaccaaagatctcaatttccaagtacctagtaacatctaacaaagaaagagatgccgaattagtgtgtactgtagatgcctacccagatgcaatggttttttggaaaaaaggtgaccaaatcatgaaaaacgacgagaccaggaaagttatgactaagagaagacagcacaccattgaaagcatttttgtcatcaccaatctgactgacgatgacttcggtacctatacttgtgtgggcaagaatagaaatggtaagaaagaagagaaagtgagcttagtgaaaactcctgcagttagggatttcatcaaacctgtaaatgtcagcaaagacgtacttttgtcgtggaaagttgaatcgaaatcgcccatatcagcacatgaaattcagtac

SEQ ID NO: 15230 - DNA, 917 bp, Diabrotica virgifera
  misc_feature (99)..(120): n is a, c, g, or t
  misc_feature (260)..(308): n is a, c, g, or t
  misc_feature (471)..(489): n is a, c, g, or t
  misc_feature (801)..(819): n is a, c, g, or t
  misc_feature (899)..(899): n is a, c, g, or t
gaatatctgtgttcagctggagggcatattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatccaaatcctggtaaaattaaaatatatacttcaggatgannnnnnnnnnnnnnnnnnngttgatagagaattggatcccctccaccagctggatcaaaaaatgatgtatttaaatttcgatctgttaataatattgtnaaagctccagctaaaact

SEQ ID NO: 15231 - DNA, 176 bp, Diabrotica virgifera
  misc_feature (5)..(5): n is a, c, g, or t
  misc_feature (11)..(165): n is a, c, g, or t
aattnttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttttttg

SEQ ID NO: 15232 - DNA, 899 bp, Diabrotica virgifera
  misc_feature (132)..(150): n is a, c, g, or t
  misc_feature (816)..(835): n is a, c, g, or t
acaataattaaatcattgaacggagttttgtggagtaccgagatagggaaacaaagaaaaatgagaatatacaataccataattaagagcacattggtatacggatccgaaatatggagaataaaggaacannnnnnnnnnnnnnnnnnnagaagctactgagatggacgccctaagaagagcaagtagaacatcgaaattggactgggttagaaatgaggaagtaaagcgaagaatgagtttacaggaaacggttgtagaatgcattgagaagaaacaattaacgtggtacggacatgttcagagaatgagggaggagagactgccaaagaaaattatgaaatggatacctacagaaaacaggaaaagaggaaggccaagaacgatacaaggagtaagacgatcaatgagtgtacggggattagaagatgaaaactgcaatgatagaagatattggcaacaaggcatcggacaacgtcggaggacgttttgaacccgaatttatataaaatatacaacattacagattgaatgatacttacctatacaatatttttctggaactggttttactataaaattaaaataaactaatcataataatacagatttatgttcataatgggcaagttatcatactgccgttaaaaaccctcttgggccattttagaaaaattgtgttaacaaaaacactcaaatattatgaattaatggcgcggaactcaaacatcatactgatatgaagtcacgaccaatgaatttgaatttttctctcgactttaatcgtctttaggggccaaacgaaagacaaaaacnnnnnnnnnnnnnnnnnnnngatatacctatattttaaattatggtctgttgtgatttatagcatttttttagaatttaaatgt

SEQ ID NO: 15233 - DNA, 950 bp, Diabrotica virgifera
  misc_feature (246)..(279): n is a, c, g, or t
  misc_feature (601)..(636): n is a, c, g, or t
  misc_feature (856)..(856): n is a, c, g, or t
  misc_feature (869)..(869): n is a, c, g, or t
  misc_feature (925)..(925): n is a, c, g, or t
acgggtcaaaatacataaaaaaaacttgggtaagtccatctaaataaaggagcccgtaacatcccctactggacacagcactaatttgtttgtaagccagagggttgtttataactttgaagcattgctggggctgcttgaataatccgatttcaattctgtaaagtgcattagatgggtggagtgcttatttatatgtaaaaaaattgacaaatatttgtatgttctagtttttgttgtgcaagnnnnnnnnnnnnnnnnnnnnnnnnnnnnnnnnnnagattgcaaaatctagtaagtcaattttaatgaaatttggtggacggttttagcacattacaaaaattttctaagcgaattgggaaggttccaagtgtaacctgagtgatggaaaaacattgaatagagacaggcttgttttgcccccttattttgtatttgttgctattttgcagcaagggtgttaaattaagacatttttggccagtcgtatctgatagaaagtttagttatctttgttttattcctatacctacgactttgttccaaaatgaatcgttttgaagttgtaagcaaagacagtagaagggaggcgaggttnnnnnnnnnnnnnnnnnnnnnnnnnnnnnnnnnnnntgttccgggcaaatttgagagggagcataagtcaattattattggcgaagttttcacctaactttatccgcaaagatccgaatgccacctctcacatccacctaaaaacagatccttcctggtctaagatgatattccactatttcaagttatttctgatttatacctattttatttagtcttgattttacaattattttaatttacctacactcactanaacattaattgantttatatatatttactattggcttttgacatacaattttaattcacactgattccnaaatctaaattatattctttatata

SEQ ID NO: 15234 - DNA, 929 bp, Diabrotica virgifera
  misc_feature (227)..(250): n is a, c, g, or t
  misc_feature (346)..(364): n is a, c, g, or t
  misc_feature (368)..(386): n is a, c, g, or t
  misc_feature (490)..(519): n is a, c, g, or t
  misc_feature (841)..(841): n is a, c, g, or t
  misc_feature (845)..(845): n is a, c, g, or t
  misc_feature (866)..(866): n is a, c, g, or t
  misc_feature (910)..(910): n is a, c, g, or t
gaaatgtcgagccagacaaaggttttatggtttttagatatgcaaaaaacatatttaagcaatgttaatatatgatgcaatgttaaaaaatatagttgtcgaccaaagatgtcatatcaatccatgtatgctttttaacacaatatctgtatgaaaaagttctagtgtgtgagatatatacctacattatagacgttttatttaccctgtataataggccgggccgnnnnnnnnnnnnnnnnnnnnnnnntacacggctagttaccaaatgttggaactagtatttatataatcctataccaaatttgggccggtttaaaagatatttaaccgggccccctggccnnnnnnnnnnnnnnnnnnngtcnnnnnnnnnnnnnnnnnnncttatacaaggctagttgctaaaagttggaactagtatttatataatcctataccaaatttgagacgatttagaaagtaattaaccgggcccccggccttcaannnnnnnnnnnnnnnnnnnnnnnnnnnnnngggctattaaaaaagcttgtgttgtcatattctattattaagcaaaagaaagataatacagtagacaggaaaaaatacttaagcttttaattgctgtttaagaagatctaaactaaatcttcaaatataatacagtgctggtcatcaacaaaaataaaattcggagaggagttaagggaaacagacggcaaatccagcatgggaataaaaatttaaacaagtcaatattgaagggcaacactttgatgaaaggaaagatcaaaccatggtcttcggaaaggcgagacgaattatgaaaactgaagaccatatagctttattngaangacccgtagtttatattttgngtacttggctcttagccagtctcgtgtaataaatattgtcgaangaatattagactacttaca

SEQ ID NO: 15235 - DNA, 747 bp, Diabrotica virgifera
  misc_feature (2)..(58): n is a, c, g, or t
  misc_feature (60)..(108): n is a, c, g, or t
  misc_feature (110)..(409): n is a, c, g, or t
  misc_feature (420)..(486): n is a, c, g, or t
  misc_feature (494)..(525): n is a, c, g, or t
  misc_feature (527)..(556): n is a, c, g, or t
  misc_feature (558)..(599): n is a, c, g, or t
  misc_feature (601)..(691): n is a, c, g, or t
  misc_feature (706)..(735): n is a, c, g, or t
gnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaatatgnnnnnnnnnnnnnnnnnnnnnnnnnnnnnnnnnnnnnnnnnnnnnnnnnnnnnnnnnnnnnnnnnnnattattcnnnnnnnnnnnnnnnnnnnnnnnnnnnnnnnngnnnnnnnnnnnnnnnnnnnnnnnnnnnnnncnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcattatgttttgnnnnnnnnnnnnnnnnnnnnnnnnnnnnnngagaaaaactga

SEQ ID NO: 15236 - DNA, 524 bp, Diabrotica virgifera
  misc_feature (6)..(74): n is a, c, g, or t
  misc_feature (76)..(211): n is a, c, g, or t
  misc_feature (213)..(242): n is a, c, g, or t
  misc_feature (252)..(316): n is a, c, g, or t
  misc_feature (352)..(371): n is a, c, g, or t
  misc_feature (397)..(415): n is a, c, g, or t
ctcacnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnggaaataaannnnnnnnnnnnnnnnnnnnnnnnnnnnnnnnnnnnnnnnnnnnnnnnnnnnnnnnnnnnnnnnnataggtaagaggaggagatgatccttttgttattcnnnnnnnnnnnnnnnnnnnntagaaaagaagtgtgaaataatgttnnnnnnnnnnnnnnnnnnntcttgtatgtagttatctatgacgactcttattgtaaaataatggtttactaatgatattgagttggattatttagatggagttagcgatgacaatataatgtattaag

SEQ ID NO: 15237 - DNA, 637 bp, Diabrotica virgifera
ccctcccaggcggccgggcgcagcgcggggaaagaagcaaccctttcggcgaaacaaaaaagcaacacggcaaccgaaaacgaacaaggagacaggcccgacgaaacggaagccgcccaagaagaggaagacgagggacccaaacagagagacaccccaaacgaccaagccgcccaccacagacagaggaaagcggcgaggcgcgcacacccacccaccccagccaagagaagaaggaaggcccgaaagagaagccaaacagagaccaccaaaagagaagcgaaaagccccaaagaaggacacaacccagaacgcaaaaaccacaaggaggaccagccaccggacgagaaaaaaaagaccaaagacagcggccaagacgaacccaccgaagaagaaactcaaagggcggcagacgaggaggcagaaaccccgcaagccaccaaagaaaaaaagaagcaagacgaggccaaaaaagaaacaagaactcccgacaaaaaaggccggcctgatttctggctcccaatattcaggaacgtcggactactggctgacaagagtcaacctcctgatgttccgatactcgaacatttgaatgatatcagcattatctgccagaaaggatacaatgaaattcatt

SEQ ID NO: 15238 - DNA, 192 bp, Diabrotica virgifera
  misc_feature (20)..(44): n is a, c, g, or t
  misc_feature (107)..(126): n is a, c, g, or t
  misc_feature (154)..(175): n is a, c, g, or t
atcataaagatattggaacnnnnnnnnnnnnnnnnnnnnnnnnngcaggaatggtaggaacttcattaagaattttagtacgagcagaattaggaaggcccggatcnnnnnnnnnnnnnnnnnnnntttataatgttattgttacagctcatgnnnnnnnnnnnnnnnnnnnnnnagttatacctatttata

SEQ ID NO: 15239 - DNA, 773 bp, Diabrotica virgifera
  misc_feature (111)..(129): n is a, c, g, or t
  misc_feature (688)..(705): n is a, c, g, or t
  misc_feature (718)..(747): n is a, c, g, or t
ggcacatgtgctttgttaacaattttcatataaaactaactatcgaataattaaaagaacagtaaacttaaaccggtagaagttcttcaaaataacaaaaatgaacagcgnnnnnnnnnnnnnnnnnnnatcacaagtccgtatcggaggaaagggcaccccaaggcgtaagaagaaggttgtacactctacacaagcaactgatgacaagaagttacaatcgtcccttaaaaaattatcagtaaacactattccaggcatcgaggaagtaaatatgatcaaagaagatggcacggtaattcactttaataatcctaagactcaggcatcattagcagcaaatactttcgctatcactggacatggagagaacaaacagatcactgatatgttaccgggtatattaagccagttgggacctgaaggtatcacccagctcaagagactagcaaacacagttgccaatgcaggtggcgttggaaagattgttcctgaagatgaggaagatgtgccagatctagtagaaaatttcgatgaggcatcaaaaggggaagtcactaaggaagaggaagaagaataaatgccaagaaatgtataagatctgttatatactgaatgaaatgtaacatcagattctcaataagaaataaaaacaagttataccaattatcatcaatagaatttgtannnnnnnnnnnnnnnnnnccaacaaatttcnnnnnnnnnnnnnnnnnnnnnnnnnnnnnngttgtactgtaatattgtcaagagaa

SEQ ID NO: 15240 - DNA, 388 bp, Diabrotica virgifera
aaccgaagcatcaatcttcttatgttacaagtatatctgacagtactcttgccctgtgggatgtcgagtatatcctaataataatataattgtgctatttctattgagcaagaaggatacaaaaccttctatttagttgatattaacacagcataatagtagcattgatatgttactggatttataacaccctataaatgtatgagcttcttaaccaatatagttatgcgcaatagatatataattaaaggcacataatatggaattattgatattaatgacgaataagcctagagatttacatttaatagaatttgtatttcatcatgcagtgacgattccgatatatcctatttatgcatccaaaatcttcatgattttcttaata

SEQ ID NO: 15241 - DNA, 953 bp, Diabrotica virgifera
  misc_feature (151)..(220): n is a, c, g, or t
  misc_feature (763)..(763): n is a, c, g, or t
agtgtatcttatataaagttagagttaaagttaatagtattaaataagtaatataacagaagatataataataataggtttatataggactttcatttgacaagtgattcaagaaagtcagaatcatcaaggaaaatcttgacaaaaatcnnnnnnnnnnnnnnnnnnnnnnnnnnnnnnnnnnnnnnnnnnnnnnnnnnnnnnnnnnnnnnnnnnnnnnaatttatctggagccagcaaaaaaattaacaaaggatgtattgttacagaagactcatgaagaaagaagaaaacggcaagagcaaagactcaaattacaaagtgctgaattgttgcagtctcacattcgtagttatattgtgagaaaacacaaaaaagatcaagaaaggcagctgtttgatgtaattgaaaacacagcaggaatacaagttgttttatcaaagttactgttcttttactacccaaaagaggatcgagaaaggcttcttcgcattgcggaaagacttctaaatattcaagcagacatgattcaacaaataaatgcggacaaatcgtttgcgtggttaattaaacggtttctgcttttatgtctgaaaaatattcaagataaccaagatagtatggtgttgatgaaatgcttgtatatttttacagttgatggccatacgttcagttatcttgtatccaaagattactatggccaccttaaaagactcttggagagtagcaacaactatttacaagaaaccattgttctcatccnaaaaccattcaaatttatgcatgaaagcgactatttaagtaatttggtgctctctgaattttgtaccaatttcttgataccatcgttgactcacaatgtgaagcatgttcttgttccgtacataagaaaccaaccaaaagaatttccatttggaaagataatccggtatctaaatacaggatttcatttt

SEQ ID NO: 15242 - DNA, 188 bp, Diabrotica virgifera
  misc_feature (6)..(63): n is a, c, g, or t
  misc_feature (65)..(186): n is a, c, g, or t
aaagcnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnga

SEQ ID NO: 15243 - DNA, 980 bp, Diabrotica virgifera
  misc_feature (899)..(899): n is a, c, g, or t
  misc_feature (923)..(923): n is a, c, g, or t
ataattttagatttggccgcgtagtcgcgccacttagcatagtttctgtgttcagtcagtgcacgatctgaatgcatgggaaaagtttttcttttttagttgtttttcattctgcatttgttttctagatggattttagtccaaataatcatatgcattgttagaaattataaatacacatgacatacaaattctatgtgttttaatgtaacatatttgaagttaaattcatctggcacttatagtacatattcaattaatgaatcttcttgttatatcctatcaaactgcgccatttttgagaaattctgtaattcgacatgaggtgttggtgtttgttagcaaaataatctgatttttcctatttaaaagactattagactattattgatggtacaacctgctatatgcgaagaaaagtctaaaatctgactgcacagagtaatgaaattacaccaatacagtaatgtataaagctccaatgttcgtcagcatcatgcagcctcttccgtccaccgctggacataagtcccatttttcgccacccttcactctgtttaatgtcgtattagtctctctacgtattttagtctcgctacgtgacctgcccaattcgacgacatcagtgatacctgtttttttcctcgggtcttgatttcttattttgtctttttttttgttacccgagaatcgatctttccaggcgcctttgtgccactcgcatttttagtgctgttgtttttgtgagcgtgagagtttctgctccgtataatatcattaataggaaaaacgcatcggtaaaatgttttccgtttaatagctatcgggatgttgcccttaaagatgtctcttagtgaaccacacgccacccaagcaagtgttattcgtcattgaatgangcgagatatatgtacttttctgtncataatttttggatggtaggtgttcgctggaaaataaaatttgtctaaaagtttata

SEQ ID NO: 15244 - DNA, 172 bp, Diabrotica virgifera
  misc_feature (18)..(54): n is a, c, g, or t
  misc_feature (78)..(90): n is a, c, g, or t
  misc_feature (93)..(108): n is a, c, g, or t
gtataattaatatatatnnnnnnnnnnnnnnnnnnnnnnnnnnnnnnnnnnnnncttatgaaaatcatgtctttgtgnnnnnnnnnnnnngannnnnnnnnnnnnnnnctctgttgaatgtgcgtggcattttgatcgtgatcgtgctgcataatcataatcatttttattg

SEQ ID NO: 15245 - DNA, 725 bp, Diabrotica virgifera
  misc_feature (158)..(178): n is a, c, g, or t
ctttatgttaattataaaataataaaggatttctcaataaatgttaatgattattttatttagtgatcggtaattcgtatcgccataaagtattttatttttattctggaacaatttctgttttgtaccttgcgtatcgcggattattaactagtacnnnnnnnnnnnnnnnnnnnnntatttagacctagctaaccatatcacaatttacatctgctatcttgaacatttaaactcctttttttctactgacatgttgttccattttaggtatctcttgttttttatgaaaatgattatacttatctatttgcaatatcttaatcattcgatatttttatattatgagtattagatatttctaggaatgaccccatgaagatcattttattcaactttaattattacataaaactcaacattcaagattttcatatttgactacaagctcttatatactacttatctatgattattatatattctttctgaatccttatattcgatatatatacttgtatgttattgtatccttaataagtgatggacactgattatcttcagagaatacgtgatacttaatgataaatatataaaactgagtaacaggcagacttccacatttatatcacctgcgtattagacacttgcctttttatatcatctatatggcctcacctgcacactgattactttctttgcacgcaaatgtttgactactgcta

SEQ ID NO: 15246 - DNA, 655 bp, Diabrotica virgifera
  misc_feature (2)..(58): n is a, c, g, or t
  misc_feature (60)..(226): n is a, c, g, or t
  misc_feature (228)..(535): n is a, c, g, or t
  misc_feature (543)..(601): n is a, c, g, or t
  misc_feature (606)..(626): n is a, c, g, or t
  misc_feature (628)..(642): n is a, c, g, or t
annnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattatnnnnnnnnnnnnnnnnnnnnnnnnnnnnnnnnnnnnnnnnnnnnnnnnnnnnnnnnnnnacgannnnnnnnnnnnnnnnnnnnnannnnnnnnnnnnnnncctttgattgaaa

SEQ ID NO: 15247 - DNA, 936 bp, Diabrotica virgifera
  misc_feature (54)..(54): n is a, c, g, or t
  misc_feature (349)..(367): n is a, c, g, or t
  misc_feature (856)..(856): n is a, c, g, or t
  misc_feature (904)..(935): n is a, c, g, or t
cctttcacgcgtccgtaaatttacctttatataataattgcctatattaatatntgtggagcaatatataatttttctgcttcaatgacagaaggtatgaaatatacgtcagtttgacaatttcaattgacaatatgaattatttaatatagttgcaatatttctccgcgactcgcgcagggtcgtttctcgtttcccttccaagtacttgcacaccgcgaattgtaccctcggagatcgctggaaaatttacactcaaaatatcaaaattcagtttggtaacactgtgtaaatgttgatagtaacatatcccttttaaggtaaacagaactttaatttagtccagacnnnnnnnnnnnnnnnnnnnccaaccatttttcaaccaaataatgtttcaaatatgatgtgcaaaataatttttaatagggttctgttaatgagcttgctttttttgtcattaaagtagaaaaaaactttaaatttcactcattaagtaaatcattatcgtcttaattattttaactgtactaatattcgtcgactaattctgaatgattaatgggttggtaaaacattttatctgtagcggcttctggaatgtcttaaaaatatcgaattgcattgataaaatgcgcatatcacgccgatcttcgcttcgatcataccttcctcgcttcctgacaacatctcttgaactggtttgatgctctaatgctctttctagcacattgtatcgagaaactaacatcaaactaagtgggggtaaaggcacggtaggggaggactatagtgtcgccgagcggtaaagaaaattatagttctacctttagtccactcgtcagagaataacctctanaaatcgtacgaacaataagctaattttgatgagaatatcaattttagnnnnnnnnnnnnnnnnnnnnnnnnnnnnnnnnt

SEQ ID NO: 15248 - DNA, 873 bp, Diabrotica virgifera
  misc_feature (514)..(531): n is a, c, g, or t
taatcattgtaatttatatcaacaattaaattcgaaaaatgttaaaggatttttaactgtaacaatgtatatttgcaacaactgtaacaaagtatatgtatttgttacgtttaaatttcaacatttgacattttaagattgacgttattaaaatgtaaataaacaatcggtattaattccgtaaaaggacttacggatatgaaatttccgtacggatgtgaaatatcaatgaattctgttttacttactgttagattgtacaatagatttttattgagagcacacgttctttttcatgtaattgccttaatagttatttatgatatgtgttaaaagtacacgtttaagggacgcttgtgaaagtttgcagaatgagcgatagcgagttctgcaatttacatgagtgccttaaaaatgttctttttaacacgcatatcatacaatattttttctacaaacgtaattacaggacaatatctacaaaaacttttacttgaacgtaactgacattccnnnnnnnnnnnnnnnnnncattacatcaaaattgtctataccagaggttctcaatctgtggtacatgtaccactggtggtacatatcattattggcggtggtacacaaaacacagaaaaaattaaaatagtagtacttagtaagtattgataatacaatttaaaaatataggtggtaccaaaaataataaaaataactctaggtacatcactcaaaaaggttgagaaccgctggtctatacggacaatacgaactgcagtgccttatatagctatttgtataacaggcgagggtagtgtaactgtatctcctgacaatgaagtttactagccgacgcgtacctgagggcagtatcattca

SEQ ID NO: 15249 - DNA, 890 bp, Diabrotica virgifera
gtcggcagcacaatcatggataaagcttattttgaagtgttttatttagtcagttattttttcgtagaaggaggttcagaatggcaaatgataattactcgatttttaccagtcggaatatgcttagtagccgttatgcagtggagagcattaaggaaaagacaaaaggaaggaattgcaagtaaatgggagatcaactgttattgtttacttcctttaagaacagtatctagatgttgggggtatatagccgaaacggtgatgtgctgcaactgacgaaaacgccagtgaagcgccaaaaatacgttttgtccttggtttttgttatgttcaggttattttctcttctttgtcactattttgtttttaatgctgacagtggaatacatattggattatttttgatattatagatgtaacactacccgaagtactgaggcctcccgtttacaaaatgtactccaacgcattcggtgttaacatcgcagaagctgaaaacgaggatttaacgtcttaccccagtctggcagatttttttgccagatctcttaaaagtggtgtaagacaagtcgacgagagtagctgtcttgtatcgccatgtgacgggacggtcctccatttcgactgttgatactgaacaagttgaacaggtaaaaggagtaacatattcactaaaagacttttttggtgagaatacaggaaaagttcaaaaatacaatggagactttaagacctctttattgcacaaaccacatgagggaaatgtattgtatcaatgcgttatctacttggcacctggagactatcacagatttcattcaccatcagaatggaaaccaacgcaccgcagacatttttcgggacaattactttctgtgaacccagcattg

SEQ ID NO: 15250 - DNA, 802 bp, Diabrotica virgifera
  misc_feature (191)..(213): n is a, c, g, or t
  misc_feature (529)..(555): n is a, c, g, or t
  misc_feature (676)..(693): n is a, c, g, or t
  misc_feature (770)..(791): n is a, c, g, or t
cggacgcgtgggttagaacatgtatttgacaagtatttatgtcgaaaacctacatgtttaactgttgtttagcaacttgcttctaaattcacgtgtttcaaactttttgtagccaatctttaatttttccctgtatgttactttcaagacacgttagtggagttttttcttgtctgcatctaagacatagnnnnnnnnnnnnnnnnnnnnnnngacaatgtcctgtcttttgtgctactcaccatgatatttccatatttgtttgcttttgaccacatcattgacgggtattctggcaaaacttgtgtttaaagtaaagattttttcgagttgctctgagaagttgccagaatgatgcaattttaatataacaatatagtactcctttaagagtagtttaagcaaaaatatatttgatctgtgagcctctaactgacatttgagttagtcaactgtttgaaccagttcgatctgtaagaaatgtatagattgaattttagataaatacatgtgaattacttacgaaaannnnnnnnnnnnnnnnnnnnnnnnnnnaaattgtttttaagtacttttatgttttttgtatgtggcgtttggtgatgtccaaacgcttaatctttataaagtatttgaaagatatcgaaaatatatttgattatctcttaatacgagnnnnnnnnnnnnnnnnnntacaatttacgtttcactattacattgtaaatatcatactttattctgacaagcacacaacctatactatgtaatcnnnnnnnnnnnnnnnnnnnnnngattctactcc

SEQ ID NO: 15251 - DNA, 203 bp, Diabrotica virgifera
  misc_feature (5)..(176): n is a, c, g, or t
  misc_feature (180)..(197): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgnnnnnnnnnnnnnnnnnncctttt

SEQ ID NO: 15252 - DNA, 959 bp, Diabrotica virgifera
  misc_feature (163)..(185): n is a, c, g, or t
  misc_feature (774)..(802): n is a, c, g, or t
  misc_feature (820)..(820): n is a, c, g, or t
  misc_feature (828)..(829): n is a, c, g, or t
  misc_feature (874)..(874): n is a, c, g, or t
agacaagtggttccaggaatggcacaacaaactcaaacacgctgtccagactgtcatggtgaaggtgaaataatcaaggaaaaagatagatgctctagttgcaagggcaaaaaagtatgtaacgagactaaaatactagaggttcatgttgataaaggcatgnnnnnnnnnnnnnnnnnnnnnnncagaggtgaaggcgaccaacagccagatgtagaacctggagatgtagtgattattttgcagcagaattagttacacactgcttagaacgctcttcacagatagtgaaagaaaagaatcttttctgtatagtaccgtagaaatgatacaagcctacagttttgatggattggatgtttcctggatgttcccaaaacccagtgacaaggatagatatattagcctgttggaccaaattaaacgtatttttaaacattatggatggctactgagtgttactgtatatcctaaattggaagacactggatacgatcctctaaaaatggatagcatagtagactgggtaactattaagacccttgatgtatataatactttgtttttcaaagttaaggacatccaactttacactggctacgattggaagaaagaagatttaaatttaaatagagaaacagttatcagaaactggcttgatgcaggtctatctaaaaataagttaattatgggaattgagttgtatccgatcaaatttacatatatgaacgccaataacacaaaagaaaaacccaaagtagtcatacatggatnnnnnnnnnnnnnnnnnnnnnnnnnnnnnctacttcagattaactgngctattannagggatataatacagaaaacgattatgtatatggacatcacctancgtatatggggttggttgaaacgacgcagatttatattttttcgaaaaggcgctatgcaaaggtaaaaaaaattggggggggttt

SEQ ID NO: 15253 - DNA, 919 bp, Diabrotica virgifera
  misc_feature (280)..(301): n is a, c, g, or t
gatccatggctctcctcccaaaaaaattctggatccgccactgataaaaaggcttctaatttgcggtcgactaagtacttcttacactatggtattacatagtacatattataaatatactacatatcgcaaattttacaataggtaaaaaataactagtattttgcttgtatattttgcttgagtaaaaattgaaaaacgaggtactacattcctacataggaaaatttaacagttccttttaatatctactattaaaaatgtggtctatctttaatannnnnnnnnnnnnnnnnnnnnngttgggtatacctatattgcctctctatattttcttttcaaccacgagcagacaaacgaagcagaggtcgaccaccgacacattggagcaacgatgtaaaaatcattgctgggaactggatggtggctgtccagaatcgagaaacatggagaagcttgaagggtgcctatgttcaacagtggacagtaacgcctacatgatgaaaatgatgattgtctcttcaacgtattattttttgcttttctcttaaacttctgatacattgcgaccatcagttggtcgattttctgtagtttagaaccctaatctacccgtttgggatagaacacttaaaattaagtttaaaacttcattatgtaatttatttccatttctctaaaagagccactatgagttgatctaaggtaagagcagcaagtacccagcttctaatacttctaataagcctgtccaaaacatgctccgatgggatttaaattaatttcatttaagtaggtattctttaacaatgctatcggcatgagggcgtgcattgtgatgcatcaggtgtgaagttttctccaataatgatgcatatgggacacattaaatgttgcagtattctatctatgattctat

SEQ ID NO: 15254 - DNA, 630 bp, Diabrotica virgifera
  misc_feature (399)..(417): n is a, c, g, or t
  misc_feature (436)..(594): n is a, c, g, or t
  misc_feature (598)..(621): n is a, c, g, or t
ccaatatacgtgggcaccaaacatgcactagtcgggattaacgagatgttggggccatccttggcattttggacgaactaaagttagagttgttgctgtttgtcctggacttaccaatactcccatcttagatggttttcaaacaagttgtcttagtcaggcgtatttgcctttaattgaaaagataaacgttgactttgggcatactatgcaaagtccagaacatcttgcgaaggaagcgatacatgtattagaaaaggcgccaaatggaaccgtctgggctatcgaaaacagccaatcaccaattgaatacactgttttagattacgctgataaattatccaataatattttacatgaatgaggtaattgatttgtaaatagaatttttaaatctgnnnnnnnnnnnnnnnnnnngagtataataaagagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnncgggggggg

SEQ ID NO: 15255 - DNA, 78 bp, Diabrotica virgifera
  misc_feature (4)..(44): n is a, c, g, or t
  misc_feature (56)..(56): n is a, c, g, or t
  misc_feature (60)..(60): n is a, c, g, or t
attnnnnnnnnnnnnnnnnnnnnnnnnnnnnnnnnnnnnnnnnntaattatttaanttgnggtgattaaataaagcga

SEQ ID NO: 15256 - DNA, 981 bp, Diabrotica virgifera
  misc_feature (372)..(389): n is a, c, g, or t
  misc_feature (777)..(777): n is a, c, g, or t
  misc_feature (815)..(815): n is a, c, g, or t
  misc_feature (838)..(838): n is a, c, g, or t
  misc_feature (886)..(886): n is a, c, g, or t
  misc_feature (894)..(894): n is a, c, g, or t
  misc_feature (903)..(904): n is a, c, g, or t
  misc_feature (958)..(958): n is a, c, g, or t
gattgggaaagtaggacagatccgcattaccatagtctaccggacatcatagggaaacctggcgaatttgaacgtccccgtaagatttgggcagcccttaatcgaattcgaacaaactgtggaagatgcgccgactccctccacagatggggtaaactcccctcgccttcttgtgactgcggcgctgcaagacagacgatcagtcacattgttcaggactgcccacgcagagcatacacaggcgaccctatagactttgtaatggcaaccgaagggtcaatcgaatatataaaaaaattggacatctgtttgtgatgcattgtataatgcataaatctaaatatattctgtgatatacttaagccatacgcnnnnnnnnnnnnnnnnnnccgcttcagttggtcgtgggaaggttttatttggtttctaatctttgttttgttctcagcagcaatgatcttcaagttggaaactcataggatgtacaggggcggcttcagttctagacgtttgtggcgaagtttgcccccttattttcagacccgaagtgggaggttggggggtgttttgcacatttatttacatcagaatgtggaaatgtgggtctttggaaggagagtggatcttggattgactttctacgattttttttcaaaaagttatagacttcgatatttgacccctttttatagacaggttatagtatctaagcaacacgttcaccaatcggactctataaagttttttatgttcggtattgaaagatcttcattttanagccttaataaatggatggggggttatttttacaatanataatgcaattgcaaagggcggncattttggacctttcgcaggctgttttgcagtagcggattggcgaggntaaacttngcatggctnncaattttaggtttttggatttactgcaattttctattttaaagtttttctctanaatgaatatcctaaagctgcatc

SEQ ID NO: 15257 - DNA, 945 bp, Diabrotica virgifera
  misc_feature (5)..(18): n is a, c, g, or t
  misc_feature (21)..(36): n is a, c, g, or t
  misc_feature (116)..(136): n is a, c, g, or t
gtagnnnnnnnnnnnnnntcnnnnnnnnnnnnnnnngtatatagtttacttcaaactattataaattttgttataaaaatataaattgaaattttgtcatgtgatgattattatgnnnnnnnnnnnnnnnnnnnnncaatctttggtattcatacttggctctctggaccgtttgtattttggtaaaaagaggtttgtaaattccctatgaagaatccacatagatatccgtaatttttgtggtaccagtctggacttcttcccatgatgtctactctggaaaagtgaataattctggattttccagacccacatggttcaataatatacctagaagccaatacaatgctgcgaaatgtatttggtattttcactgttccgggatattcgacggaagtttctactatagtacaagaatctctgggcagatctgacctccatgttcgaatcaaacagtattcttcgttcggtatgggtatgacactcttccttacgtattgaaatatttcagtctggttgtctaactgtgctataattttcgccgagattagatcgggatcccaaatgtgtcgttctctaaggattctaagcgtaacttctgaaggaggtgcgtccaattctgctgaaactttccagaatctcaagggcaacccatctgacactttcttgtagaaaatagaaatttttgaattttgacatagagagggtatttctttccaaccccgagatttttcttttgattcttttattaagttactatggcattctctcaaatattctctccagcctcccttatcgtctcctatgtctgtaaataattttggttttatctctttcatctcactcgagttgcactggttgataaaataatagggaatcttaaataatttatggaaatgttgaagacagaacatcaaacattcctgtgctgctttattttctgcc

SEQ ID NO: 15258 - DNA, 917 bp, Diabrotica virgifera
  misc_feature (67)..(889): n is a, c, g, or t
caaaaggtgacgataacatcgtcgtcatacactacacctaaccttcaaaatatcagattgggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaactatggagttcccagtactcta

SEQ ID NO: 15259 - DNA, 897 bp, Diabrotica virgifera
  misc_feature (472)..(486): n is a, c, g, or t
  misc_feature (625)..(649): n is a, c, g, or t
  misc_feature (826)..(826): n is a, c, g, or t
  misc_feature (883)..(883): n is a, c, g, or t
gaagtttttactcccattgtttttactttaatgtatttatactatcccattgtatttatacatggttaatctaaaatctgaaagaaccagaccaacaactattatcaaattatcattatcatttttatcgtatggtacttgtacttcattatatatttattactagtgtggctgataatttgatctgtgtttccggaagttcaattttgggcctcactccaattttctcctgcatccctgtagtgtagtggtcgagattgtcgagaaatggaatggtttgcttacagataacttacggagacaacttaaactcttacattttactttaccctgcattttaattatgactattcgtttaaattctatgactttacttacagtaggtccttgctacttggtgtctccgtgtgacggaggagtgtgttgttcatttaacccaactatacctaaattgtgatacccgttaagtacnnnnnnnnnnnnnnnacaccaaaatgagaagtagaggaggaatccgtgggaaatcatatgcgtctctgttctctcctcactctgggctgcagaagtacactattacctacttaccagaacaggcgctcatgttgtacaatcagtcttctccctnnnnnnnnnnnnnnnnnnnnnnnnngcatccaacgaaatcctcctggtccaaaatcaatgattgaatacaagaaactggaaagacatggaattgcgaggagatggatattagcgataaataataggtgtctaagaaggctgcatggtcagaaatggatttagattcaaatgaaatgcgaatcatcaacagattcagtgctanattcaaccaccagagtcgcagcaatcgacaacgcctcccaggtgcgctgcactccangaagctgaaaaccc

SEQ ID NO: 15260 - DNA, 1097 bp, Diabrotica virgifera
  misc_feature (322)..(325): n is a, c, g, or t
  misc_feature (328)..(348): n is a, c, g, or t
  misc_feature (361)..(379): n is a, c, g, or t
  misc_feature (386)..(407): n is a, c, g, or t
  misc_feature (454)..(494): n is a, c, g, or t
  misc_feature (496)..(599): n is a, c, g, or t
  misc_feature (612)..(689): n is a, c, g, or t
  misc_feature (701)..(740): n is a, c, g, or t
  misc_feature (763)..(835): n is a, c, g, or t
  misc_feature (845)..(870): n is a, c, g, or t
  misc_feature (873)..(1017): n is a, c, g, or t
  misc_feature (1022)..(1059): n is a, c, g, or t
  misc_feature (1068)..(1096): n is a, c, g, or t
cgcccaaggtgacgataacatcgtccgcatcccttcacctaaccgttcaattgtcggagtgggggcaacagggcgtgtccccgtgcctgataagggacacatcctttttttggtctagccgtgatgggcacagaaccttatttcttaacatgggagaagactggcacagcctacttgggtccgacgggttgatagatagaggaaaccattctcttgtcagtgatgctaaaggatagaatatactcgccactgaataaactgcggagtgggggtcaaaggtaaaatgtcccttatagcgtgttgagggaagaattggaatgcnnnnggnnnnnnnnnnnnnnnnnnnnncctccttatattnnnnnnnnnnnnnnnnnnnttgggtnnnnnnnnnnnnnnnnnnnnnnctgaggggggagaaaaccccccccgcgcgggggccccccgccgcggnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcccccctcnnnnnnnnnnnnnnnnnnnnnnnnnnnnnnnnnnnnnnnnnnnnnnnnnnnnnnnnnnnnnnnnnnnnnnnnnnnnnngccgccgcccgnnnnnnnnnnnnnnnnnnnnnnnnnnnnnnnnnnnnnnnntggggggagaaatttccctcccnnnnnnnnnnnnnnnnnnnnnnnnnnnnnnnnnnnnnnnnnnnnnnnnnnnnnnnnnnnnnnnnnnnnnnnnngggggggtgnnnnnnnnnnnnnnnnnnnnnnnnnngtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccnnnnnnnnnnnnnnnnnnnnnnnnnnnnnnnnnnnnnnacctccctnnnnnnnnnnnnnnnnnnnnnnnnnnnnng

SEQ ID NO: 15261 - DNA, 667 bp, Diabrotica virgifera
  misc_feature (9)..(82): n is a, c, g, or t
  misc_feature (87)..(156): n is a, c, g, or t
  misc_feature (190)..(261): n is a, c, g, or t
  misc_feature (279)..(279): n is a, c, g, or t
  misc_feature (283)..(395): n is a, c, g, or t
  misc_feature (405)..(475): n is a, c, g, or t
  misc_feature (483)..(499): n is a, c, g, or t
  misc_feature (501)..(528): n is a, c, g, or t
  misc_feature (537)..(598): n is a, c, g, or t
  misc_feature (612)..(632): n is a, c, g, or t
ccacacacnnnnnnnnnnnnnnnnnnnnnnnnnnnnnnnnnnnnnnnnnnnnnnnnnnnnnnnnnnnnnnnnnnnnnnnnnngggcnnnnnnnnnnnnnnnnnnnnnnnnnnnnnnnnnnnnnnnnnnnnnnnnnnnnnnnnnnnnnnnnnnnnnnggaagagaagcgaccccccccccctctcataacnnnnnnnnnnnnnnnnnnnnnnnnnnnnnnnnnnnnnnnnnnnnnnnnnnnnnnnnnnnnnnnnnnnnnnnntctcgcacacaaggcccnccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttgttgnnnnnnnnnnnnnnnnnnnnnnnnnnnnnnnnnnnnnnnnnnnnnnnnnnnnnnnnnnnnnnnnnnnnnnncccccctnnnnnnnnnnnnnnnnntnnnnnnnnnnnnnnnnnnnnnnnnnnnngtgtttttnnnnnnnnnnnnnnnnnnnnnnnnnnnnnnnnnnnnnnnnnnnnnnnnnnnnnnnnnnnnnnccaacaacaaaaannnnnnnnnnnnnnnnnnnnntgggggcgcggggcgggcgggggcgggcgggggcg

SEQ ID NO: 15262 - DNA, 874 bp, Diabrotica virgifera
  misc_feature (16)..(41): n is a, c, g, or t
  misc_feature (64)..(675): n is a, c, g, or t
  misc_feature (682)..(719): n is a, c, g, or t
  misc_feature (739)..(752): n is a, c, g, or t
  misc_feature (755)..(777): n is a, c, g, or t
  misc_feature (785)..(807): n is a, c, g, or t
  misc_feature (837)..(868): n is a, c, g, or t
cctctcaggcgtccgnnnnnnnnnnnnnnnnnnnnnnnnnncttctaatattatcatcattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15263 - DNA, 457 bp, Diabrotica virgifera
gtggataggtgtgccgtatatactttaaaggcaagaacagattataaaagatggttcgactggaaacaagatacgatcctattcacggatacgattacacttactggcccgattcaagatattttagagattaccgattttctccgccaatttcctgggccgatgactggagtcatagatcacgagtatggttcccgtactactggtcaacccgtaggctatttcaacattacatggactacaaaccttcagcaaggtctcttcgatctcaacgactacgaaacgacttgtatttctagactagattccgagaaaattgtatccgaagaaactagatgaaatattatttattatcataaaaactgaatctcgaagactacaaactaagaaaatattatttacatgcaatttatatttgtatatatgtattttttgaacttattttaaacaagtaatt

SEQ ID NO: 15264 - DNA, 829 bp, Diabrotica virgifera
  misc_feature (157)..(191): n is a, c, g, or t
  misc_feature (368)..(388): n is a, c, g, or t
  misc_feature (670)..(690): n is a, c, g, or t
atggaatcaacacagagaaagagtgacagaacatagaatagtacaaatagcaagagacaaatcgacaaatggaagacgatcattgggacgaccgaggaaaatatagcaaaacaacgtcaattgagactaaaaacggaagtaaaacaggcatgagccnnnnnnnnnnnnnnnnnnnnnnnnnnnnnnnnnnngtggctgatttatacatggtagctatgtcaatagtacagggagagtctaatatttcgcaaaacgaatattagattgaaaaactgaaaaacacgtgatcaatgtttttcaaaaatctatcgaatgagaccaaacacgactccccattccaccccctggagatggggcggagggggtgnnnnnnnnnnnnnnnnnnnnnggaaccccttttttattatagatttggattccttatacaaaaataagtttttccggacatttttttcgaattatttacagatggcgctataatcgaagaaaaaacgatttatccttatcccctaagaaaattatagaaagggtctgatatctccagaaatatacttctaaatgaaagacacgtgttcaatatttttaaaaaatctattgaattacaccaaacatgagtccaccctagcccctggggctggggtgtgggttgtgtttggtgtcattcaatagnnnnnnnnnnnnnnnnnnnnnagacattcaatagtacggagagagatagaatctcgcggctcgataacgcttacttattttattgatctctgcgaatgttcagataaaaaactaccggaatataggtacataataatcacatactataaaataaagaatg

SEQ ID NO: 15265 - DNA, 869 bp, Diabrotica virgifera
  misc_feature (615)..(633): n is a, c, g, or t
  misc_feature (769)..(788): n is a, c, g, or t
agtcaactaattgaactatattacaatatggaatcatcttttataaatagattcaaaaggcaaaatattttattggtttgtagtatatatacaatatttatttacaataaatcaatactggtttacattaaagagtggcccataataaaacacgtcaaatatattgtcactgatgaagcatcatactacatctaaaatattttgttggggcaatcctataatacccagtcatttcacacaattttataataaatttctattctttttcgataagtagttatattattagaacaagtacaattgaaattatgacatcgttttgtattaaattcagagtaaattatttatctacaatcataacggataaggtattttaatggtgtcggtaacattcaacaaatattctgtaggagtaaatatatattgtatcacaacctcaagtctctgacgcaaatattttatgacaaattatatgtaatctatttccagcttttcgtcaattttacgaaacatatgtacatctataacatagatggttcgttgaaattttatgcttagatatcaatacatcttaacacgtcacttgtcagctcatctacgcgtcataatatctannnnnnnnnnnnnnnnnnngaatgcaatttctaacaacatggtctcttttgtgttatcaacaagaaataatattaataacgatttatatgttcaatcggagtattacatgatacattaaagcaattataccatcgttaaacgaattttaaatgcnnnnnnnnnnnnnnnnnnnnttctacattttttgttgcgcattattaattaatttacatacaatgacgggtgtactaaatggacattgagtaaggacaaaa

SEQ ID NO: 15266 - DNA, 934 bp, Diabrotica virgifera
  misc_feature (112)..(129): n is a, c, g, or t
  misc_feature (355)..(379): n is a, c, g, or t
  misc_feature (525)..(546): n is a, c, g, or t
  misc_feature (573)..(593): n is a, c, g, or t
tggaaacccaaataaaagtttctgtaattgtgaacagtttttcatcaatctgcagactttgtcttcgatctgaagacttgttaccattatccactgtagacgccattcagannnnnnnnnnnnnnnnnnaaattgaggtaaatgatgatgatctactaccaaaaaaatatttgcaagatttgcatcagtcgtctgcaagaaattaaacaatttgtagacctatgtaaagctaataacacattgtttctcactgctgtacaaagctttggtgttaagaatgtatctggccaagtagacacaatagtagtaacagataatgtggaagtggaacagatttggataaaagaagaacctnnnnnnnnnnnnnnnnnnnnnnnnncagagttctttcagtgttgcatttgtaataatacttttaaagaaaaacaattacttattgctcataaaattaaagaacatagaattgtagtagaacatagctatactaaagaaattaacaaaaagatacataggacaaagaatgannnnnnnnnnnnnnnnnnnnnngtgaaaacaagtgacacagtaagttcnnnnnnnnnnnnnnnnnnnnnggtgccccctaagaaattgctgaaaagtagaaaagaatcagtagggccattcaaatgtacaatatgtgatcgttcgttgtcttcatacaaagtgctgcatgaacataagaaaatccatagtggagttagaccatacaagtgcccccattgtcaaaaagatttcttatgttcaactagccttaagattcatataagggtgcacacaggagaaacaccatacatttgtacaatttgcaataagggctttcgccgtgctggctatctaactgtacacaaaagaaatgcacattttgtcattgaaagacacacagccccagtgtccaatttgtaacaaattgctt

SEQ ID NO: 15267 - DNA, 60 bp, Diabrotica virgifera
  misc_feature (2)..(53): n is a, c, g, or t
tnnnnnnnnnnnnnnnnnnnnnnnnnnnnnnnnnnnnnnnnnnnnnnnnnnnnatttttt

SEQ ID NO: 15268 - DNA, 936 bp, Diabrotica virgifera
  misc_feature (732)..(748): n is a, c, g, or t
gaaactgattcaagaaaaacagcactcaacagaagatgaattcgaatatgaggataccatgtccagaccacatgcagttcctattgtagttgcagatgaagatcattcattcaaattagatgaagaggctctcaagaaagttttaatgaaagaagagctgaaagatcgatttgttgttgtggtatctgttgctggagctttccgtcatggcaaatcgtttttattggactttttccttagatatatgaatgcaaagtacgtcttgaaacaaaatacgtcagaatgggtaggcgcagaagaggctcctttagaaggattttcgtggaaaggtggatcagagagggatactacagggatccttatgtggtcagaagtttataccacagaacttagtacaggtgaaaagatagcagtaatattgctggatacacaaggaacatgggatagtaaaagcacagtaaaagaatgtgcgaccattttcgctctaagtactatgttaagttcggtacaaatttacaatttatcaagcaatatacaagaagatgatttacaacatctacagctttttactgaatatggaagactggcattagcagactcgggcacaactcccttccagcgacttcagttcttagtcagagattggcgtttcccttacgaagctccatatggtgctgttggcggccagcaaatattacagaaacgattagaagttaacgaacatcaacacannnnnnnnnnnnnnnnnagaagacacatcagttcttgttttactgagatagcttgctttctaatgcctcatccaggaataaaagttgcaacaagtccaacttttgatggtcgacttgcagaaatcgacggagaaattaaagataatctcaaaatcttagtccctatgttactagcgccagaaaatttagtacttaaaaaaattaa

SEQ ID NO: 15269 - DNA, 908 bp, Diabrotica virgifera
caacaacaaatgactcatcattccaaacgaagtcaaggaccttatcagagacagaaacaacgcaagaagggcttaccaaaggacaagaagacaagactacaaggactacagcgacgaactgtcagcagaaataaggacaagactgaccagcatcaacgagaacaaatggcacaacatcatcagaaaagccgaagaaaatcaaggaaacgtctggaaaatgatgaaggccagaaaaagaggaaaacagaaaataccacctatcacggatgaggaaggaacacactacgaggcccaaagaaaagcatgcaattgcaagaaaactggaagccacacacaggcaaaatcaacacatgtcggaccaacagaccatagacgaagtaaacagggcctacaacaggatttcagaaagaaatcaattcgtgatagaagaagaagaccagctacacccatcagaagtccacaggatcatcaagaaactcaaaggatccagagctccaggacaggaagacatccacaacatcgtcctcaaggaactaccgaagaagatgatagtacaactgtactacattttcaggtattgtcttgagaaagctcatttcccaaacaactggaaacatgcaaagacgatacctctcctgaagccaagaaaagatggaagaagaccagaaagctacagaccaatctcgctgctggaacccatgggaaaaatcctagagaaaatcatattcaagaggctcaacaaacacgctgaaagaagaaacatcatccaggaagaccaattcggattcagaaaaggaaggaactgtgaactacaactcgcaaagagtgtcagcgacaccaaaatccggttcaacagaaaacagaaaacagggatggcaatactggacatagaaaaggcatatgacacg

SEQ ID NO: 15270 - DNA, 870 bp, Diabrotica virgifera
  misc_feature (784)..(811): n is a, c, g, or t
gtatttacattcctatgagaaagatatgaaatcggatcctgagaaggaggctacttatatataccttatctatggaaggaggtatagtatttgttaaattttttgccacatttacaaagtaattgttcagggtctcaggagaagtcgggattgtggtgggagaagaagtcttatctctcagttcatttacgatagaccacgtttccttatcaacattacctgatttagccagcctcgcattgtaataaatttccttggcgacctttatggctttatggtaaattttcttgtaaagcctaacgtaatcatggaaggatatgttgtccgagaatttttttaggtacgataatgagcgcatgttctttgcagatatacgtagacctctagttgaccagggtttacgatgttttagttttgatgggcctaagaggaaaggattcgtatgccagaccagacaacaactttatgaatctagaaaactcgatgtcgacatcaacagagcggaagtcccagtcagttgtttgacataggtgtttaaatgttagaaaattttgttctccaaagacacggaacaattttcgttgtgtgttttcactactattttttgattttaaccaaaatgtagtcaatactgcttcatgatcagagaaacctgagttgaaaacagtacagtcagtagaatttggagctaaagacgatataactccatggaagcaatggaagcattgcttccctaggtttccgtagcaatactgtaccaactgagtaaaactgagaaagatannnnnnnnnnnnnnnnnnnnnnnnnnnncgcgtaagcagccttttaaagtgcatacgagaatattcgctagtacgaccagcgagcaa

SEQ ID NO: 15271 - DNA, 802 bp, Diabrotica virgifera
caaatatctaacatgacatcagatggaacaaacaattgatactacaaacgacagataagataaaatttttatgtaagccaaatcagcattctaagtaaaatcaacagaatagctcacagctatgtacaagtgaaaataaattgttcaaatattttgattttaaaatagtgtgtacttagtgaaacaatttgcaaatattacaatggcaaggataaaacgaggatttgtttttggtgcttctgttgtgtcgggaattggtgttttatttacgattatttcgcttgcgactgaacaatgggtttattcggatcaagcgcagctggctgtcaacgcttcaacagatcggtatttctccaagatcaagtatggcttatttcaagggacgctaagaacgggcgttacttacaacacggtccaaatatcaatgacatgtattgcaaaaaacaacatttgtgctatgttatgtgcaaagaacagcacagagcgatttaacattttagaggacctttacgataataagggaatccatatccagaacgacaatgaatgtccgatggtagcaagtagtaccaaattacacaatgaatttgcagtattaagatctacacaagcaagtgccaataaggacagaaaatttatcaacttcggagtatggatctcgacaatatttttcttatcagtgtccatcttatttggattactagcagctggtctatcattgtacaacactgtgtcccatccaatacaaatatacctcagtatatatggaataattatatttaacggaattgcattaggcact

SEQ ID NO: 15272 - DNA, 845 bp, Diabrotica virgifera
  misc_feature (9)..(9): n is a, c, g, or t
  misc_feature (13)..(600): n is a, c, g, or t
  misc_feature (607)..(644): n is a, c, g, or t
  misc_feature (664)..(677): n is a, c, g, or t
  misc_feature (680)..(702): n is a, c, g, or t
  misc_feature (710)..(732): n is a, c, g, or t
  misc_feature (770)..(793): n is a, c, g, or t
  misc_feature (803)..(840): n is a, c, g, or t
cggacgcgngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatctcnnnnnnnnnnnnnnnnnnnnnnnngaaaggaccnnnnnnnnnnnnnnnnnnnnnnnnnnnnnnnnnnnnnncgaac

SEQ ID NO: 15273 - DNA, 913 bp, Diabrotica virgifera
  misc_feature (154)..(182): n is a, c, g, or t
  misc_feature (423)..(439): n is a, c, g, or t
  misc_feature (581)..(581): n is a, c, g, or t
  misc_feature (828)..(828): n is a, c, g, or t
  misc_feature (875)..(875): n is a, c, g, or t
  misc_feature (883)..(883): n is a, c, g, or t
aacacgtctaataagaagtgctggtgtcttctgcgttaatatgtttcttattgccatatttctgttgcatatttaaagaaactcaattttgactgctaactgattacacaggccaacaaaattttaccaattttcggactcggagataagaatnnnnnnnnnnnnnnnnnnnnnnnnnnnnngctttgaattctaatctgagctcctcattgccaaagtggttctggtttctgagataccctaacaagtgcaaaagtttttggccatttttgaggttatgtaacatcttaatataaccataggcatataatacatggactgcgcgctgcagtctgaaacttcccccagtgcggcggagaggggtgtttgtgtttagggtgggcatttctttctgatcgacggggtttatccaataacgttggnnnnnnnnnnnnnnnnnctttcccactaccgtcgatttgataaatcccgtggattagagagaggtgcctgccctgggtataagcacttttctctgtcgcactgggggagaaaattttttagattacagcgcgcagattgtaacattgtaatataactgngtatttgtaagtgcccgaaaaaaaatgagaagcgatgaaaagccctataaaatcaattacactgatgtgaaccacttgaccttgtcgacatatcaatctgtacattcggtaatcagaaatatcacttatttaatgtaatttatataaactattcaagcaatactttattttatgataattaacattatcatgttaaacaagtgtgtagattctcagtaaagtattttccttttatatctaaacttgnatttgtatttcaaacttttcttattttgtcttttaattggtcacaancttctttnatttaaaattgtttattattataaaatata

SEQ ID NO: 15274 - DNA, 639 bp, Diabrotica virgifera
  misc_feature (245)..(287): n is a, c, g, or t
  misc_feature (552)..(566): n is a, c, g, or t
gccgtggacttagcgggctgcgggatgatcgtgatctcgtcattgatcttcagaggtttcaactgatctgcagccgacggcttgggagagctgttggaagttgtcgaagaggtcgtggagccgcccttcttgtccatgactcgcttggcgacgacgctgtgggcggaatagacgtggttctcgaattgtttgtacattccgaaggtggccgtgcacactgtgcatttgtaggacaggtgcgcggnnnnnnnnnnnnnnnnnnnnnnnnnnnnnnnnnnnnnnnnnnntttccattggtagactcttccacaaacaggacaccttcctgaatctttgctcttgttggcagcatcctgcatgctggaggtgactaatccatgagagcctaataaatgcctttccaacccttgatctgtgaagaacctaaattgacacttttgacaatttaatggcggcctgttatatatcatcttgggatgaatcttaatcttgtgtatccattgcatgtgatttctaagctgttcaaggtccttgatgtacccatcgcagatnnnnnnnnnnnnnnncgagttcttggaggatgtatcccctggtttggcgccgcccgaagatccaggtgcggctgcggcagcagatggg

SEQ ID NO: 15275 - DNA, 279 bp, Diabrotica virgifera
  misc_feature (73)..(92): n is a, c, g, or t
  misc_feature (200)..(222): n is a, c, g, or t
  misc_feature (225)..(239): n is a, c, g, or t
ccttctggggcgtccgcccttgtataatgtcatgcaagcaacttttttttgttaccggaataatacaaaacgnnnnnnnnnnnnnnnnnnnnctacaaacgggtgcaggaatctttaaaataggagcacaaatgataaagttatggattgtcaaacttaatcaaacattttgggtgacgcaattttgtgccggtgagtgnnnnnnnnnnnnnnnnnnnnnnngcnnnnnnnnnnnnnnngtttaaaaacttatgccatggctgatatggaaaatttcca

SEQ ID NO: 15276 - DNA, 910 bp, Diabrotica virgifera
  misc_feature (231)..(249): n is a, c, g, or t
  misc_feature (566)..(586): n is a, c, g, or t
  misc_feature (882)..(908): n is a, c, g, or t
ccttctgcggcgtccgtcttcatcttctaatctagaacaatatgttacaagcctgttcaatgcagaaggatggagaaagtattctaacttattaggcctagccctggattggttaggatctttgtctgtatcgtcaaccaatacagatcaatttgaatataaactttcaaatttgatacataaattaagagtcattacctatgcttgtaattaggaattattgtactctcnnnnnnnnnnnnnnnnnnnccagtagtgattgatcatattggaaggtaaagtacaggacaaaagattagtaagaagacgctcgaactcgtggctgaaggacctgacaaaacggtttgaccgctcatccgcagaaatttttcttgcagcagttttcaaagctacagttgccatttggatcgccaatctttgaaaggagacggcgcaataagaagaaatgattgatataacctcaacaaacagtgacttactttactttcattatcaacaaaacaaatgttttgtagagaaagcaaactagtgctgctgctagtggtgaattaatatactaatgattnnnnnnnnnnnnnnnnnnnnnagtactatgttaagggttccatttacgttgagataggtatcgatacatgtatcgcgacaagttgcgatacacgtatcgtgagatttgtgtctgtttcacgacagagatgcatgcgacgatagagttgtagacgacgaagattgagagttgtgatactgatacagcgatactgagacagccaaatacacgatgagatttgtatcacgatactggtacttgcgacatatatcttaaaattctaaaatttttaatctttctacacaagtatcttataattagaaaattgtttataatannnnnnnnnnnnnnnnnnnnnnnnnnntc

SEQ ID NO: 15277 - DNA, 895 bp, Diabrotica virgifera
  misc_feature (15)..(16): n is a, c, g, or t
  misc_feature (18)..(18): n is a, c, g, or t
  misc_feature (24)..(25): n is a, c, g, or t
  misc_feature (28)..(28): n is a, c, g, or t
  misc_feature (32)..(33): n is a, c, g, or t
  misc_feature (55)..(55): n is a, c, g, or t
  misc_feature (57)..(57): n is a, c, g, or t
  misc_feature (71)..(72): n is a, c, g, or t
  misc_feature (81)..(82): n is a, c, g, or t
  misc_feature (85)..(85): n is a, c, g, or t
  misc_feature (91)..(91): n is a, c, g, or t
  misc_feature (94)..(94): n is a, c, g, or t
  misc_feature (108)..(108): n is a, c, g, or t
  misc_feature (112)..(112): n is a, c, g, or t
  misc_feature (123)..(123): n is a, c, g, or t
  misc_feature (127)..(128): n is a, c, g, or t
  misc_feature (133)..(133): n is a, c, g, or t
  misc_feature (137)..(139): n is a, c, g, or t
  misc_feature (144)..(145): n is a, c, g, or t
  misc_feature (155)..(156): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (169)..(169): n is a, c, g, or t
  misc_feature (174)..(174): n is a, c, g, or t
  misc_feature (177)..(178): n is a, c, g, or t
  misc_feature (181)..(181): n is a, c, g, or t
  misc_feature (189)..(190): n is a, c, g, or t
  misc_feature (197)..(197): n is a, c, g, or t
  misc_feature (202)..(202): n is a, c, g, or t
  misc_feature (205)..(205): n is a, c, g, or t
  misc_feature (207)..(207): n is a, c, g, or t
  misc_feature (214)..(214): n is a, c, g, or t
  misc_feature (217)..(217): n is a, c, g, or t
  misc_feature (223)..(223): n is a, c, g, or t
  misc_feature (228)..(228): n is a, c, g, or t
  misc_feature (234)..(236): n is a, c, g, or t
  misc_feature (251)..(252): n is a, c, g, or t
  misc_feature (255)..(255): n is a, c, g, or t
  misc_feature (277)..(278): n is a, c, g, or t
  misc_feature (287)..(287): n is a, c, g, or t
  misc_feature (290)..(290): n is a, c, g, or t
  misc_feature (299)..(301): n is a, c, g, or t
  misc_feature (314)..(315): n is a, c, g, or t
  misc_feature (318)..(318): n is a, c, g, or t
  misc_feature (328)..(328): n is a, c, g, or t
  misc_feature (331)..(331): n is a, c, g, or t
  misc_feature (333)..(333): n is a, c, g, or t
  misc_feature (342)..(343): n is a, c, g, or t
  misc_feature (352)..(352): n is a, c, g, or t
  misc_feature (354)..(354): n is a, c, g, or t
  misc_feature (359)..(359): n is a, c, g, or t
  misc_feature (364)..(364): n is a, c, g, or t
  misc_feature (366)..(366): n is a, c, g, or t
  misc_feature (368)..(369): n is a, c, g, or t
  misc_feature (372)..(372): n is a, c, g, or t
  misc_feature (375)..(375): n is a, c, g, or t
  misc_feature (379)..(379): n is a, c, g, or t
  misc_feature (381)..(381): n is a, c, g, or t
  misc_feature (385)..(385): n is a, c, g, or t
  misc_feature (391)..(391): n is a, c, g, or t
  misc_feature (404)..(404): n is a, c, g, or t
  misc_feature (407)..(407): n is a, c, g, or t
  misc_feature (424)..(424): n is a, c, g, or t
  misc_feature (431)..(431): n is a, c, g, or t
  misc_feature (433)..(433): n is a, c, g, or t
  misc_feature (438)..(438): n is a, c, g, or t
  misc_feature (448)..(449): n is a, c, g, or t
  misc_feature (453)..(454): n is a, c, g, or t
  misc_feature (466)..(466): n is a, c, g, or t
  misc_feature (478)..(478): n is a, c, g, or t
  misc_feature (481)..(481): n is a, c, g, or t
  misc_feature (483)..(484): n is a, c, g, or t
  misc_feature (495)..(495): n is a, c, g, or t
  misc_feature (505)..(505): n is a, c, g, or t
  misc_feature (508)..(508): n is a, c, g, or t
  misc_feature (510)..(510): n is a, c, g, or t
  misc_feature (514)..(516): n is a, c, g, or t
  misc_feature (532)..(532): n is a, c, g, or t
  misc_feature (547)..(547): n is a, c, g, or t
  misc_feature (552)..(552): n is a, c, g, or t
  misc_feature (556)..(556): n is a, c, g, or t
  misc_feature (571)..(571): n is a, c, g, or t
  misc_feature (574)..(574): n is a, c, g, or t
  misc_feature (581)..(581): n is a, c, g, or t
  misc_feature (583)..(583): n is a, c, g, or t
  misc_feature (590)..(590): n is a, c, g, or t
  misc_feature (595)..(595): n is a, c, g, or t
  misc_feature (606)..(606): n is a, c, g, or t
  misc_feature (629)..(629): n is a, c, g, or t
  misc_feature (638)..(638): n is a, c, g, or t
  misc_feature (645)..(645): n is a, c, g, or t
  misc_feature (658)..(658): n is a, c, g, or t
  misc_feature (663)..(663): n is a, c, g, or t
  misc_feature (673)..(673): n is a, c, g, or t
  misc_feature (684)..(684): n is a, c, g, or t
  misc_feature (727)..(728): n is a, c, g, or t
  misc_feature (732)..(732): n is a, c, g, or t
  misc_feature (737)..(737): n is a, c, g, or t
  misc_feature (744)..(744): n is a, c, g, or t
  misc_feature (765)..(783): n is a, c, g, or t
  misc_feature (800)..(800): n is a, c, g, or t
  misc_feature (805)..(805): n is a, c, g, or t
  misc_feature (837)..(837): n is a, c, g, or t
  misc_feature (845)..(845): n is a, c, g, or t
  misc_feature (864)..(893): n is a, c, g, or t
ctccacaaacgcgtnngnaaaagnnagnaaannagggagtgtcctttaaaaaaanangtggaagatgaatnnaaatggttnntangtatantantgtgataatgaaantgtngatggtgttgnattnnattanattnnngaaannaatggtgttnnantagtnantganatgtnatnnagnataatgannaagaaantaganatntnaaaattnggntggatnattgntggtgnnnaaaagaatattgganntgngggagtagtagtagttattgtnngtgaagatnttntaggaaatnnnatgaaatggtgtnnatntgtaatgganttnanttatatagnnaaagaaaantntgtanataanantnnagnaanattntntgtntatgtnatggaaaaggtanttnagtggattaaaaagaanggaggtntngaagntatggaaaannaagnnatagaaaagagnagtttattgtanaangnnatggttgaatntaaaggtttntananttgnnnaattgatgaagaagtnagaagtagaatgaangtatnattnagagtaggtggaggnaangaaaaantngaagaanttttnttagtagaagnagagaaagttaagatgtattaantaaaagggnatagatntgtaggaggaatnagagntagtttatanaatggagttantttagatgatgttaaattgttagttaaatttatgaaagaattnnaggngaaanatggatnaaagtgatgttattaatttgnnnnnnnnnnnnnnnnnnnggaattgtatgtttgtnttttntaattgtaaatttgtttaatatttaagaatgntttatttngggatgtaagatgttgtannnnnnnnnnnnnnnnnnnnnnnnnnnnnngt

SEQ ID NO: 15278 - DNA, 856 bp, Diabrotica virgifera
  misc_feature (10)..(25): n is a, c, g, or t
  misc_feature (28)..(657): n is a, c, g, or t
  misc_feature (664)..(701): n is a, c, g, or t
  misc_feature (721)..(734): n is a, c, g, or t
  misc_feature (737)..(759): n is a, c, g, or t
  misc_feature (767)..(789): n is a, c, g, or t
  misc_feature (819)..(850): n is a, c, g, or t
gaactagtcnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcaannnnnnnnnnnnnnnnnnnnnnnagtttaaaccggtgtgagccagggtggttnnnnnnnnnnnnnnnnnnnnnnnnnnnnnnnncaaagg

SEQ ID NO: 15279 - DNA, 706 bp, Diabrotica virgifera
ggtagattcagtttgctttttttgtttctttttggtttgtgttggtactttaaattctttatttaattcttcagtgggagatggagtagtattaatttccgaaattgttctcttattggtcgttgactgatccttagatatacaattagtttccataattaatacggggggcattaaattagtatctgtttgttggttaagtgaaggttcggcattagaattactgactggatgatttggttccatttctaggggtgatggaacagacttgggggattcttgtggttgttgttgtattggttgttgttgtattggttgttgttgttgtattggttgttgttgtattggttgttgttgtattggttgttgttgaatcaggtgattgatggtagagcagatgacccacgataagaccaaggtaggggtggaaagtatgacagtaccgggtcatcacctctgaatcgagtgcggatgcacatgcttgatgctatttctccactttgcggatcccatcattgatatggaaatggaatgtgaccagcaaaagaacgaaaggaaaggattctgcttcgtaacatatgaatctgaccaagtagtgaatgagttactcacgcaatccaaacaaagcatgtaatgaaaagaggttgatgcgaagaaaggctcaccaaagaattaccaaatgggctgtcgcatgatggggatgagc

SEQ ID NO: 15280 - DNA, 757 bp, Diabrotica virgifera
  misc_feature (15)..(43): n is a, c, g, or t
  misc_feature (50)..(140): n is a, c, g, or t
  misc_feature (149)..(606): n is a, c, g, or t
  misc_feature (609)..(609): n is a, c, g, or t
  misc_feature (612)..(612): n is a, c, g, or t
  misc_feature (621)..(621): n is a, c, g, or t
  misc_feature (623)..(624): n is a, c, g, or t
  misc_feature (638)..(638): n is a, c, g, or t
  misc_feature (643)..(665): n is a, c, g, or t
  misc_feature (667)..(667): n is a, c, g, or t
  misc_feature (669)..(670): n is a, c, g, or t
  misc_feature (674)..(674): n is a, c, g, or t
  misc_feature (694)..(695): n is a, c, g, or t
  misc_feature (708)..(709): n is a, c, g, or t
  misc_feature (713)..(713): n is a, c, g, or t
  misc_feature (728)..(749): n is a, c, g, or t
cccctccagcgcgtnnnnnnnnnnnnnnnnnnnnnnnnnnnnncttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnaanatttttttnanntgtttattaaaaanatgtnnnnnnnnnnnnnnnnnnnnnnntngnntggngattgattaatttgaatggnnggggtattttganngtgntaaggtaggataatnnnnnnnnnnnnnnnnnnnnnntggaaatg

SEQ ID NO: 15281 - DNA, 978 bp, Diabrotica virgifera
  misc_feature (143)..(169): n is a, c, g, or t
  misc_feature (793)..(793): n is a, c, g, or t
  misc_feature (820)..(820): n is a, c, g, or t
  misc_feature (877)..(877): n is a, c, g, or t
  misc_feature (912)..(913): n is a, c, g, or t
  misc_feature (918)..(918): n is a, c, g, or t
gcgaaagatgattgattatacaacaaaacaaattaatattcaatgaacataaataaaaactttagaaatagaaaacaagaattaagttataatcatacgttaaagtaaataataaaaacagtaaatataataaaacagatacnnnnnnnnnnnnnnnnnnnnnnnnnnnaagtgtcatgaccgcaactgtcaaataaatgttaccaatttatgccacaatatcaccttcgttcgattacagttacagtgtgttccgaacaaatgtgaacaaatgtgtatataataaaatatgtctatgatagtggctgtatttccagtgtactcggcaatgattctaaaaaagaacacacctacggcctaaatatttggcgttggtatcatgtgacttcacgggctatgacgcggatgacgtgcagcggtaagtatattagacggagtataggtacatatcttcggaaagtgaaaatctcactggaataaaacaattttaaatgattactaaaaatcatatatgtaataagaacgcaactattcaaccaaccagagccaaaagacttgagaagcaattgccagaaaacttggttgaattactcaaatactagagtccaatcgttcctcttgctccatatttactaattatgatttgtattgattgagtatattgtaaatttcaataaataagtaaataaaaactatataaagtacagcctaaatgtattttcgtaccaacgcaacgcttgacaattttgaaggtgtgagaggagttattatttgtctgttgagatttttttanattagaaagcaaacattgcatctctanattaaggatacgggatttcatttcatattcatagtctagagtctagagaattacaanagtcttcttatttttctaatggccctacaaccctnntgtgngcatgcataacaatgttcttccattctgcccctatcgatagtttccttcgtcactgcctg

SEQ ID NO: 15282 - DNA, 765 bp, Diabrotica virgifera
aaaagtgtgtaatgtgatttcagtgcattagacgcatttgttgagtttttcaaagaatttacatacaatttgattattttgtatgaagattatgacttactagtgtttatctaacgaaaagtgaaaatgttctttatcatttccatttgttattttttactttcttgacctgggttaagttgttgtccatgtttgatttcaacaaaaataataagacactttttctttaaatttctattatgggaagaaacatgaactgcgacatgatttcaatgccgaagacccttttgaatacatgcttggcatatttggtcctgttattaatacaaaaagaattgttcttggtaaatgctgctgttgtaccaaattcctcgtctgccttacattgtgagtattacaataatactttcaaagacaagcctgcagatgctgctgtaactgaagaaatatgccctgtagatgaccagaaacataattgttatgttttgtggtccatttcagaaaatggaacagttaatgtttctttaaagttgactttcgataatgtgaaactcaatgaatcagagacaaatttcaaattacaagagcttaaatagccacgagggagggaggaaaaaattcaaatacaaaagaatttgattaacattcgtgatttagtatatgaagcatttagtttattatatataagaatgtttattttgtataagaatgttttgtataaggagtaaaagaatgtttattttgaaaagaagatggtacttttac

SEQ ID NO: 15283 - DNA, 919 bp, Diabrotica virgifera
tacacagttacatattcatatatttaatatttacgataacaaattatcaacaatcaaaagcatttaaaagatgtgtgccttcgtgttatattatcaaagactattctattattagaaaatcaataaaagcaaatcaactgtttggccatgaatcccaaaatcaaattgggtaaaaaggctggatttgctagctttgttcttccacgcaagccctccaataaggtaggaatatctgttacaagaagtcatagtgccagagagcagagtatggatcatgtaattatttcagaagtcacaaatgatttagccatttcaagaagacccttaagctttgatgttaaacgtaaaaaaatgcaagatattaaaaagttgacaacaaataatttggataggcacaacagtttatctgacagtaatgtgtgtggtaattgcaatgatgcaataccagctggcaaatctagggaaaaatcaatatcacatgagaatctactagaacataaaggactgaatccatttcatctaattcctataagtaaagcgagacaaaggaactttttgcagggtaaaatcggtgctaattctctactaggtcctagtgaattggacagagtatgtcctaatcgtgaaataactatttttgtaggtacttggaatatgaatggacattctccaccacaagaactgaatgattttgtcctaccggttagcatggaacacgtcccagacattctttctttcgggactcaggaatcaacttcagaaaggtttgagtgggaagccagtttacaagaaactataggaccatcacatctacttttacattcgatatcgttaggtacaatacatcttgcaacgtttataagacgagatttgatatggtacgtttcagtacccgaagaatctagcttgtcagtacgac

SEQ ID NO: 15284 - DNA, 136 bp, Diabrotica virgifera
  misc_feature (17)..(135): n is a, c, g, or t
gtttataagattattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 15285 - DNA, 923 bp, Diabrotica virgifera
  misc_feature (298)..(314): n is a, c, g, or t
  misc_feature (778)..(778): n is a, c, g, or t
  misc_feature (835)..(835): n is a, c, g, or t
tatcgaatgacgtacatggtatatcgatgttaatcgattaatatatcaatcgaccatttcattatatcaatcaagaattttctttgcctgttaatttcggttttgtatttcatgttattttaaattacatgcatacactactaaatgcatattttttaacttttctgctttctttctgatgtgaagaactatttttctcatcgtaataacacagagaggagagttttatggtggaaataggttcttccatacaatattggccttttcggtgacttactttgcagtcaagaatcggaannnnnnnnnnnnnnnnntattgtataactgtggtgtacttccaaagagatatttgatattatagctgaaattttagtccaaaatacttccgcattcttctgtgtgcgtatcatccactaaaatttaataaaatcattacaaactatagtctgtttttaattggttgtttgtaaaagcttgtttgtaattggtccaactccaggcaagtttactccactgttatcaaattttgacactaatgacatttataaaattttgacacttttggcatttcataggttaattaagttatatcagcggttttttgtattttctgcgttattcctttaatttttagattttcagtctgttgttatataaaaaaacggttgtttttagaactctttaatgatgtattagtataatataatatttatggattaccgtcaaaggcctatgacaaccaaaaaagaagatgtatttggtgatatttctaatgatnttcctgggtgtgaatctgtctttttagtttactcctctttggttaaaataaagcttnagtgagtgaaatgctcagtagatctgataaaaattctgaatcccactgatagcgactctatttaggagaatgtttaaacgtttaaccc

SEQ ID NO: 15286 - DNA, 941 bp, Diabrotica virgifera
  misc_feature (45)..(84): n is a, c, g, or t
  misc_feature (185)..(208): n is a, c, g, or t
  misc_feature (424)..(447): n is a, c, g, or t
  misc_feature (460)..(477): n is a, c, g, or t
  misc_feature (511)..(533): n is a, c, g, or t
  misc_feature (619)..(619): n is a, c, g, or t
  misc_feature (760)..(780): n is a, c, g, or t
  misc_feature (860)..(879): n is a, c, g, or t
ctgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttgngaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctaattatgttgttgcannnnnnnnnnnnnnnnnnnntataggagctgtatttgctattatagcgggatttatcaatgatttctttatttacagggata

SEQ ID NO: 15287 - DNA, 105 bp, Diabrotica virgifera
  misc_feature (4)..(98): n is a, c, g, or t
aatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatttt

SEQ ID NO: 15288 - DNA, 713 bp, Diabrotica virgifera
  misc_feature (645)..(670): n is a, c, g, or t
atatgattgtatcaccttgactccttagtctcttttcctaaggagtatttagacgacttacgacgtttaaagtggatcagttgttgtggaaacaagaagccgaactgtagcaaaatgttcaaaatcgctctatgtgccgccatcttggcgatagcctatgccgaggatggtatcgtctatctaatggatcctactggaaagagcggagtcactggcaccgttagattcttaaaactaccaagtggcattaatgtcataggtgacatccgcggcctgacaccaggaaaacacggattccacattcaccaagaaggcaatatccaacctagttgtttagctgctggtggtcatttcaacccattcaacaaacaacacggtggtccagatgactgcgaccgccacgttggagatcttggaaacattgaagctgatcaaaatggtgtagcacatatcgatttccgcgataccaagatctcttttgaaggagcaaccaacatttttggtagatccgttgtcgttcatgaaaaagttgatgatttaggaaaaggaggacatccagattcgctaaaaaccggaaacgctggaggaagattagcatgcggtgttgtgggtgttgtcaccgttctcactttatagtttaatagnnnnnnnnnnnnnnnnnnnnnnnnnncattttgtgtattctagtttataatagtaaagtattgtgttac

SEQ ID NO: 15289 - DNA, 979 bp, Diabrotica virgifera
  misc_feature (579)..(609): n is a, c, g, or t
  misc_feature (861)..(883): n is a, c, g, or t
  misc_feature (890)..(890): n is a, c, g, or t
ctcccctagcgcgtccgccaatctgatagaagacgaagagatgcttagggcagagacagatctagagatagagacagagacgatgacgaagtcgatagaaagagaaggagggaggatagggtaagagacagggagagagatgacaggaaatctcccatcaggaaacgatccaagtcacggtcgagatccccaaagggtgtaagaaggaggccaaggattattccgagatatatggtgcagatccctaaaattaatttggatttggatggtggtgatgttctcgaacttaaaagaagatataagaacatgtatatcccttcagatttcttcttcaccagcataaaatgggttgattcctttccagctgacaaaccgtttgctatcaacaaaccttgttcattccaaataatgcacaaagatgttgcaccagtccttgaaaaccgctcctccgatccgccagatgctgactatctcttctccgctaaagtcatgctgatgagcacccctggactggatgaaatttaccacaggtgctgctctctcgctgacgataaagacaatgacgagaaagactatgtnnnnnnnnnnnnnnnnnnnnnnnnnnnnnnnggtctcaggggcaagaatgaaactatggctataggaggtgcttggagtccatccctagatggcgagaacccaaaagaggatcccactgtgttgatcaaaacagctataaggacttgtaaaaatctgacaggtatcgacctgtctaattgtactcaatggtaccgtttcttggagctgtattatcgtcggagcgagtctacttacaagggggaagaccatccctgcccgtgtcgagaccgtcgtactgtttcnnnnnnnnnnnnnnnnnnnnnnncctaccnaggttggagtgggacgatctgcagaactcctacaaaaagcaatgcgaacgaatcttgacccagcctgagactggtgacgctgctgctga

SEQ ID NO: 15290 - DNA, 960 bp, Diabrotica virgifera
  misc_feature (457)..(471): n is a, c, g, or t
  misc_feature (473)..(486): n is a, c, g, or t
  misc_feature (817)..(841): n is a, c, g, or t
  misc_feature (880)..(880): n is a, c, g, or t
  misc_feature (888)..(888): n is a, c, g, or t
  misc_feature (892)..(892): n is a, c, g, or t
tattttattaaaaatatccccagaaatcgatagagggacaaattctgagcagagtttgttacgtaaagttattaaggtaaatcgaatttttgagttattggagatcagggattttagtttttcgtgagaaaagtgcatgtttttaaccgctttttcataaataactcaaaaactataagattttacagaagggttattaccaaaattgaagctaataaaagatgaaatgaactacttactggaaagatcttttaatgttaactgaaagtgagttgtgggtggttgaatgtacctatgtttttttcgacgagtacccaggtctgggtgttcaagcttgaatggcggaagaattatgcattttataacataaccttattgaacatttgtcaaggtacttagaagtatctatcgaatgagcccccgaacaagttgatagcattaaaatttatgcatcaannnnnnnnnnnnnnncnnnnnnnnnnnnnntttacgatatcaggtttgtctaaaaactatttgaaagttaattttaatggctattaaaccacgttgaatttaatcttttaaactttaaaatcttttaaaaaggtaaaatatttgatacagaaaaaactaaaatttggttatacatatacatcactttttacgtatattggttattgagttattatcaaatgaaaatgaaaattatgatcattttaaaaattctgatttttttaaattatacatatcttcttttcaaaaatatgcattctaaacaggtcaaaattgttgaagtcattacttatgctaatataaagaaattcttctaaggatnnnnnnnnnnnnnnnnnnnnnnnnnggaaatggcgtatgttttatttttcactttttcctaaanaagtctanaggngtctcttattttcatcataacttgcttaattgtgatgctattaacttctactgggactcatttgatgg

SEQ ID NO: 15291 - DNA, 963 bp, Diabrotica virgifera
  misc_feature (463)..(484): n is a, c, g, or t
  misc_feature (633)..(658): n is a, c, g, or t
  misc_feature (687)..(705): n is a, c, g, or t
attttcacgtacgtgctttgtatatttcttgaggaatgtggaataatataaattttaaatgtttttctttcaaaaattgtttttcagtttgtttttcttttacgttacgaccagggttggcaagtttaaaccaacatggttgaaaccttggttgaaactggttttttgtgggtttttcaaaacaaagtaatacattagtgatcctgtacatgcatggaatgagcttgaaaacaatttcagaaatattggaaatgaatagtgtaaaaaaaattcaaaagtctgtatgaaatggcaataacataagcacatttttatcatatatgcttgacacaagggaaaaatccccctacttagatttaacacaggaagagacatcaacagcactggactttgcaaaagaaaagtatcctgaaattgacgttttgctaataattataaagtttcaggcaaaaagtgtagcttnnnnnnnnnnnnnnnnnnnnnncagtgttacttcaaaagtgacaccgattgagtggcagaaaagccacaaaaatattaatatcatcacactaacatcattaatattattgaacaacttcacacaacccaagcgtcttcggcaagcgttgaaagaataattttttattcctnnnnnnnnnnnnnnnnnnnnnnnnnngggtacagcaaaagcctccaaactgttgnnnnnnnnnnnnnnnnnnnacatctgcagtaaatgaagaaaattgagataaataaattctatttttgtattttcaaatttagttattttgaatattattacgtttgaagatgttttttgttatattaattttgtgtgtgtgtaaataaaaataaaagtgtcttaataatttttcattgcttatatataaattaatactttgtatcaaataaaactggttaaaaccaataaacctgattaaaagcaaaaaacctgtttttttttggtttttttgaaaa

SEQ ID NO: 15292 - DNA, 746 bp, Diabrotica virgifera
  misc_feature (3)..(547): n is a, c, g, or t
  misc_feature (554)..(591): n is a, c, g, or t
  misc_feature (611)..(624): n is a, c, g, or t
  misc_feature (627)..(649): n is a, c, g, or t
  misc_feature (657)..(679): n is a, c, g, or t
  misc_feature (709)..(740): n is a, c, g, or t
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15293 - DNA, 597 bp, Diabrotica virgifera
agttaggttaagggtaaaactttcacattgcttgcaatccggcttgataacggatggaatgtatgcgatgcacacgacgctgtgcttcccgattatccctctggcaactgcagggtataggcccatcaatgacaccgtccataatatctaagaggtatctacgtcgtcatcaggtgaatattttcgatttttggatgagataacgatgagcaggacatggggactgccgacgacattgtgggcagagaaagatctatcagaaccaccaatatcctcaagatggccggcatttcttaaagtctattttctcaacattctcatgtacgatcttacccagggcatcatcacccgcaaaagtgtgaacgcgatgtgggacatggggcttgttgtcgattataatgaggggaagactctggacccgcagatactatattactaaatcgtcgaccaatcacatgagagttataaacaccgactcaagcaagaatacggagtccgcaaattagacatgattggccgtgccgccctgctgcatgcgtttgacataggtgatcgacagtgtaatgtgtatgatacatttccggcgaccggaagaga

SEQ ID NO: 15294 - DNA, 914 bp, Diabrotica virgifera
  misc_feature (861)..(861): n is a, c, g, or t
gtggattcgtcaagtactgccattattgtgttttccatgtgtaatcttataatggatgccatccatcaggaagcggatcaaaaggttttatcggatttaagacgcatattggctagtccagattatacaccaaatagtgctcaagatatatgtaatagactattcgttacatgttatatgggaagtgaaaattcctctaaagagacccggatgagggccgagactctggcagattttataggaagctatcacatgaacattgttatagatacagctgtttcagcttgcgttgaaatattcactaaaatgacaaacatgcttcctaaattttcttcgaatggtggttgtgcaagacaaaatctagctcttcaaaacattcaagctagaatcagaatggttttgtcatatctcttcgcacaactaatgctttggacaagagggcgtcccggtggacttttagttttgggaagtgctaatgttgatgagtcgttaagaggctatatgactaaatatgactgttccagtgctgatattaatcccattggaggaatttcaaagtcagatttaaggcggtttatgaattatgctaaaaccaaattcaacattccgattttaaacgaaataattgaggctccacctacggctgagttagaacccttaaaagaaggaggaatagttcaaaccgatgaagaagacatgggaatgacctacgaagaactcactcagtacggtaggttgaggaaaatcgaaagttgtggtccatattcgatgtactgtaaattagtccaaacgtggtcgtcgaaatatactccgaaacaagtcgcagaaaaagtgaaacatttttttagatgttacgctatncacagacacaagatgacagtaataactccatcatatcatgccgaatcttacag

SEQ ID NO: 15295 - DNA, 541 bp, Diabrotica virgifera
  misc_feature (10)..(156): n is a, c, g, or t
  misc_feature (163)..(189): n is a, c, g, or t
  misc_feature (200)..(500): n is a, c, g, or t
  misc_feature (511)..(532): n is a, c, g, or t
ctcctctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggatcnnnnnnnnnnnnnnnnnnnnnnnnnnntttccaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattgttgannnnnnnnnnnnnnnnnnnnnnctaaatgta

SEQ ID NO: 15296 - DNA, 983 bp, Diabrotica virgifera
  misc_feature (18)..(43): n is a, c, g, or t
  misc_feature (45)..(914): n is a, c, g, or t
  misc_feature (921)..(938): n is a, c, g, or t
  misc_feature (940)..(982): n is a, c, g, or t
ccttcctcaggcgtccgnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgatnnnnnnnnnnnnnnnnnncnnnnnnnnnnnnnnnnnnnnnnnnnnnnnnnnnnnnnnnnnnnt

SEQ ID NO: 15297 - DNA, 868 bp, Diabrotica virgifera
  misc_feature (317)..(340): n is a, c, g, or t
aattagataaatatcttttgatactttttgacacgtttcagagaaaccaccctgttcgtgtattgcatggcagccgtaggaatgttggcgatggcaggggcccttagaatgcgaagcctgccgttgacttacgctacttgtatttttgctggatttttcttcaactgctacatgcctataggatttgaactagcagtagaactaacatttccttcagaagaaagtacaactactggtctaatgaatgcagtgactcaatctatgggcgtaatagtaacactagctctaggaaaactaaatcatcagatagctactannnnnnnnnnnnnnnnnnnnnnnngaaaggaattcgttttaagagctcaattagatgtccattcttacaaacacaagtctgccaagccatactcctgtacaatatgcaaaaaatctttcagcgttagaagtaaactcacaagacattcagcagtgcattcgcaaattaaaagccatatctgctctatatgtggaaatgcatacaggagtaaggagtctcttaaaattcatgccatcatacataaaggcgataggccttacgaatgtcaaacttgcaacgccaagtttaataatcagtcaaatctgaataaacacgctgtggtgcatacaaaggaaaaaactcatatgtgcgatctttgtggaaaaagatttaaattcaagtgggccctatcagttcataaaaaaaacacacccaaagcagaccctttgaatgtgacgtttgttttaagaagttcaatttcaaaaaagatcttcaaagacataaccttatacatcaggagggcaagcaatacaaatgcagcgtgtgttcgacgacgttccgtcgccaagacaa

SEQ ID NO: 15298 - DNA, 191 bp, Diabrotica virgifera
  misc_feature (51)..(51): n is a, c, g, or t
atcctctagaggctacgcctgcacgtcgcgggctggaattcccccccttcncacgcttccggggattgatgaccagggtgaactctttttaactttctaaaatgcgtcccgcaagatggattaattgtaaggggaggatatatagtttatgtagtatatcctataattcgggatatagggggtgtgcttgg

SEQ ID NO: 15299 - DNA, 897 bp, Diabrotica virgifera
  misc_feature (17)..(52): n is a, c, g, or t
  misc_feature (54)..(54): n is a, c, g, or t
  misc_feature (60)..(145): n is a, c, g, or t
  misc_feature (154)..(383): n is a, c, g, or t
  misc_feature (385)..(611): n is a, c, g, or t
  misc_feature (614)..(766): n is a, c, g, or t
  misc_feature (768)..(781): n is a, c, g, or t
  misc_feature (783)..(857): n is a, c, g, or t
  misc_feature (864)..(896): n is a, c, g, or t
cccccccggggcgtccnnnnnnnnnnnnnnnnnnnnnnnnnnnnnnnnnnnngnaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnncnnnnnnnnnnnnnnnnnnnnnnnnnnnnnnnnnnnnnnnnnnnnnnnnnnnnnnnnnnnnnnnnnnnnnnnnnnncctatannnnnnnnnnnnnnnnnnnnnnnnnnnnnnnnng

SEQ ID NO: 15300 - DNA, 82 bp, Diabrotica virgifera
  misc_feature (5)..(62): n is a, c, g, or t
gtagnnnnnnnnnnnnnnnnnnnnnnnnnnnnnnnnnnnnnnnnnnnnnnnnnnnnnnnnnncggttaataaaggaatccgg

SEQ ID NO: 15301 - DNA, 615 bp, Diabrotica virgifera
  misc_feature (439)..(458): n is a, c, g, or t
agttaagcaataagcaatttttagaaacgttttttaaattatttatctcttctaacgacattttcttctcttttcctacgaataattaacactaactgtacaaaaagaaaaaaacactcctgagtttaaagtgcaccctgttacttttacataattctaaaacctataactacttatcgatattatcactcaaaattcactaaaagtaacgtttactttatttatcttttgttttttatcagggtaacggttttaaagcatttcaggatatttgtgaaaaagtacttattggttattaaaatgaatttttgaataaccttttcactcttataaattataaacagtattaaactatcaaacctacacttattgaagattattatgttatcatgggattatgtcattattgaggaagcgaattaaaaaaatgggcaaaatnnnnnnnnnnnnnnnnnnnnaaacgtttttgaaaagaataaaataatgtctaatacagcgagagaaatttataaaactatgcatgcggacttataatcccgtacgaatcgctctacaaagttgtgatattgaagttaagcaacattatgacgtgttataaaatgataaatgaaaagg

SEQ ID NO: 15302 - DNA, 932 bp, Diabrotica virgifera
  misc_feature (290)..(315): n is a, c, g, or t
  misc_feature (321)..(341): n is a, c, g, or t
  misc_feature (863)..(888): n is a, c, g, or t
gttcgtctaaagatactagaatacatgtaaataactttaactataagatatatatctagtttccaatatcttaaggcactcgggtacatgttgttcgatctaagctctcgattacatttagagaccaagagctagtcgaccctccgagtaacggtgtgtctgtgggactagaggttcttgtactgatgagtcatagcattctaagtgcggtagcctggcattagttatgacattacctggcacgtatcagccttgcacgtcatcgtcccctatatttgtgaaagtgtggnnnnnnnnnnnnnnnnnnnnnnnnnnttaaannnnnnnnnnnnnnnnnnnnntagaaacaaagaatctacatatccctctttcactacagtgtttataatccggagcaaatcacattaccatttttattattcaaaatacaatggttcacaaaagttcctaacatttgcttggtgataatatcactaaaaaaactatttcatagaaatttaagaccgaattatggtggtattatcaaaaagcactatacgtaaacagaaaaagcaacagaggaagcaaaatttcaactttataggaattgaaaaggtttaagattgtatgtattgatacattagcacaaaattaatagtaaaattttaaataatcccttgtttttgtatcacacataaagcatacacataagatctttccctgcgacgtcagagtgtaccacgtgacccataatcatagttaacactcccagcggatatgacacatctttcggtttacctgacaggttctcatcgaaaatgcctgtcaatttttttaaacttcacaatgaaaaaacaaaattgtataaaagtttcaagctgacnnnnnnnnnnnnnnnnnnnnnnnnnngaaattttcgaaaatataggggaatgatgacgtgcagggctgat

SEQ ID NO: 15303 - DNA, 862 bp, Diabrotica virgifera
  misc_feature (2)..(42): n is a, c, g, or t
  misc_feature (47)..(79): n is a, c, g, or t
  misc_feature (84)..(558): n is a, c, g, or t
  misc_feature (565)..(602): n is a, c, g, or t
  misc_feature (622)..(635): n is a, c, g, or t
  misc_feature (638)..(660): n is a, c, g, or t
  misc_feature (668)..(690): n is a, c, g, or t
  misc_feature (720)..(751): n is a, c, g, or t
  misc_feature (758)..(861): n is a, c, g, or t
cnnnnnnnnnnnnnnnnnnnnnnnnnnnnnnnnnnnnnnnnnctaannnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 15304 - DNA, 650 bp, Diabrotica virgifera
  misc_feature (16)..(17): n is a, c, g, or t
  misc_feature (38)..(38): n is a, c, g, or t
  misc_feature (56)..(56): n is a, c, g, or t
  misc_feature (58)..(58): n is a, c, g, or t
  misc_feature (62)..(62): n is a, c, g, or t
  misc_feature (64)..(64): n is a, c, g, or t
  misc_feature (70)..(70): n is a, c, g, or t
  misc_feature (79)..(79): n is a, c, g, or t
  misc_feature (82)..(83): n is a, c, g, or t
  misc_feature (86)..(86): n is a, c, g, or t
  misc_feature (89)..(89): n is a, c, g, or t
  misc_feature (95)..(95): n is a, c, g, or t
  misc_feature (103)..(103): n is a, c, g, or t
  misc_feature (107)..(107): n is a, c, g, or t
  misc_feature (111)..(111): n is a, c, g, or t
  misc_feature (115)..(115): n is a, c, g, or t
  misc_feature (132)..(132): n is a, c, g, or t
  misc_feature (143)..(143): n is a, c, g, or t
  misc_feature (148)..(149): n is a, c, g, or t
  misc_feature (155)..(155): n is a, c, g, or t
  misc_feature (157)..(158): n is a, c, g, or t
  misc_feature (160)..(160): n is a, c, g, or t
  misc_feature (175)..(175): n is a, c, g, or t
  misc_feature (191)..(192): n is a, c, g, or t
  misc_feature (194)..(194): n is a, c, g, or t
  misc_feature (199)..(200): n is a, c, g, or t
  misc_feature (206)..(206): n is a, c, g, or t
  misc_feature (221)..(221): n is a, c, g, or t
  misc_feature (233)..(233): n is a, c, g, or t
  misc_feature (236)..(236): n is a, c, g, or t
  misc_feature (238)..(239): n is a, c, g, or t
  misc_feature (241)..(241): n is a, c, g, or t
  misc_feature (244)..(244): n is a, c, g, or t
  misc_feature (249)..(249): n is a, c, g, or t
  misc_feature (254)..(254): n is a, c, g, or t
  misc_feature (256)..(256): n is a, c, g, or t
  misc_feature (261)..(261): n is a, c, g, or t
  misc_feature (271)..(271): n is a, c, g, or t
  misc_feature (274)..(274): n is a, c, g, or t
  misc_feature (283)..(284): n is a, c, g, or t
  misc_feature (290)..(290): n is a, c, g, or t
  misc_feature (298)..(298): n is a, c, g, or t
  misc_feature (302)..(303): n is a, c, g, or t
  misc_feature (310)..(310): n is a, c, g, or t
  misc_feature (313)..(313): n is a, c, g, or t
  misc_feature (319)..(319): n is a, c, g, or t
  misc_feature (330)..(330): n is a, c, g, or t
  misc_feature (349)..(349): n is a, c, g, or t
  misc_feature (357)..(359): n is a, c, g, or t
  misc_feature (370)..(370): n is a, c, g, or t
  misc_feature (385)..(385): n is a, c, g, or t
  misc_feature (391)..(392): n is a, c, g, or t
  misc_feature (398)..(399): n is a, c, g, or t
  misc_feature (404)..(404): n is a, c, g, or t
  misc_feature (407)..(409): n is a, c, g, or t
  misc_feature (414)..(414): n is a, c, g, or t
  misc_feature (418)..(418): n is a, c, g, or t
  misc_feature (420)..(420): n is a, c, g, or t
  misc_feature (428)..(429): n is a, c, g, or t
  misc_feature (433)..(433): n is a, c, g, or t
  misc_feature (436)..(436): n is a, c, g, or t
  misc_feature (446)..(449): n is a, c, g, or t
  misc_feature (454)..(454): n is a, c, g, or t
  misc_feature (460)..(460): n is a, c, g, or t
  misc_feature (466)..(466): n is a, c, g, or t
  misc_feature (471)..(471): n is a, c, g, or t
  misc_feature (474)..(475): n is a, c, g, or t
  misc_feature (479)..(479): n is a, c, g, or t
  misc_feature (489)..(491): n is a, c, g, or t
  misc_feature (501)..(502): n is a, c, g, or t
  misc_feature (505)..(506): n is a, c, g, or t
  misc_feature (508)..(508): n is a, c, g, or t
  misc_feature (513)..(513): n is a, c, g, or t
  misc_feature (517)..(517): n is a, c, g, or t
  misc_feature (520)..(520): n is a, c, g, or t
  misc_feature (528)..(528): n is a, c, g, or t
  misc_feature (532)..(532): n is a, c, g, or t
  misc_feature (538)..(538): n is a, c, g, or t
  misc_feature (552)..(553): n is a, c, g, or t
  misc_feature (564)..(564): n is a, c, g, or t
  misc_feature (572)..(573): n is a, c, g, or t
  misc_feature (577)..(577): n is a, c, g, or t
  misc_feature (589)..(589): n is a, c, g, or t
  misc_feature (611)..(611): n is a, c, g, or t
  misc_feature (620)..(621): n is a, c, g, or t
  misc_feature (631)..(631): n is a, c, g, or t
cccccacctgagcgtnngagtggttgtagtgaggagantaagcccttaaaaaagananttantngattgngaaaagaangannatnaantaaatnaaaatggntttnaaanaagnagataaaaaaaaatggntaaaatggggnaaatnngtatangnngntgaagaaaaagtagntggaggatataaatannanaaatnntggttnaaatggggtatgtgnaataaaatggtngantnnanaangtaantgaanangaagntgaattgtantgnaaaaattgnnatggangtaaatangganntaaaggntanggattnggtggtggagntgggtgtttaagtatggangatggagnnnaatttaagggngatgaagaatttgtnaaaagnngtggtnntttgntgnnnagagntatngntaaagatnntganggngaaggatgtnnnngatgnggaggntatgtntatgntgnngagnaaatggttgnnngtggaagagnnttnnanaaaanttgnttnaaatgtgntgantgtaanaaaggtttggaatnngttaatgtagntgaaggtnntganaaggatatttantgtaaagtttgttaaggaaaangatttgganntaaaggttanggatatggttaaggaggtg

SEQ ID NO: 15305 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15306 - DNA, 871 bp, Diabrotica virgifera
  misc_feature (18)..(18): n is a, c, g, or t
  misc_feature (25)..(25): n is a, c, g, or t
  misc_feature (27)..(27): n is a, c, g, or t
  misc_feature (67)..(67): n is a, c, g, or t
  misc_feature (387)..(450): n is a, c, g, or t
  misc_feature (792)..(811): n is a, c, g, or t
  misc_feature (855)..(855): n is a, c, g, or t
cctcccaacgcgtccggngcggagngngggaggtcgcgaccttagaggaacatgcctttacagctgnttcattttttattttcactgtgataggaatatttagaaaatttcactttcattcttagggtacttgccataaaatggggggcttttaaaaacttttaatttagaacaacacgtaccattttaaattagtctaatttttactttgattgcatgcatctttgagtcaaccaagcgtcagattttagtaggaaacagaagggtctaaattcatcttatttgaagccttgcttttgcaactaaattaaatgcgttagatacatttgtaatggatgagttgcattttacagatccataataaagtgctttttaacccaataaaannnnnnnnnnnnnnnnnnnnnnnnnnnnnnnnnnnnnnnnnnnnnnnnnnnnnnnnnnnnnnnntaatattgataaatgttttaatttttgtgattcaaaatcgcagagttcatcaaatctatccttgtgcttccagatattgttttgaagtactttgatctccattcttcagagcttcttttgggcgttcctaatttttttaatattccgctttcgtctattccttataaatgtgcttactaccatagctcattcttctataatgttgtgtaagctttcctaagtaaaatcagataactaatatcaaatactgtcatatttgatcatgaaagaaaatatattttaactcttttattcaattatcttgaacgattttttgtaatctcaaagaacaaataattacannnnnnnnnnnnnnnnnnnnatatgaagactttttatcgttacgtccaaaagtaaatggaaatnttttatgtactagttc

SEQ ID NO: 15307 - DNA, 861 bp, Diabrotica virgifera
agaaccaataacagaatcgttggaccctagtatgatcttgagcgtggaatgtgccctgtaatgcacaaataggaactaccttcatgaagtcatggagcgatagagacgcaaacacttcaattttagtgacgcaaaacacccgcattgagaataccacaacatgatcccttcatcttccttaataatagcttatcatgaaccgaatacctcactgaaggtacttcatctgtccacatcaacccattaaaaggatacgggatcgactactgtcatgcaacagctatgcaaaacagagataacctttaacatgaaaggttctatgaaagaccaaaaatatgtacacaactacaaacctccaggtcttacagacatgacagccaaatagactgaaccttactctcacataactgaagagatgtctattattgtcatagaaaaacagaatggactgtaatgctaacatgcaaaaaaatacaccccgactactgctcatctgactacgctgttaaaagcttatgcgatgatgcatgacgtgacattagcgcagagagactcatagagagatgctacttgtgaatatcgttcagacctgtgactatccctgcccacaatactggactcatcgcaaatgaagtggtaaatacccatacaccgatattcaaacatgcgcgataccacactggccaactctgattatcctatgttgtgtagtaaatacttacgtgaccaaaatatgaatactatactaatgtatctaagcaatactatatctaaagatcatgtcatatcacatgttgattagacagactatgatatgatgtatctatatattgatgacgataaatctgttccacttcgcat

SEQ ID NO: 15308 - DNA, 913 bp, Diabrotica virgifera
  misc_feature (795)..(795): n is a, c, g, or t
  misc_feature (807)..(831): n is a, c, g, or t
  misc_feature (881)..(882): n is a, c, g, or t
acggttttaacttgtagttataaataattcgttttctgacagaataacgttgttaagatataaacaataacatattatatgaaaatcaaatttacttctttgatttatgaaatttatgcctgttttcattgttcaactttcacttatgtcatattttgagtgataacgtgataactcggttgatatgtgacagaatcgtcatattagtgttgattttatttatttgcattagttaaagtggactcttttgtgtgatttgtaaaaaattgattccttaggaagggttagtgattatttgaagatataaaataccaatcgatagcttgctcgacatcgatgccaagtttctgacattgcttccacacttacaacacagctgatccattgacaaaaatctaccacataatttttcattttaatacatttagatcgagttacactgctgctaaaaataagaaggcgagggaatggtttaccttttagccaattggggcatgggagaaaatgacacaggtaaaagtaattgtgccgaacccactaatgcagctttcagacgtcaagaacaactcagttgcaacaatgatgaagtcgatttatttcctttaaataaccaggttggtggtcacacgagattgatggtattgaattctagtacgatagtcaaacccctgaactaccgagaattggatttttatcaaaacatacaggaacaggatattaaaaatttcgtaccgaaatataaaggtaagctgagtaacttataagaaaaaaagtgacttttcggaaaagactcanagtgccatttcnnnnnnnnnnnnnnnnnnnnnnnnngtgcttttttaatacataatatagatttagtacaattgtaaatattgtannaacacagaaatcaaataagctttttcttaat

SEQ ID NO: 15309 - DNA, 868 bp, Diabrotica virgifera
  misc_feature (9)..(10): n is a, c, g, or t
  misc_feature (22)..(22): n is a, c, g, or t
  misc_feature (38)..(38): n is a, c, g, or t
  misc_feature (43)..(43): n is a, c, g, or t
  misc_feature (47)..(47): n is a, c, g, or t
  misc_feature (64)..(64): n is a, c, g, or t
  misc_feature (66)..(66): n is a, c, g, or t
  misc_feature (70)..(71): n is a, c, g, or t
  misc_feature (73)..(76): n is a, c, g, or t
  misc_feature (80)..(82): n is a, c, g, or t
  misc_feature (84)..(84): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (107)..(107): n is a, c, g, or t
  misc_feature (111)..(112): n is a, c, g, or t
  misc_feature (115)..(115): n is a, c, g, or t
  misc_feature (123)..(123): n is a, c, g, or t
  misc_feature (127)..(127): n is a, c, g, or t
  misc_feature (134)..(136): n is a, c, g, or t
  misc_feature (142)..(142): n is a, c, g, or t
  misc_feature (147)..(147): n is a, c, g, or t
  misc_feature (157)..(158): n is a, c, g, or t
  misc_feature (162)..(164): n is a, c, g, or t
  misc_feature (166)..(166): n is a, c, g, or t
  misc_feature (171)..(171): n is a, c, g, or t
  misc_feature (175)..(177): n is a, c, g, or t
  misc_feature (179)..(179): n is a, c, g, or t
  misc_feature (185)..(186): n is a, c, g, or t
  misc_feature (190)..(190): n is a, c, g, or t
  misc_feature (197)..(198): n is a, c, g, or t
  misc_feature (200)..(200): n is a, c, g, or t
  misc_feature (212)..(214): n is a, c, g, or t
  misc_feature (221)..(221): n is a, c, g, or t
  misc_feature (223)..(223): n is a, c, g, or t
  misc_feature (225)..(227): n is a, c, g, or t
  misc_feature (229)..(229): n is a, c, g, or t
  misc_feature (231)..(231): n is a, c, g, or t
  misc_feature (233)..(236): n is a, c, g, or t
  misc_feature (242)..(242): n is a, c, g, or t
  misc_feature (247)..(247): n is a, c, g, or t
  misc_feature (259)..(259): n is a, c, g, or t
  misc_feature (270)..(270): n is a, c, g, or t
  misc_feature (276)..(277): n is a, c, g, or t
  misc_feature (290)..(290): n is a, c, g, or t
  misc_feature (292)..(292): n is a, c, g, or t
  misc_feature (296)..(296): n is a, c, g, or t
  misc_feature (306)..(308): n is a, c, g, or t
  misc_feature (312)..(312): n is a, c, g, or t
  misc_feature (316)..(317): n is a, c, g, or t
  misc_feature (319)..(320): n is a, c, g, or t
  misc_feature (332)..(332): n is a, c, g, or t
  misc_feature (337)..(337): n is a, c, g, or t
  misc_feature (347)..(347): n is a, c, g, or t
  misc_feature (349)..(349): n is a, c, g, or t
  misc_feature (362)..(362): n is a, c, g, or t
  misc_feature (373)..(374): n is a, c, g, or t
  misc_feature (388)..(388): n is a, c, g, or t
  misc_feature (390)..(390): n is a, c, g, or t
  misc_feature (396)..(397): n is a, c, g, or t
  misc_feature (407)..(407): n is a, c, g, or t
  misc_feature (410)..(410): n is a, c, g, or t
  misc_feature (413)..(414): n is a, c, g, or t
  misc_feature (417)..(417): n is a, c, g, or t
  misc_feature (420)..(420): n is a, c, g, or t
  misc_feature (424)..(424): n is a, c, g, or t
  misc_feature (428)..(429): n is a, c, g, or t
  misc_feature (432)..(434): n is a, c, g, or t
  misc_feature (437)..(438): n is a, c, g, or t
  misc_feature (443)..(443): n is a, c, g, or t
  misc_feature (445)..(445): n is a, c, g, or t
  misc_feature (449)..(449): n is a, c, g, or t
  misc_feature (451)..(452): n is a, c, g, or t
  misc_feature (456)..(457): n is a, c, g, or t
  misc_feature (467)..(467): n is a, c, g, or t
  misc_feature (479)..(480): n is a, c, g, or t
  misc_feature (482)..(482): n is a, c, g, or t
  misc_feature (495)..(495): n is a, c, g, or t
  misc_feature (509)..(509): n is a, c, g, or t
  misc_feature (515)..(516): n is a, c, g, or t
  misc_feature (519)..(523): n is a, c, g, or t
  misc_feature (525)..(527): n is a, c, g, or t
  misc_feature (529)..(532): n is a, c, g, or t
  misc_feature (534)..(534): n is a, c, g, or t
  misc_feature (537)..(537): n is a, c, g, or t
  misc_feature (541)..(541): n is a, c, g, or t
  misc_feature (544)..(546): n is a, c, g, or t
  misc_feature (548)..(548): n is a, c, g, or t
  misc_feature (551)..(552): n is a, c, g, or t
  misc_feature (557)..(558): n is a, c, g, or t
  misc_feature (563)..(567): n is a, c, g, or t
  misc_feature (569)..(569): n is a, c, g, or t
  misc_feature (573)..(573): n is a, c, g, or t
  misc_feature (583)..(584): n is a, c, g, or t
  misc_feature (586)..(586): n is a, c, g, or t
  misc_feature (589)..(594): n is a, c, g, or t
  misc_feature (596)..(598): n is a, c, g, or t
  misc_feature (604)..(607): n is a, c, g, or t
  misc_feature (614)..(614): n is a, c, g, or t
  misc_feature (617)..(617): n is a, c, g, or t
  misc_feature (622)..(622): n is a, c, g, or t
  misc_feature (630)..(630): n is a, c, g, or t
  misc_feature (633)..(633): n is a, c, g, or t
  misc_feature (635)..(635): n is a, c, g, or t
  misc_feature (638)..(639): n is a, c, g, or t
  misc_feature (641)..(641): n is a, c, g, or t
  misc_feature (646)..(646): n is a, c, g, or t
  misc_feature (649)..(649): n is a, c, g, or t
  misc_feature (654)..(659): n is a, c, g, or t
  misc_feature (661)..(661): n is a, c, g, or t
  misc_feature (665)..(665): n is a, c, g, or t
  misc_feature (667)..(667): n is a, c, g, or t
  misc_feature (674)..(674): n is a, c, g, or t
  misc_feature (677)..(677): n is a, c, g, or t
  misc_feature (679)..(680): n is a, c, g, or t
  misc_feature (682)..(682): n is a, c, g, or t
  misc_feature (684)..(684): n is a, c, g, or t
  misc_feature (687)..(691): n is a, c, g, or t
  misc_feature (695)..(712): n is a, c, g, or t
  misc_feature (716)..(716): n is a, c, g, or t
  misc_feature (718)..(718): n is a, c, g, or t
  misc_feature (720)..(720): n is a, c, g, or t
  misc_feature (722)..(722): n is a, c, g, or t
  misc_feature (724)..(724): n is a, c, g, or t
  misc_feature (727)..(727): n is a, c, g, or t
  misc_feature (730)..(730): n is a, c, g, or t
  misc_feature (733)..(733): n is a, c, g, or t
  misc_feature (735)..(737): n is a, c, g, or t
  misc_feature (743)..(743): n is a, c, g, or t
  misc_feature (745)..(745): n is a, c, g, or t
  misc_feature (754)..(754): n is a, c, g, or t
  misc_feature (756)..(757): n is a, c, g, or t
  misc_feature (759)..(759): n is a, c, g, or t
  misc_feature (761)..(761): n is a, c, g, or t
  misc_feature (764)..(764): n is a, c, g, or t
  misc_feature (769)..(771): n is a, c, g, or t
  misc_feature (773)..(773): n is a, c, g, or t
  misc_feature (777)..(777): n is a, c, g, or t
  misc_feature (779)..(781): n is a, c, g, or t
  misc_feature (783)..(784): n is a, c, g, or t
  misc_feature (786)..(790): n is a, c, g, or t
  misc_feature (793)..(793): n is a, c, g, or t
  misc_feature (797)..(797): n is a, c, g, or t
  misc_feature (804)..(804): n is a, c, g, or t
  misc_feature (817)..(849): n is a, c, g, or t
cctcgtgtnnggaaatatgtgnccacttcaacagcaangaagngaanaaagcaggagagggaanangggnnannnngcannnanacaaacaaggaanaccccnangngccnnaancaaagaanacangaagcannnagcggncaaanacccaacagnnaagnnncnaaaancaannncnaccacnngcanacccaannanccagacaaaaannngcccacncngnnngncnannnngagggngaccnaaaaaaacaaanagcaggcccangggagnncagaggaccaaancnaacncaagaagaannngagnacanngnngggaaaacgggngcaanagaaacaagnancaaagaagacccnagaccaaaagnnaaggacaaaacgcncncagaannggccgaaacnaangannggnagnacanaggnncannnacnnacggngnaagnannacanngaacaaaggnaccaaaaacagnncnacacaccagggcngaaggcaagaaaanaagganngannnnnannnannnnanaanaaanagnnnanacnnaaggnngcgannnnnanacancaaacacggnnanagnnnnnnannnaaaacnnnnggaaaanaanagaanacccaggnacnanggnnanagccnacnagagnnnnnncnagcnanggacacnaanannananggnnnnngccnnnnnnnnnnnnnnnnnnaccngngnananggnacnggngnnnaaaacngncacaaaggnanngnancanaaaannnanacanannnanngnnnnnganaacnaaaaaanaaagattatttgnnnnnnnnnnnnnnnnnnnnnnnnnnnnnnnnngaaacaggaacaccgcaag

SEQ ID NO: 15310 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15311 - DNA, 121 bp, Diabrotica virgifera
gggagatgcctttcgttgtgcttcttgcccatatttgggaatgccagcattcaagccaggggaaaaaattcaattagttggaaatcagctaagtgatgatatttaaaatgtgtatattttt

SEQ ID NO: 15312 - DNA, 585 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(328): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttctaagggatccaggtttacgaacggggggtggggaggcaaaagcttttttatggggcccccaaatttcatttccggggcggcggttttacaaggcggggagggggaaaacccgggggttacccatttaaatcgcttggcagcacttccccttttccccagtgggggaaatagcaaaaaggcccgccccgatcccctttcccacatttgcgcaccctgaagggaaaaggggacgcgcccggtagcgggctttaa

SEQ ID NO: 15313 - DNA, 961 bp, Diabrotica virgifera
  misc_feature (781)..(798): n is a, c, g, or t
  misc_feature (809)..(809): n is a, c, g, or t
  misc_feature (818)..(818): n is a, c, g, or t
  misc_feature (847)..(848): n is a, c, g, or t
  misc_feature (851)..(852): n is a, c, g, or t
  misc_feature (857)..(857): n is a, c, g, or t
ggaactatatgtaggtgaattgatgtaactattactattactctcggcatctgccagtctactatcagaagttgcagttctataaccttccgtcgcacttttaaattgttccgtacatgttaacgtactatgctcactgatttctctttgtttttcaatatcttccctcattaacatttccgcggctactgtgtaggttttgtaacgatctctagcttggtttctccgttgtttcgtagtcatggatttacttaaacttcgtattttctttggtgttgattctatactgctcctggcatcggaaaatagggtaacttcatcttcgtcgttgtctaatgcagtttccattattgaatctgtaccatccaccatatcttcggcaatggttacatcggccgcagtaccatcttcatcaacgacatgagtaaagcagtcttcaaaaatctcagtctcgctgcctatcccttctgtcggaacatccgccaaagaattgcagaagtctgtgatctcgttaaaaagcgatggtgggttgatgttttctaattcgctaaaaggttgcttcaaatcaaaaatcggatgttgagtgctctgtggattgttgataagaccgttaatgagaaaatcagctctatggtcgttgggcaaacttgcaacactggtcatacttccttccatgtcaaatagaaggtcagagggaggattaatgtgatccaaattggacaggctttccaaacttgaaccattatttagcgaattactcaaagctcttcggaccatcaannnnnnnnnnnnnnnnnntttccttttgngtaatttanggcttctaggtagtcctactgcactgttnngtnnatgantcatatttgatggaggctgaacgtggtctaactctagagaagctgcgcttgttatgctcgtggacatttcggcttcttggttaaacgctgtagccattttactg

SEQ ID NO: 15314 - DNA, 912 bp, Diabrotica virgifera
  misc_feature (19)..(19): n is a, c, g, or t
ccctccaaggcgtccgggngtttatttgtgttgtttttatcctgtgattggtcactcaacttgcactataacctacctgttagtgtttacctggacaaggtaccaagattttaccaatcaataaaaataaacagaaccaatcacaatgtcgaaggacgcgaaaagtatggtatgggactacctcgtgttcttcatctttgtcgtagctagtacatttgtggcagtttactcaaagtgcttcggacccaaagaaaaaacaaaagcagactatgtatttgcagcaggcaaagtgtcaatggcagcgatgatgctgagtatagccagagggacgctgggagtgcgatcttttttaggttacccttcggaactattctatagaggagccacaatgtgggaaaccctttacggcatggtcctggcctatcctatagtttgcttcatattcgtgccggtgtatttcagccttggaataacttcagtgtaccaatatttggatatgcggttcaaatctcgattggttaaacagctggcttcgggaacttatatcgtaagagcgctcctcaatcagggagtgacagttttcactccttgtgttgctcttaacactgttattggaattccgtattggctttcgatcactggtatttcactagtcagcattattttcaatatattgggaggtctcaaagcagccatttgggcagatgtaatgcagggcgttacaatgatagtagttagtatggcgatcattttccaaggctgctttgaagctggcggacctttaaaagtcattgaagtcaacaaagaggacgggaggctgaactttttcaatttcaatatggatttgactgcaagagtaactactacgtcagcaatcattggtcaactttttatgtcgctgtcaatttttgg

SEQ ID NO: 15315 - DNA, 921 bp, Diabrotica virgifera
gatacggacaaccaggtcaattaagatatccagaaatttcaagtacaccaccaacaggtagacctggacaagcaggaaccggtactagacctgatcaagcaagtggtccaggacaaacaggtggctggccaggacaaacaggtggttggccaggacaaacaggtggttggccaggacaaacaggtggttggccaggacaaacaggtggttggccaggaccaataggaagtccaggacaaataggaagcccaggacaaacgggtggttggcaaggacaggtaggaagtccagggcaaagtggtggttggcctggtcagggactaggtccaggagttacaggaggtacaaacggaccaattagtagttggccaagtccagttggaagtcccggacaaggtggaaattggcctagcccaggcatcccgggaaatgttgatgggagaccaaacactggctggcccggaaatttattaaccccaggacaagtacccggacctgtacaatccggaggatggcctggtcaaaatggtggtagtttgcctgggccagggcagataggaactacaggacaaacaggaggatgggctcaaactccaccttcgggcactgctggaggtggaattcaaacaggtaatttgcccgaccaaggaggaaatgtaggtcctggtgggggtagcccaactggcggtttgcctagtccagtaggtgtcccaggacaaaatattggttggcccggtcaaactggaactcaagtatctggttatcctggtcaaatggacaaagtggtgcttggtctggacaagaaggtggaacaaatcaccctgggctggtcaggtcaaccaagtggaaacagtcaaattaggtgggtggcctggacagtaggaactccaaggggggtggtcaaggtggcagcactggagc

SEQ ID NO: 15316 - DNA, 938 bp, Diabrotica virgifera
  misc_feature (562)..(579): n is a, c, g, or t
  misc_feature (710)..(750): n is a, c, g, or t
  misc_feature (918)..(918): n is a, c, g, or t
gttactatagtgatttgtgcagtgttagtaccatgactttgacaatcaaattggtggcaatattcgcttttgcagctgctgcaacagggtctcctcttacgacgtttggaaaacggactccagcactaccaacaccatccaaagaaccagactcttaccagctcttccaaactcagttaccaatggaactagaattaccaaaagaagaagccaatcctgtaccattctacgctcctgaaccatccacggatcttaaagctccacaagaatctcaagaaccggactattatcaggtaccaatacccaaccaagaactcgcggcacccatagacactgagtggaatcccaataatgatcctatttattactatgaagtcccagctataatcaacaaccaggaatcgcctacgagagagttccctaagaaatataacgaagatattcacgacaaaaagaaaccttttgcgtcccagccaaaggttgagattattttcgaaccgatcagcaagcagcagtacgaagaaaaacaaatagaattaaccaaaaagtttgataaactcgnnnnnnnnnnnnnnnnnnagatcattcaggcacaacagactatttagattcgaagagagagataaggaaggggtggtaaaaggtcactatggcttttacgacaaagagggaaagctgcaagtagtccactacgatgcccacccgcatannnnnnnnnnnnnnnnnnnnnnnnnnnnnnnnnnnnnnnnnagtagtcaacctttgatcagactgaattagaaattatcgatagataatttgtaattgcagaatattacttatagattttttattcttatgaaagggtggtattaatggtaagggcgaataaatatacactttttgaggatttttgaagcgaagcttctatattgacgnttgtattgattttcctctat

SEQ ID NO: 15317 - DNA, 576 bp, Diabrotica virgifera
  misc_feature (2)..(501): n is a, c, g, or t
  misc_feature (503)..(567): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnttttttttg

SEQ ID NO: 15318 - DNA, 872 bp, Diabrotica virgifera
  misc_feature (11)..(23): n is a, c, g, or t
  misc_feature (26)..(43): n is a, c, g, or t
  misc_feature (103)..(128): n is a, c, g, or t
  misc_feature (341)..(360): n is a, c, g, or t
  misc_feature (631)..(656): n is a, c, g, or t
  misc_feature (818)..(818): n is a, c, g, or t
cgtgctgtacnnnnnnnnnnnnncgnnnnnnnnnnnnnnnnnncttgattttaacaaaataaatgcttacaaagatttaagatgacaaaaaatgcatattagnnnnnnnnnnnnnnnnnnnnnnnnnncatgaaagttgtactgtagtcgagaactaattaaaaactgtatatttacaattaaacttttattcaaaaggatacataattttgaaaatatgttaaattttgtttgttgtttactacagtggtcgagcaaagatacaataacaacattactttcctcaacacttgtagatagacaatcaaaaaacaaatttccaaaatcatatctataaccgnnnnnnnnnnnnnnnnnnnngtaatatgtaattcgcttttaaatatttcgacaacaatctaaatatttaaaatctgtattaattttactgagtaaagacctccagtcagaatcctcttaacactcacacacgacactgatagattctacgtattctaagacatataaaattttataaactcctctatatcattaaacagtgcaaataaagtacagaactgagatttacacagtataaattttgcttttccaacagttctattgcttagccatacttgatatgatgttggcnnnnnnnnnnnnnnnnnnnnnnnnnnatgtgaagcaaatctatccgtccgtcgacagaaagtagcattttttaaaagattacaaacatccactgttatgtatccgttatttgtgtcatgaatattaatcagtattgccaaccgatattatattaaagagaatacatacatttttcctcttaagcccgntgcacgtcatcaatgggatttctgcttcgtcacagtacaaccaactattcttat

SEQ ID NO: 15319 - DNA, 440 bp, Diabrotica virgifera
  misc_feature (276)..(295): n is a, c, g, or t
ccttttctcacgcgcccggattatgtaacttttttgagaccacattatgcaaaaaatcaatacagcgcgttgcagtgcttgtgagaactggaagcgaaatgatagaaccaaatagaacccacacgtggttacgccgggaatggctgccaaaatgatgctataaacaccacattccggtgatctgtagagtatgggacaccagggagggcaaggcaaaataagtaccacaggggaggggaaacgaccccgtcgacgaggcagagtgactctgtaatnnnnnnnnnnnnnnnnnnnncgtaagctaatgtggactcgaggtaagaatatgaaactatggtacattcaaaggaactacgagtgacgctacgtgagtcagaggtgtcatataaaataagttatgtcgcaccgcacatggaacacagtggagaactccaccaagg

SEQ ID NO: 15320 - DNA, 484 bp, Diabrotica virgifera
gaactgagcgcgtaattaatagatcgacataaaccccggcgtgggtacgccgggacttactcccctattgccccgactccgaactaattccggagacctggagattacgctaagctgagcagcaaaaaggcaaaaatatactctcaaaagatgggtaacgattctgtagaataggacgagggacacttaaacaataaggtccagagagaaccagaaattaatatggatattcgggtgagacaaatgcgataacagtatattctatggaaccatgagtgatgccccatgaaactgagatgtcatctaaaatcatgattagtcgcacagcacatgatgatagaggagaactcagcgcagcagctggtactgaggagattgaaacaggcatattaatggtgtgcaaacacgtgaacaagatcttttggatatgacccttggtgtaagactggttagtgttggggatcaccagatgcactcaactgaa

SEQ ID NO: 15321 - DNA, 678 bp, Diabrotica virgifera
  misc_feature (36)..(56): n is a, c, g, or t
cggacgcgtgggggaaaatactttgcaactctgttnnnnnnnnnnnnnnnnnnnnncctgtcataatacaatgtaatcatattcacagttcgtcgacgaaccatgcatggaaaaaccaggaaagaaacacaaaaaaatggttaaaatataatgacaaagtgtatccacctcaacaacctgatgaggaaccaagaaaggcatttgtttgccatcaaaggacaaatattaaatacagtccatggaagatgtggtacatagcttgtttaattaggggtatgccagtagatgaggccatcaaacagttaaagtttgtggttaaaaagggggcaaaagatgttagagaagtcctggaagaagccaaggagttagctgttaaggaacataacgtagagtttgccagtaacttgtgggttgctgaatcgtttgtggggaagggtgctgtcattaaaggtatgagaagacatgctagacaaaggtttggaatagttgaatatgtccattgccattactttgttaggttagaagaaggtcaaccgccagaacattattatttgtctcatccaaaagaaccacatgaacaactagaggattggttagctcaaatgagaagaaggaaaatcaccaattcattgtaattttactgtagacatataaataaaagtttgttataagaagaat

SEQ ID NO: 15322 - DNA, 634 bp, Diabrotica virgifera
  misc_feature (13)..(13): n is a, c, g, or t
  misc_feature (15)..(18): n is a, c, g, or t
  misc_feature (26)..(26): n is a, c, g, or t
  misc_feature (31)..(31): n is a, c, g, or t
  misc_feature (57)..(57): n is a, c, g, or t
  misc_feature (59)..(59): n is a, c, g, or t
  misc_feature (62)..(62): n is a, c, g, or t
  misc_feature (65)..(85): n is a, c, g, or t
  misc_feature (95)..(95): n is a, c, g, or t
  misc_feature (106)..(106): n is a, c, g, or t
  misc_feature (135)..(135): n is a, c, g, or t
  misc_feature (152)..(174): n is a, c, g, or t
  misc_feature (209)..(209): n is a, c, g, or t
  misc_feature (245)..(245): n is a, c, g, or t
  misc_feature (524)..(524): n is a, c, g, or t
ttcctttaaaagngnnnngaggaganaaaancaaggaggaaaaatcttaaaaattgngnggngannnnnnnnnnnnnnnnnnnnngtttggggtnagtgttttatnatgaaaagtatactcaagaatttgaattntagttttagggtaatgnnnnnnnnnnnnnnnnnnnnnnnaagtatttttggatagtatatttaataatgttagnttagtttttgataatgaatattttagagtgatgttnagtattaatttagtgagaggttaagagaaataagatttatttatgatgtttttagttttgtaaggaattaagatgaaaatataattgaagttattgtaaatggtgttgtttttagattattaaggttgataaattttgagtgatatgagtcatgtgtaaagtgtgatgtgtgttttgtatttgtagaaattgtagttattattagattaaagtatttttgaatatataaataaatagtgttatatgagtttataagtggaatatgattgttaaaaagtngtataaagttatataatgtaaaatttttgaagaaaataaggtatttgagtgagattttttgtttgtgattgaaaattgaaaataatgagtattaagtcgttttatagaaa

SEQ ID NO: 15323 - DNA, 441 bp, Diabrotica virgifera
  misc_feature (132)..(182): n is a, c, g, or t
cttcttaccccgcgtccggctgtgaaagtaatccagagatggtatccccaaggaaatagaacaagaggaaggccccttaaaagatggatagacgatatagagggggatattaaaaccatgaacatcaggtannnnnnnnnnnnnnnnnnnnnnnnnnnnnnnnnnnnnnnnnnnnnnnnnnnggaccagactcacaaagggtggtcgcgccattataagaagaataaaaggtgataaggaaggccgtataaggagccttgtgtgctgtatacattacgaggcggccaatcccagaggcatcgtggaatccccttcttatcttcaagactgtggtagattcgtagcaaccattaactgatggctagtagagctgaggtgaaccctaatattataaagacgcagagccacctattgtataggtgtaactactgccaggccgcg

SEQ ID NO: 15324 - DNA, 1003 bp, Diabrotica virgifera
  misc_feature (141)..(163): n is a, c, g, or t
  misc_feature (190)..(210): n is a, c, g, or t
  misc_feature (653)..(675): n is a, c, g, or t
  misc_feature (883)..(933): n is a, c, g, or t
cgacatatgacggaggctcgaaacaaatgactgtgaatgaaaagccctattacgcatattcgctgtgagccgatgagtagaggggatttgacagttttcgccagcgctgttagtggcagttttgtgcattgaatttgaacnnnnnnnnnnnnnnnnnnnnnnnccatttttattcagttgcaatgcgaannnnnnnnnnnnnnnnnnnnnacttagaacagggagcgcagaccagcactctaaatcgacgattttcgactctatttggagtcatcatcagagaggagtaggcctgctgctctctgcccgaagtgacaaaatcacgaaagcttatccccgcattgcaactgacgtttatggagtaggtgactagcgtcatctggcaactgaaaggcaaagtaagttttcaacctaatagaaattataataattatgaaaaagattaaaaatattactaaaagatttttaattgaaaacttattgatccatttccctgataacacctccatggcttctaaaaattgcaagccagatggatgctgaagcgaagaagacaagagagaattcaaaaaacttacaattcacgaccccgtctattcagctggtaaattccaacagaaaatggacctagttactcaaagaagtaacgaccnnnnnnnnnnnnnnnnnnnnnnnccatttttattcagttgcaatgcgaaggcaaaaaaaaaattgagaaaagcatttgaacaattttatcagaaaagtacaagtttcaaaccgcgagagagcgctaccgacgaaacttacagccaataaaaacagaggtaacctctaaatttcacataaacttcttctttctctcaatggcctcttgcgtaagcagtcatccagtcgcacnnnnnnnnnnnnnnnnnnnnnnnnnnnnnnnnnnnnnnnnnnnnnnnnnnncttttactataattatggggattcgtttcgaaatcagggtacaaaaaaattttaagttcttaatcctggg

SEQ ID NO: 15325 - DNA, 794 bp, Diabrotica virgifera
cggacacgccgcgcatcttttctctcttcttccttaattgcttcaagaaaatactcctttacttgataccgagctaactataacatgaacatgagcttctacttcgacttgctagttcatgttcaattggggaactgctactctcatcgaaccccaccgaaacagcatccgctacaccagctctttgcctgtagtataatgaacctcataattatatctcatcaatctaattcagagtcttcgccagcgaggagtgagatcgtcaatcggttttgatattattacttggacctaacggtgtgaggactagtctctaaaacaatcgagacatcccagatgatatattctagagacttatcagcagcccatgtcagagctaggtcttcccgctctatttgggaatatcttttttcagagaaaaaatggaaaagagaagaatatggaacgattacctttttaccctcaatacactgcatcactcgtgctcccagtccaaatgatgagggatccgctgaaactgctatctgtctggaaggaccatagcaagataaacatggacttttttgcaataattccttgactcttacaaaagcttgattctgcggactgccccacatacctgtgacaatcgttctctgcaatgacgcaaggagatcaaggattacacatggatgacgatatacatctacatagaaaacctatcttacctgaaaactcgattgatatctggtatattagatcttctctgaaacgctaactgatgatgatatcccttcgggagcagatgcctctcc

SEQ ID NO: 15326 - DNA, 924 bp, Diabrotica virgifera
  misc_feature (835)..(835): n is a, c, g, or t
  misc_feature (842)..(842): n is a, c, g, or t
  misc_feature (869)..(869): n is a, c, g, or t
  misc_feature (906)..(906): n is a, c, g, or t
ggacacaaaactgttgaattaattatgccatagagcatccttgcatccttaattactcgtcggtcacgcaatgagagaatacccaattgggtttcaatttgataataatttaactgatttaactcaaaaggtatacccagtttatatgctatgtaccttaagaacttgtgttggactgtctcgatttttgttatgtaaatattgtaagatggagaccaaacacaagaacaatactctagatgaggtctaactaaagaacaatatagtaatttaattgcatcaatattctgaaagtctctagtgcatctttttataaaaccaagcatttgtaaagatttggaaatttttgatgtataatgggattcaaataaaagtttacagtctaaattaattcccaaatcacgaatttcagtaacccagtcaacaggaatattctgtatattataattatattctattgggtctctcgatcgtccaaaagaaatagcatgacacttagattcattcagggccatggcattcaacatacaccactcactcaaccgatcaagatcatgttgaagattaatacagtcttctgtattgttgataattgtatagaactttagatcatctgcaaaaagcagaggtgaactgtgtcggaagcagtggtgtatatcattgatgaatatgttaaataacaggggccccaaatgtgaaccctgaggtactcctgaatgaaccttaatctcactggaaacaaaatccctgatacgcaccatctgaactcggtcaatcaagtatgttctcagccactcaagaagtggaccattaacacccatttgtttaagtttanatattanaatattatggttgaccccgatcaaggncttggagaaatcggtgtatagtgcatgtaccctacancccctctcccatgcttcc

SEQ ID NO: 15327 - DNA, 713 bp, Diabrotica virgifera
  misc_feature (9)..(9): n is a, c, g, or t
  misc_feature (11)..(12): n is a, c, g, or t
  misc_feature (14)..(14): n is a, c, g, or t
  misc_feature (19)..(19): n is a, c, g, or t
  misc_feature (21)..(21): n is a, c, g, or t
  misc_feature (25)..(26): n is a, c, g, or t
  misc_feature (32)..(32): n is a, c, g, or t
  misc_feature (49)..(82): n is a, c, g, or t
  misc_feature (85)..(108): n is a, c, g, or t
  misc_feature (118)..(148): n is a, c, g, or t
  misc_feature (160)..(586): n is a, c, g, or t
  misc_feature (588)..(634): n is a, c, g, or t
  misc_feature (636)..(655): n is a, c, g, or t
ctcctaggngnngngtagngngggnnggaggnattttcataaggaaaannnnnnnnnnnnnnnnnnnnnnnnnnnnnnnnnnagnnnnnnnnnnnnnnnnnnnnnnnnctctagaagnnnnnnnnnnnnnnnnnnnnnnnnnnnnnnngcttgtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnannnnnnnnnnnnnnnnnnnncccgtattaaatataaacggctcgcctgcccactgactaacttgaatggccgcggcat

SEQ ID NO: 15328 - DNA, 940 bp, Diabrotica virgifera
  misc_feature (737)..(737): n is a, c, g, or t
  misc_feature (809)..(809): n is a, c, g, or t
  misc_feature (872)..(873): n is a, c, g, or t
  misc_feature (881)..(881): n is a, c, g, or t
  misc_feature (888)..(888): n is a, c, g, or t
ggttcgcgatcagtgttgataaaacagaatatcagaagaatggcgacatataaaccaacgttgactatcgagaatttaaatccttgtatcaaggtgatggaatatgctgtcagaggacctttggttacaagggccggcgaaatcgaaaaagagttggaaaagggagcaagcaaaccattcaaggaagtcataaaagccaacattggtgattgccatgctatgggccaagttccaatcaccttcatccggcaagtgctggctttggtaggttatccgaaacttttagatgatcctcactttccagaagatgctaaagagcgcgcaagaactatattgaagggttgcaggggtagctctctaggatcttataccgattcgcctggtattgaagttatcagaagacacgtagctcagtatatcgagaacagggatggtattccaagcgattggcagaacattgtgattagtgggggtgccagtgacgctatcaaaaacgttctcaaactcttcatatgccgtgtaaatggaaagaaacccggtgtgatgattcccattccacagtacccgctatattccgcaactttatctgaatttgacattgaccaagtcgggtattatctagatgaatctaagaactggggactttctttacaagaactagagaggtcgataaatgaagctaaaaagcaatgtaatgtaagagctattgtagttatcaatccaggaaatccaacagngacaggttttgaccaaagaaaatatccaagagattgtcaagttcgcacagaaagaaaagctgttcattttgnccgatgaagtatacagcacaacatatacgaccccaactcacaattccattctttcaaaaaggnntatgtatngaatggngagaacctacagaagcatggagcttgccagtttcatgtcttgttcccaaggt

SEQ ID NO: 15329 - DNA, 927 bp, Diabrotica virgifera
  misc_feature (265)..(286): n is a, c, g, or t
  misc_feature (675)..(693): n is a, c, g, or t
gatttaggtagtaattataacctttgtcaaaatctaccccatgccgaaccgcgcttctccctggggatgaaacaaccccatcaaggggatgaaaaatttttcaatcaaaacaactatggaaatcgatagagtgaccaattctaagcaaaccttgttctataaattttttttgcaaaattgacactttccaagttgttagcgatctaaaccatgcactttttccttgaaaaaaactcacgccctacaaccgcccctcatgaatagnnnnnnnnnnnnnnnnnnnnnngaaacaatcattaaataataaattgtgactcataagaaaacaaagagattcgcgtaggaaagacatatatgaggcgtctagaagtcaagtggtacaagtgcaattttggtcaagttggaggtaagtacagaaatagatagtcaatacccattttaatgttgtggacaaaggatacaagtgaatttaaaaccagtagtgacatatatggatatttcacttatatctcttggcttccaaataagtgttagtcatacaggggcattcagaaaatatcccgacaaacgaagaccggagattcctcagacaattttaagacaatttaactcaattcatccagtccgaaaatgcttcctaagggagctagaggtctttaaagatggagtcttacnnnnnnnnnnnnnnnnnnncctatagaacgcttctattcagaaaaacgaaaactggtaaacccattcatcttccagagataaatcgattgcatcagttgcgaatctccagcaccggtcataggcgtccgttttggtagggcaagggctattctatcgcacaactgttttctcggtaaacattaagcacttctgacactgtaatagcaaattgtgagggcgtctagtactaaaggtactcttgattaagtcgct

SEQ ID NO: 15330 - DNA, 778 bp, Diabrotica virgifera
  misc_feature (13)..(15): n is a, c, g, or t
  misc_feature (20)..(20): n is a, c, g, or t
  misc_feature (23)..(24): n is a, c, g, or t
  misc_feature (26)..(26): n is a, c, g, or t
  misc_feature (29)..(30): n is a, c, g, or t
  misc_feature (58)..(58): n is a, c, g, or t
  misc_feature (60)..(61): n is a, c, g, or t
  misc_feature (69)..(69): n is a, c, g, or t
  misc_feature (72)..(72): n is a, c, g, or t
  misc_feature (74)..(78): n is a, c, g, or t
  misc_feature (80)..(84): n is a, c, g, or t
  misc_feature (92)..(111): n is a, c, g, or t
  misc_feature (131)..(131): n is a, c, g, or t
  misc_feature (171)..(262): n is a, c, g, or t
  misc_feature (292)..(292): n is a, c, g, or t
  misc_feature (431)..(431): n is a, c, g, or t
  misc_feature (438)..(489): n is a, c, g, or t
  misc_feature (492)..(508): n is a, c, g, or t
  misc_feature (557)..(557): n is a, c, g, or t
ctattaaacgcgnnnggganggnngnagnngaggggaaagtctataaaggcatatgantnnataaaaanganannnnnannnnnaaaagggnnnnnnnnnnnnnnnnnnnnattcccaggaaaagttaaantatgggttagaataaaggtgtttttatagtttaagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaagatgaataaaaaaaaagtagaatntttgttagagatttaaaaaagattaatgtagagtaagttatttatgaatttttgtggagtgtaaatatggaatagaattattagatgtagaataaattggagttttggatttgaagttttgaggaaatgggaaaatttnaatgaannnnnnnnnnnnnnnnnnnnnnnnnnnnnnnnnnnnnnnnnnnnnnnnnnnntannnnnnnnnnnnnnnnnagaattaggttttttaaaaaatagtggggtgatttttaataaaaatttntatgtataagaaagggtgggaagtaagggtaaaataaaaggatatattggtatagggtagagtttgtttatggaagtatttgttatatattgggaaaatagaaagtaaattgatggagtaggatggaatttgaagttaaatatggtgattgaataaaatagaagtgggtgattaaaaggaggatagaaggaaatggggggtatagtataaaatattttttt

SEQ ID NO: 15331 - DNA, 978 bp, Diabrotica virgifera
  misc_feature (2)..(44): n is a, c, g, or t
  misc_feature (50)..(72): n is a, c, g, or t
  misc_feature (263)..(336): n is a, c, g, or t
  misc_feature (341)..(406): n is a, c, g, or t
  misc_feature (424)..(442): n is a, c, g, or t
  misc_feature (451)..(465): n is a, c, g, or t
  misc_feature (467)..(483): n is a, c, g, or t
  misc_feature (486)..(504): n is a, c, g, or t
  misc_feature (519)..(539): n is a, c, g, or t
  misc_feature (677)..(726): n is a, c, g, or t
  misc_feature (731)..(839): n is a, c, g, or t
  misc_feature (847)..(887): n is a, c, g, or t
  misc_feature (895)..(971): n is a, c, g, or t
gnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnctaaaaa

SEQ ID NO: 15332 - DNA, 786 bp, Diabrotica virgifera
  misc_feature (13)..(13): n is a, c, g, or t
  misc_feature (23)..(23): n is a, c, g, or t
  misc_feature (31)..(31): n is a, c, g, or t
  misc_feature (56)..(56): n is a, c, g, or t
  misc_feature (63)..(63): n is a, c, g, or t
  misc_feature (79)..(80): n is a, c, g, or t
  misc_feature (83)..(83): n is a, c, g, or t
  misc_feature (90)..(90): n is a, c, g, or t
  misc_feature (100)..(100): n is a, c, g, or t
  misc_feature (137)..(137): n is a, c, g, or t
  misc_feature (176)..(196): n is a, c, g, or t
  misc_feature (202)..(202): n is a, c, g, or t
  misc_feature (217)..(217): n is a, c, g, or t
  misc_feature (223)..(223): n is a, c, g, or t
  misc_feature (229)..(229): n is a, c, g, or t
  misc_feature (235)..(235): n is a, c, g, or t
  misc_feature (398)..(398): n is a, c, g, or t
  misc_feature (534)..(534): n is a, c, g, or t
  misc_feature (580)..(580): n is a, c, g, or t
  misc_feature (598)..(598): n is a, c, g, or t
  misc_feature (633)..(633): n is a, c, g, or t
ccctcaaacgcgnccgaattggntcaatgtnctgtttcctctccctaagcagaagnttttttntggatttgtaaatttnnttnaagggtnaaataatgtnagtgagttgaaacttccaaaaaaagtagtgatttganaataatttgtgtaataatattaagaaatttaagattaannnnnnnnnnnnnnnnnnnnntaaggntatttttagaaaagnttattngatgtnatatgnattaaaagagaaagtagaggaaaagttgggataaatgattaaagttgggattgtaaaaaaagttagtttttaagaatgggagtagtatatagtaatagtagtaaaaaaatgtggaaatgatgttagaatgtgagtggatttttgagttagtgtaaataaggtnttgaatgtaaataaatataatattgatataaaagaagatatttttgtgagtttagaaggtggaaagattttttgtgttttagatatgtatggagaataaaaataaatttaggtggatttagattgtaaaaaatatnttaagattaatattgagatgggtatgtttaggtatagtaggattanatatggaattgtttgtgnaatagatttgtattaatgtgttatagaagaaattntatgtggtatagaaggtgttagtgtgtaattggatgatgttttgattggtggtagttgtttggaatatggaaaggaaattttaggtaaagtattaagtaaattatatgagtttaatgaaaaagtaaatgtagaaaagagtagattttttgaaa

SEQ ID NO: 15333 - DNA, 398 bp, Diabrotica virgifera
  misc_feature (274)..(274): n is a, c, g, or t
  misc_feature (285)..(285): n is a, c, g, or t
  misc_feature (360)..(360): n is a, c, g, or t
  misc_feature (365)..(396): n is a, c, g, or t
ttgatatgtttagaggtaaaaaatatgaagatatttgtaattgtagatagaatatggatgtatataatgttaaatgtgaagattatgagtagaaagatatttatgatgatgagtagttatgaattatgtatgataatggtgaattaagtgaagatttaaaagttagagatggtgaagttggtggtagagtatgggtagaagatggtgaaggaaaggatatattatgtattgtaatgaagtgttgtggtgaagaagttgttattgtagtaaaaanaaataatggtnttgataaataataatagaaggttgtaagaaagaggggttgagaaggtaggagtgagtgtttgtataatgaggatnaaggnnnnnnnnnnnnnnnnnnnnnnnnnnnnnnnngg

SEQ ID NO: 15334 - DNA, 763 bp, Diabrotica virgifera
aaagtattacaatgttcatcgatttatttactaatagtacttccgcaatttgtatttcaaaaagcttatttctatgatttgaatggtcgatgtcttgaacgcagcaagatcgggatagctgagtacctacgaaccgagaatgcttcaagagaaacttgatgagacacaaatcgtcgtgcatgtagcccagctagcaacgaatcgctcggagataccatcttccccttattacctcatataccctcctattcgacgcctgtgccttactatcgatcatgaattcatccacaacgaatacctactaactataacaagaactaacgaaaactgcaaaaaccacacagactaccttatggctttgggattttatgtactggatctctcggatatacatcttcggaatagtgaactacatattgaagactctgccataaaccaatgtatcaaatatgaatggctggtactccccgtcctgtcccatgtcgactagcaaatagaactagcaacagatgtaccggataaacctgttacactttggacatcttttactgcatacccgtgtcccagccttaccagatgaccaaatatattcttcttgcaatgctgtcgaggcaagcaatacgatacagcgatcatattgaagacatctgaacctgatggagagcacacttcttatataatgccaagtgaaactgactccctcataatatattctacactgaattgtgtccctggtacatccagtcactgtgtgaacaagctg

SEQ ID NO: 15335 - DNA, 616 bp, Diabrotica virgifera
  misc_feature (95)..(113): n is a, c, g, or t
  misc_feature (132)..(171): n is a, c, g, or t
  misc_feature (201)..(233): n is a, c, g, or t
  misc_feature (239)..(258): n is a, c, g, or t
  misc_feature (324)..(350): n is a, c, g, or t
  misc_feature (477)..(477): n is a, c, g, or t
  misc_feature (480)..(504): n is a, c, g, or t
  misc_feature (555)..(582): n is a, c, g, or t
agtatatatgtaattttaatttatgaataaaatgattaagaatagtattaggtttattaattatttgatttagattttgattaatagagttttgnnnnnnnnnnnnnnnnnnnaagattattataagattannnnnnnnnnnnnnnnnnnnnnnnnnnnnnnnnnnnnnnnaaggaagaaaattaatttttatgtaagtannnnnnnnnnnnnnnnnnnnnnnnnnnnnnnnnttattnnnnnnnnnnnnnnnnnnnngaagatatataagtttaaaattaagattatatttagaattatgattgagatttataatttatggannnnnnnnnnnnnnnnnnnnnnnnnnngataatttagttgattaaggaaatattatgattttattatgatttatagtttgtattgaaataattagaaatgtaattagatatggaatattagtagtaagtttaattggtaatataataggagganagnnnnnnnnnnnnnnnnnnnnnnnnngtggagtaatattatgaatatatatattagatatattatttattgtgaagnnnnnnnnnnnnnnnnnnnnnnnnnnnntatgtataattgaatattatgtatttgttgtttt

SEQ ID NO: 15336 - DNA, 418 bp, Diabrotica virgifera
  misc_feature (14)..(14): n is a, c, g, or t
  misc_feature (29)..(29): n is a, c, g, or t
  misc_feature (55)..(55): n is a, c, g, or t
  misc_feature (63)..(65): n is a, c, g, or t
  misc_feature (75)..(76): n is a, c, g, or t
  misc_feature (79)..(79): n is a, c, g, or t
  misc_feature (82)..(82): n is a, c, g, or t
  misc_feature (97)..(97): n is a, c, g, or t
  misc_feature (116)..(116): n is a, c, g, or t
  misc_feature (132)..(132): n is a, c, g, or t
  misc_feature (150)..(150): n is a, c, g, or t
  misc_feature (175)..(175): n is a, c, g, or t
  misc_feature (178)..(178): n is a, c, g, or t
  misc_feature (188)..(188): n is a, c, g, or t
  misc_feature (212)..(212): n is a, c, g, or t
  misc_feature (231)..(231): n is a, c, g, or t
  misc_feature (244)..(244): n is a, c, g, or t
  misc_feature (248)..(248): n is a, c, g, or t
  misc_feature (282)..(282): n is a, c, g, or t
  misc_feature (331)..(332): n is a, c, g, or t
  misc_feature (389)..(389): n is a, c, g, or t
  misc_feature (393)..(394): n is a, c, g, or t
agaaattttaggtngtttggttgaaatgnttgttgattggggttataaggtttanttaggtgnnngtttggattnnttntangaaagtggtggtggngttaaatgtttaggtaatntagagagagaaggatntgtttgaattgtaggagntgtattattttgtggtggtgatttntgnagatgtgttnagagtgatattgttggtattgtanaggtgttgtggggtttggnaaagaaatttggntaangtaagtagttgttttgagtagattgggttggatnattattgaaatatttaagagaattggaggagttttatgataaaaatttnnaagagtttatttttgttagaaataaagttaaggaaattttttaggaagaagatgatntagnngaaattgtgtaggtggtaggtaaa

SEQ ID NO: 15337 - DNA, 538 bp, Diabrotica virgifera
cccttcaccgcgtccgattctattctccaacttaagttcatcttttagtgtaaaaacatagtgaagcatcgcacctcgccaggcacattgctacgcacatcgcatcctcaaaaaccaattattttgttcttcaaacatagctaatataaggggcgatttctcatatcgagttcaactcaagtttaacctgaacttttagtgaactacagttaaacgtcgaaaacagtatttctcaattcccgtgcagacattgagagggtcgccactgcgctcaatttcaacgctgagaatcgttacgagcatgatcctcaccgaaaggttgtaaggcaatagttttgttttaagaatatccggcaatcttggacgacgggaggagataccaatgagaaatgccttcttagctcatgccgggaatgctaggccctgatgattatattgcacggtcctagaggctttaaccccaagaagctgagcattgcccctgctatgagacccgctattgatggaaagaatcgcataaatgcagggaccgacaaga

SEQ ID NO: 15338 - DNA, 929 bp, Diabrotica virgifera
  misc_feature (15)..(15): n is a, c, g, or t
  misc_feature (17)..(43): n is a, c, g, or t
  misc_feature (50)..(140): n is a, c, g, or t
  misc_feature (149)..(606): n is a, c, g, or t
  misc_feature (609)..(609): n is a, c, g, or t
  misc_feature (612)..(612): n is a, c, g, or t
  misc_feature (623)..(860): n is a, c, g, or t
  misc_feature (862)..(928): n is a, c, g, or t
cctccccgaggcgtncnnnnnnnnnnnnnnnnnnnnnnnnnnntttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnaanatttttttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnng

SEQ ID NO: 15339 - DNA, 254 bp, Diabrotica virgifera
ttaggaattatggaagagatggtagtaaagaaagagaaaaatgatttaatgatagtgaagatggtagaaagaattttagttatttgatgggtggaggagttggagttggtggagaatatggtgagaaataagtggtgtaaaaatttattagttgtatgagagaatatggtgatgtattggatttaggtaagattgaaattaagatttatgatatgattgaagggaagtgtgttagatttaaatggagaggtaaa

SEQ ID NO: 15340 - DNA, 680 bp, Diabrotica virgifera
  misc_feature (373)..(394): n is a, c, g, or t
  misc_feature (609)..(628): n is a, c, g, or t
cgggtgttgttctattttagaaactagttagagcttaaaagactgcgtaaaactttgaaagatgtgcgattgtcccatcgctggtgtgattgcctcacatgaggcctacagaagttggattatttttaaggaatgcaagactgaaagtggtacagccagctcaattcaagccggcgtggaaagttcctctacagaaaatctgcacgacaaccaagatactagtaatataaaagtccttctcgattcactagatccacatttgaggcctgtaacaccagactattccgatcctcagtcagtagctctgttaaacgaacatattcagttagcagaagaatattggaaggtccaaaccgaacttgtcctcttaacnnnnnnnnnnnnnnnnnnnnnngccgcaaaagaagaggacgaacgaaggaaaataaacctggagcacctccaagaagaaaaagaatcgttaatgttagccagagacttactgagacagcaaagatcttcctcgccagcaggtgattcgtctgaaggttcagcagaaaattgggtcatcgtgccaaggagagaacaacagagttgacgttattattattgttattatttattgtaagnnnnnnnnnnnnnnnnnnnngtattaaattcataaaaattgtatatattttaagatacaacttaatttttgt

SEQ ID NO: 15341 - DNA, 458 bp, Diabrotica virgifera
  misc_feature (2)..(113): n is a, c, g, or t
  misc_feature (115)..(144): n is a, c, g, or t
  misc_feature (146)..(165): n is a, c, g, or t
  misc_feature (171)..(249): n is a, c, g, or t
  misc_feature (251)..(267): n is a, c, g, or t
  misc_feature (279)..(303): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnncnnnnnnnnnnnnnnnnnnnncatgtnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnngatatttttaannnnnnnnnnnnnnnnnnnnnnnnntgactagtcctttcttacataacaatgacgattgaacactcccccctcttgccgagcgttctcagggtccggaactgttattacctactgtacacattaatgccgactcggacaagatacttacacatattccacccactagtgacgaggatgta

SEQ ID NO: 15342 - DNA, 962 bp, Diabrotica virgifera
  misc_feature (13)..(14): n is a, c, g, or t
  misc_feature (17)..(17): n is a, c, g, or t
  misc_feature (24)..(24): n is a, c, g, or t
  misc_feature (27)..(27): n is a, c, g, or t
  misc_feature (45)..(114): n is a, c, g, or t
  misc_feature (117)..(159): n is a, c, g, or t
  misc_feature (168)..(625): n is a, c, g, or t
  misc_feature (628)..(628): n is a, c, g, or t
  misc_feature (657)..(657): n is a, c, g, or t
  misc_feature (662)..(684): n is a, c, g, or t
  misc_feature (686)..(686): n is a, c, g, or t
  misc_feature (693)..(694): n is a, c, g, or t
  misc_feature (713)..(714): n is a, c, g, or t
  misc_feature (716)..(716): n is a, c, g, or t
  misc_feature (747)..(797): n is a, c, g, or t
  misc_feature (800)..(840): n is a, c, g, or t
  misc_feature (843)..(864): n is a, c, g, or t
  misc_feature (882)..(954): n is a, c, g, or t
cttttaaaggcgnncgnggaattnatntatattggtattttcttnnnnnnnnnnnnnnnnnnnnnnnnnnnnnnnnnnnnnnnnnnnnnnnnnnnnnnnnnnnnnnnnnnnnnntcnnnnnnnnnnnnnnnnnnnnnnnnnnnnnnnnnnnnnnnnnnnttgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnaagatttttttgatgtgtttattaaaaanatgtnnnnnnnnnnnnnnnnnnnnnnntnggttggnnaatgattaatttgaatggnngnggtattttgatagtggtaaggtagaataatnnnnnnnnnnnnnnnnnnnnnnnnnnnnnnnnnnnnnnnnnnnnnnnnnnntgnnnnnnnnnnnnnnnnnnnnnnnnnnnnnnnnnnnnnnnnnaannnnnnnnnnnnnnnnnnnnnngagaaagaacttatagannnnnnnnnnnnnnnnnnnnnnnnnnnnnnnnnnnnnnnnnnnnnnnnnnnnnnnnnnnnnnnnnnnnnnnnntggggggg

SEQ ID NO: 15343 - DNA, 489 bp, Diabrotica virgifera
  misc_feature (13)..(13): n is a, c, g, or t
  misc_feature (23)..(24): n is a, c, g, or t
  misc_feature (28)..(28): n is a, c, g, or t
  misc_feature (55)..(55): n is a, c, g, or t
  misc_feature (74)..(74): n is a, c, g, or t
  misc_feature (76)..(76): n is a, c, g, or t
  misc_feature (78)..(78): n is a, c, g, or t
  misc_feature (96)..(96): n is a, c, g, or t
  misc_feature (104)..(104): n is a, c, g, or t
  misc_feature (136)..(137): n is a, c, g, or t
  misc_feature (318)..(318): n is a, c, g, or t
ctctaaaacgcgnccgagctgannagcngagggggcccgtcctaaaaggagcgancaaccacaaaagacaacangngngacgacgagggggcggcncaggacgncgacaatgtctccgggaggcgcaaagcagganncgccggagaagacgcaccccgagccgacagccccgcaaacggcggacgcccaaggcaccaaggcgacagggccggaacgggacaaaaagacccagacgaaggagaagaagcccaaagcaaaagagggagccacacaccgaaagaccccaaagaacacggaagcagcaccaaccgggacganacggaaaaaagcaggcaacacacccccaacaaagaacaccgagaagccccagaagaacacccagaccaccacacagaagcaccactcaaccccaaggcaaacagagaaaagacgacccaaagcaaggaggaaaccaacaacacacccgccagggacgaagccatccaagcc

SEQ ID NO: 15344 - DNA, 586 bp, Diabrotica virgifera
ggtacactacagagattacttacggattgagtaccctttggctatatttataacatcgaccgaaccatcataccaaaagcaacagtgaactgcgtaacgagatccgcatatatggtcggctactaaggaatacaggctgacacaatgaaatgtgaccaccaacaactgaacatcccaaaagatggcgatcgagatgaacaatcgcttgagtgaaaaatatgataggacaagaagaggaggaacttatagctgcaatgcacacatgatcgtgggtgcatacttcacaagacacacagcgaacagacccggccgtgctgatctatttttcaaaacacctagggcacaaagggaacctgccatctaagaggttcactaatagcacatgggaggacaagttactactagcgtcaatgatatcctcgaaagaaatcatgcacctgctctcatcacatgacaaaacgacgagagtgctctcacaaacatcctaaatctggaagctacatttaccacaaagaacaaaaatgtcatcgaaggatacgaagacggctcctacttcgaagactaccatcatgtggattacctgaac

SEQ ID NO: 15345 - DNA, 792 bp, Diabrotica virgifera
ataacatctataaaacaatttgctgtaaaattatatgctggaagatcaattttataataaaaacacaaatatttatataagtctacagcatagaagttgatcctaacatccaatttgcatttataagtgtcaatctgtgagtgtagtgttaagaagtaccattatgtcttttttgtgctagttgtttcttacaaggtttttttgtaaagaattattacgaactttttgctattttcgttatgcttgaatgtggcctgccccataagagatagcgatggcgaatttgaactttacaagaaacattggaggaaacaatcttggaagaacaagtgttagtttcggtagtaattctatgtctggacatgttactcctgttctcggacaaagaataccttcggagcgacgagcccttcctactatgggaaacgcaaatcaaatgggtcacatgagtaccttaggaggttatagttcctttaactcggtttttggttctggtgataccaacactccatctcttttagactttaacgaatttccttcacttacaaatcgaaactctggtgataacctgccgcagccaagtccaatgcccggtggtaagccctatgtaggaatggtcaaacaacccacgtcggaatccagcgaatttacaatgtcgtcggaggattttcctgcgttacctggtacgcagaatagggaaggagcgtcgcctggaagtaatgcttcgggagacaaaggagtgagtggaggtgcgggagatggtgtgaattcaagaagaaaggagacaagagt

SEQ ID NO: 15346 - DNA, 785 bp, Diabrotica virgifera
  misc_feature (19)..(19): n is a, c, g, or t
  misc_feature (24)..(24): n is a, c, g, or t
  misc_feature (28)..(28): n is a, c, g, or t
  misc_feature (32)..(32): n is a, c, g, or t
  misc_feature (38)..(43): n is a, c, g, or t
  misc_feature (330)..(355): n is a, c, g, or t
  misc_feature (371)..(393): n is a, c, g, or t
  misc_feature (696)..(713): n is a, c, g, or t
  misc_feature (752)..(771): n is a, c, g, or t
tcgttaggggtatcataanatatnaggnatgnagactnnnnnncattttcatttttatctgtatatttcacagaaactgtttgttttgtttcatagtaattgaaattgttcagcaaaattttccacggcattggattaggaggagaagcatcatcaagtggcctcctcagtctccagatttgactcttctggattttttgtgggaacttttagtcaaacagtgactggtcggtgggtttttcaaaaatattgccctagtttttgataatgtcgcccttgatattatattgatttattatgtttacttgaaatgttttttcaatctttatnnnnnnnnnnnnnnnnnnnnnnnnnncttctctatttttgcnnnnnnnnnnnnnnnnnnnnnnncattcatagatattctgaccaatagaaagataaagaaataaaaattacaccgataatttttgataatttgctgtcgtcaagtaatatgtcagatgcactttgtgacattaataacaattaatgctttacaacttgtcacaaagaacaccaagaaacaagtttagcaaatatttaagtgaagatatcaataaaatattgttctgaagctatatccctgtggcatttttgtaatcaactattctaaatgggaaataagccacaatttaactaaaaaaatgattttattaatgtttaactttttgnnnnnnnnnnnnnnnnnngaattttgacacgtcatgcaatttgaactcgaaacgttnnnnnnnnnnnnnnnnnnnnacgcaaacattctt

SEQ ID NO: 15347 - DNA, 808 bp, Diabrotica virgifera
  misc_feature (50)..(67): n is a, c, g, or t
tgattcttatgatttaaccggagtatttttagatctctcgcttaattggnnnnnnnnnnnnnnnnnnaagaatattgttatcttcccagcaaaacaaaatctaacatgacggtgttggcgtatgaaaatctatttaaaggcactctatttcagttacttgctgttttatcaggcaccttaaacgcaatcagtgatggaatgcaatatggatggactgctccagtgttacccattctccttggtccggactcgcctgtgccaattacagaatgggaaggtgaaatgttggaaactttcttatgggtaggatcgttgtcgtgcctaccattaactatgtatcttgttgacaaaataggaagaaaaaattcgattttattagcagcagtactaacactaacagtgtgggtcattacagctttagctccgtctgtagaatacctgtatgttgcgaggtttttagcaggaacggctagtaatacagcttatgtctcaactcctatgtatatagctgaaatagctgaacaaaaaattcgaggatttttgagcagtcttatttacctcatgatgttactcggtatatttttgatttatgctgtagcaccctatattccttattacgcccactgcactctaggtgcaattttggcttgtttagaacttggtatctttccatttatgccagaaagtccttatttcttagtttttaaaggaaaacatgaagaagctaaaaagtctttagaatggttaaggcctgaaggtgccgatgtgggaactgagcttaatgaaattaatgcagcaattgaaagaa

SEQ ID NO: 15348 - DNA, 508 bp, Diabrotica virgifera
  misc_feature (48)..(71): n is a, c, g, or t
cacagcgacgcgcactcttcttttttgttttatggttgccagacctgnnnnnnnnnnnnnnnnnnnnnnnngtaatcccgtgccatccgacaatataatatgagaatgtagctatatgcagcattcgacagcgcaatgcaagataatagcaattgggactctgctatttgtggatatgacccaagttataatagaatgtaagttgcccgcctttcctacctaagttcactacaggaacccaggatacatttgtggaaacatattcacccctatatggctatcaacccctagaaaaactggatatgtaccgtattactactacatctaactgcatataagaataacttgatgccctccggctatccaccaaagtgatacctgagtactggcaatctttatatgatgatgaaattgcacagaatgaattttcacttatatatgcttttgatgacataacggtatcaagtgataaatatagcgccaatctgtctcgaattcgcacatttgt

SEQ ID NO: 15349 - DNA, 966 bp, Diabrotica virgifera
  misc_feature (56)..(75): n is a, c, g, or t
  misc_feature (91)..(108): n is a, c, g, or t
  misc_feature (336)..(351): n is a, c, g, or t
catctaagcggaaaaatgtacctttagaacaagatattcaaaataccttatttgcnnnnnnnnnnnnnnnnnnnnaaatacgtcttagaannnnnnnnnnnnnnnnnnatgtggatgcaaatttatccaggaaaattctatcagctgctcgttcccagcaaagagaactagaagaaaacacaccccagcagtcaaaaaataaatttgtaagcttagatgccatggattcagacgaatctgatgaagcagaagatgacactgttgacgatgcatattacgaaaatattgaaattaatgaagatgatgaaaaagcaatcgatatgttcatgagcaaannnnnnnnnnnnnnnngaactctagctgacattattatggaaaaaattactgaaaaacaaactgaattagacactcacttcagtgatgctggttcaatgcaggttcaagatctggatgtgaaagttaaacagatgtatgaaggtgtcagggatgttctcagaaaatatagaagtggaaaactaccaaaagcatttaagataatacccaaattgaaaaattgggagcaaatattgtacattacagacccacccacgtggtcagcagctgcaatgtaccaagctactagaatttttgcatcaaatttgaaagaaaatatggctcagaggttttacaacctagttctcctaccaaggataagggatgatttaatggaatataaaagattgaactttcacctataccaagcactacgaaagtctttgttcacaccaggagcttttatgaaaggtattttgttgcctttattggaaagtggtaactgcaccttaagagaaaccataataatagggtctgtgggtgctaaaaattctataccgatacttcatccatctgcagccccttctaaaaattgctgaaatggattatactggagccaacttctatattttttagaaaattcttaaataaaaa

SEQ ID NO: 15350 - DNA, 811 bp, Diabrotica virgifera
  misc_feature (5)..(801): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttgat

SEQ ID NO: 15351 - DNA, 815 bp, Diabrotica virgifera
  misc_feature (768)..(768): n is a, c, g, or t
gcattgatattaatcataaatttaatatccttacaccgaggatatctgactagaacaagtcgataacattaagatattagtaatgtaatcaagcaaaaaagcagtacgattgatactattatgctataaaatgttctaataggttcagctgttataccgttcaaacaagaaatactttcgttaacacaatacatggagattgttcaatagaaacataacataaatatattcaattcaattcaaatctattcctccatagagtagaatggaaaagtacttcatggatagtaattcgaaaaacaatatactttaagggtactcaataaacaataaatatatcttgcaaaattacaatacaaagagagcgtatattgccatctttgcgatataataaatttactaaattcagtaatgaggtattggaatctggaaccaataatcttgtaaatgggcttagtaacaatttcagtaccatcagaaacgaagttcattgatgaaatgtttagaactgagatataaaaagttgaacactttaaagaagaaatgtgtcctgtacaataaaaagggtagatgatactactactaaatattacgcgacaaatgacccctttcataatattcacagagaaaaaatgaggacaatcttattcatcgtaacaggcaaatattaaagaacggcaaatttagaaagacaacgacaaaactggtttacgcagtagaaaataattcaactaaagaccgaatatatcagttggatatctatgaatncataaaacagtgaagattacagcttacttaatggacatatatatttt

SEQ ID NO: 15352 - DNA, 917 bp, Diabrotica virgifera
  misc_feature (150)..(178): n is a, c, g, or t
  misc_feature (209)..(226): n is a, c, g, or t
  misc_feature (322)..(345): n is a, c, g, or t
  misc_feature (707)..(751): n is a, c, g, or t
aagctcccgtatgtgcaaagtattggaaaaccgttctcaacaagatgaagaacgtatggaccaactcaccaaccaattgaaagaagcccgtctcttggctgaagacgctgacaacaaatctgatgaagtatcccgtaaacttgccttcgnnnnnnnnnnnnnnnnnnnnnnnnnnnnncgtgtaaagggtggagatgccaagatcatgnnnnnnnnnnnnnnnnnnaaagtcgtaggtaactctctcaaatctctcgaagtatccgaagaaaaagccaaccagagggtagaagaattcaagaaacaacttaagagtcttacnnnnnnnnnnnnnnnnnnnnnnnnacgtgccgaattcgcagaaaagaccgtcaagaaattgcagaaggaagttgacagacttgaagacgaacttggaataaacaaggacaggtacaagtcccttgccgacgaaatggactccaccttcgccgaacttgctggatactaagaaaatctcttcatcttcgttcgccacgatttatcatctagtcatcatggtgtgaagaataattaactaattaatttatatattgtatttcagacattgtgaaaagattcagaaagtgtcacactaatttgtgagctttgatgtgcccttttattctagtctattaagcatctaggaagccgttcagttgatttaaataaaaaatcttgtataatannnnnnnnnnnnnnnnnnnnnnnnnnnnnnnnnnnnnnnnnnnnngccggtgaacgtgaattctctggtttgggtaactgcttagtcaaaatcttcaaagctgacggcttgggaggatatatcgtgggattggtgtatcagaacaaggtatcattatctaccgggccgctttcttcggtttccacgatactgccaaggggatttttgcccg

SEQ ID NO: 15353 - DNA, 839 bp, Diabrotica virgifera
ggaagaaatcacgatcctcagtaatggggaaacgacaggagagagatctttggtcactgtaaatatttcctcttgaaagttttactgtgtcatctctcgagtatttggatgacaacgggatttgtccaaagtgtttaggcaaattgggggggggttgctggtttttaaacattttgtcgtcagatttcgttggtttcatgttttcttgaaaaagttgagtgacagattttttggtttatagttttgatccacatgggaataatatacgagtataattcacgaaaaagttttttgagagatttcaagtcgaagtatgcaataggaaaaaagttatgtgactttgtagactagtggcactcttccaaaaaaggcttatttctcgagatactgagcacggtgtggtaaatggctaattctggtcttactttgagtttttgattgtgctgacaacgaatataaggatttgctgccaatattgaccgtagatggtcgtcaacaaccgaattccccccctcacaaaagacagtaacttcggccccgtgtttcttaaaagaaaaacgggcaaaatctggatttgaaacgaaaagccttttgtttggaaccccgcgtactggcgccccctggtaatttttctgttgcgcaatgatttctgtgtgtaaattatccctactactaccacccccgcctctcttctctccgcccctgtcttcttctcccttctcaccggaacgccccaatacccccccccccccaaatccccatctaccccccctactaacatcttccatgcgcccccccccctcctttcggccgtccccccccctctcgtatttcttttt

SEQ ID NO: 15354 - DNA, 838 bp, Diabrotica virgifera
  misc_feature (45)..(88): n is a, c, g, or t
  misc_feature (699)..(720): n is a, c, g, or t
aagaatttacgtggacgggaaaccgtttggacctcgaaaactgannnnnnnnnnnnnnnnnnnnnnnnnnnnnnnnnnnnnnnnnnnngttttgtcaacatccgatgttgatttttcgtgtatcagtgaaagtctaaaagtgaatgatgtgatttgtttagtgcgagctcattttttgtggatttctatttggattgttggtaataacagatcaaagggatgagtgaatacgaccgaatacgaagggcttgtttgaaacgtggggaactatgggaagatcctgattttcctgcgtcacaatcttcagtattctatcaccaaactccaccattccagttcacatggaaacgaccaaaggaattgtgtaacagaccaaattttatttaagatgctcctacttctttcgatattagtccaggcaaaatgggagataggtggctggtatcgtgcctgggcatcctctacctcaacaaaggcttattttaccgagtagtacccgccgatcaatcgttttttggcgaacagtactgcggagtgttcagatttcgcctgtggtggtgcggagaatggactgaagttctagtcgatgacagattgccaaccgttcacggaaaactcgctttcctgcagtcacataccgacaatttttggcctggtctgttagaaaaagcttatgcaaaactacatggctccctatgnnnnnnnnnnnnnnnnnnnnnnattggacggtctagcagacctcacggggggaataaccgaaaacattcctcttcgacaagacaccaattcgtgcgcgaggttactatacaaatttactggacatggacctctattcgtg

SEQ ID NO: 15355 - DNA, 213 bp, Diabrotica virgifera
ccttaaatgaatagacgccgacgaaaacaaggacaccccgccccttttatgtttctaccgacaaaggaataatttaagtataatttttatgatttagatgttacgaggaccaattttcaccttttaaatgctttgaagaggctaagagtaatatgagatatatcagtaagaccctgctagatgtgtacaggcctgacgaaaatgacagcacaa

SEQ ID NO: 15356 - DNA, 1136 bp, Diabrotica virgifera
  misc_feature (8)..(45): n is a, c, g, or t
  misc_feature (47)..(601): n is a, c, g, or t
  misc_feature (642)..(666): n is a, c, g, or t
  misc_feature (736)..(757): n is a, c, g, or t
  misc_feature (814)..(831): n is a, c, g, or t
  misc_feature (840)..(860): n is a, c, g, or t
  misc_feature (882)..(978): n is a, c, g, or t
  misc_feature (980)..(1022): n is a, c, g, or t
  misc_feature (1024)..(1062): n is a, c, g, or t
  misc_feature (1122)..(1134): n is a, c, g, or t
ccctctcnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggccacatttttttctcctgtttatttaaaacatgtcnnnnnnnnnnnnnnnnnnnnnnnnncccctgccccctgaattaatttgaaatggccgccggaattttgacccgggcctaaggtagccataatccnnnnnnnnnnnnnnnnnnnnnnctgcgaatggaggggcgggtggaaaaaaaaactgccttttttttcatttatccaccnnnnnnnnnnnnnnnnnnctaaaaacnnnnnnnnnnnnnnnnnnnnncgaaaagaccccccctcaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnntnnnnnnnnnnnnnnnnnnnnnnnnnnnnnnnnnnnnnnncccccccgcgcggacccacccggccactttttctttttgctggagtgcctcaccccccannnnnnnnnnnnngc

SEQ ID NO: 15357 - DNA, 805 bp, Diabrotica virgifera
  misc_feature (715)..(746): n is a, c, g, or t
  misc_feature (757)..(779): n is a, c, g, or t
aaaacaacaacatgataaatgtttatatcaagttttagaaagagctaggataaataatgtcaaatttaattatgaaaaatgtagttttggtgtaaaaaatgtaaaatttttaggatttaattacaataaagatggtcaaagtgttgatagtgataaaattaaagccattcaagatatgaaaaagccagaaaataaaaaagacatacagagattattaggaatgataacgtatttgtctaaacacataaaaaatttgtcagacttaaccgcacctcttagggaattaattaaagaaaatgtagaatggcattggtcacataaacatgatgaatgttttagtaaaattaaggaaataatttcaaaaagcccagtattaagacattttgatataaatgaaaagtgtttaatatcggttgactgttcaaaagactcaataggagctgtactcttacaaaaaggtcaaccagtagcttacatatcaaaggctttaactttaacacaacaaaattatgcacaatttgaaaaagaaccttcttgcagttctgctgacatgtgctaaattccctatctaatcttcccccctcatcctcatagacgcccgccactcctcccttattttctttctcctccaaacctttttcgatggaacttttctcctccgaccacgaaaatttaccttcctgactaacctttccccctccctccaaacccccannnnnnnnnnnnnnnnnnnnnnnnnnnnnnnnttcctcttctnnnnnnnnnnnnnnnnnnnnnnnccccccaccccggacctgctccttcc

SEQ ID NO: 15358 - DNA, 897 bp, Diabrotica virgifera
aatataataggtgaatatcagtgcggatttagacgaggaagaagcacaacggaccaaatattcgtaatcagagaattacaagcagaaagctatgaacacaacctaccaacgatagcgctattcatcgatttccagcaagcgtacgatagaataaagaggaagaatttaaagcaggcgcttgaggaattgggagttagcagaaagttacgcaacatgatacatattacgttagaaaatacagaaaatagagtcaaaataaacaaccaatcatcagacacatttatagtaaatgaaggagtaaggcagggtgatcctttgtcatcattactctttaacttatgcctagaaaaaataatgcgagaagcaaaaattaatagagaagcactcctatatcaaaaacgacaccaagttttggcatttgcggatgatgtggtgttgcttgcaagaggaacaaaagagctacaggaaatagtacagagaatagtaaaagcagcgaagaaaatgggactctacataaatgaaactaaaacaaaatgtatggaatggacagatggtcagttcaggaatggacaaaagcttaaagtagaagtagaagaaggaacatcatacgaattcgaaatggtagaaagatttacatacctaggagcaataatatcacgtaaaccgaatattaaagaagaaatacaagctcgaataatggcaggcaacaaaagtgtacatgcgcttaatggaatgctgaaaagcaagtttttatcaagaaaggcaaaaatacagttatacaaaacaactatccaaccaatagtaacatactgcagtgagacatggacaatgacaaaaaatgaacaaagtttactggagatctgggaacggaaaatcctgaggaagatatatggagga

SEQ ID NO: 15359 - DNA, 717 bp, Diabrotica virgifera
  misc_feature (19)..(54): n is a, c, g, or t
  misc_feature (57)..(77): n is a, c, g, or t
  misc_feature (109)..(131): n is a, c, g, or t
  misc_feature (174)..(201): n is a, c, g, or t
  misc_feature (434)..(454): n is a, c, g, or t
ccttcctcccccttgtccnnnnnnnnnnnnnnnnnnnnnnnnnnnnnnnnnnnnacnnnnnnnnnnnnnnnnnnnnnggtaatataaatactgagtaggaataaatgtnnnnnnnnnnnnnnnnnnnnnnngagaagactatatttgtattataattataaaattagccatagnnnnnnnnnnnnnnnnnnnnnnnnnnnntacggggggtccgattaagtcggcaccatatgggaaacttttttagtttgatgaaataagttattctttgtatgtaaatgacatactcttaattcttaacgataaaatcattggttttagagatatttaaaattaaaaacgaagaggcataatacattaatcaaaataacagtgccttttcattatcttcagatatctctaaaactaataactttaccgttatgtatgaagannnnnnnnnnnnnnnnnnnnncgggataaccccattaacagctaaaattcacaataaaactcacgattgagcacataaataattccctatagtataaaatcgctaattaacgtccactacccaccacaaaaaaaacaatcacgtgtaccaatattactgtccatctaatttactcaccgctgtacatcattatctacgttagagacctaggtcgacattgctgcccaattacaaaaactccttgcattcattttacatcaaattctatcacacactttttgcgg

SEQ ID NO: 15360 - DNA, 748 bp, Diabrotica virgifera
  misc_feature (719)..(738): n is a, c, g, or t
gtttatttcctctctccaaatttcaatattataagtaaaaccgttcaaaagttacgagggggggggggtacggacttttgactagcactgtatataataatatgtgttaaatctcataggtcatttttagggagaatgtgatttacaccatttgacttctgaagcatccatatgatcataatattgattgagattttgagcattacttaataacttactatactaatttaattgaattttgtttaattttaattttggtttgcttctttttaacgcaaccaatgcgttgtaaaggttgatgttatacttttgtaaaaatggtatatccataaaataaataaataagtaaatataaagtaaatgatgaaaacgaataaatttctgacacctcttcagaaataattccacactggttgaaacatatttattagtctgactcgaaaagactaattcgattcttgatgcagcaaattatgtagctagacttacttatgtattcttcttttttgttcagaaataaagaacaatgccaggtgggttagttttcggaaacagcataagcaggaagaacactgtacagttttgacctgtgctcgttggtgtgaagattgtagtaaagactacaattacgagatttttcctactaatgcacctaccatcaattgatttcgtctggaaataaagaacaatgccagttggggtagtttcctaaacagcgnnnnnnnnnnnnnnnnnnnngccaattttg

SEQ ID NO: 15361 - DNA, 812 bp, Diabrotica virgifera
  misc_feature (29)..(29): n is a, c, g, or t
  misc_feature (32)..(32): n is a, c, g, or t
  misc_feature (370)..(398): n is a, c, g, or t
tgtcggtggaaacgacatcaaagaacgangancaccttgagcttttttcgacattcttcggggcgtccaatgcaagtgtcagaataaattttggaagatgtggggcaggtggttttacttgttctacctatcccaaaactaatacgttggctgtatattataactgtgttggtgatgatgtcagtttatatatcaaccagttcagcagtccatccaatatcgaaactcttcttattcaaaactgtgtgaacctaaccatatcttttagatgtacaggagaaaataaaaacatactaggtttagtagtaagaaacgttaaacggctaaaaattgaaccacaacagtacacgtcccatgtcccaacatcggnnnnnnnnnnnnnnnnnnnnnnnnnnnnngaaattccgaaagatacttttgctcaaatccaaaaaaccacacattcttatgggtgcatcattccgaaaaaggatttttacgccctctcggttaaaaacgttacaatagacactgtaggatcccgagcttttcaaatgcctgaaaactttggcaattttacttttcccgatggcaaaataaatagagtacaaacattcaagttctttgggtaaattagagaaactagctcaggttctaatagaaggtaggaaaatagaaggtgtgggacctcttgtggttttcagcgcccccgcaaccacctctaccatcaataacaatacagcccccctgctatcgcctagtcgtgccactaatggggaaagggcacaaatttttttttctaccacaattacagccaacccctctctttcctt

SEQ ID NO: 15362 - DNA, 767 bp, Diabrotica virgifera
  misc_feature (506)..(523): n is a, c, g, or t
gcaggaccagtttttctacaaatgcgggttataataaatattgtttcaagttcgtagttcgtttgtgtagttcgtttatttaataaatttgtgaccgtgtttccaggttttttcctaatatgaatctacctgaatctgatagtgaagacgaactaccccccggctgggaggaaagggttacagtggatggtagtgttttttacgcgaatcatttaacgaagaatactcagtggactcaccccagaacaggaaagaaaaagaaggtatcaggtgatcttcctttcggttggcaaagatgtgttgacaaaaacacaggaaaagtaatttatgtggaccacgaaaatcgcagaactacttatacagatcccagattagcttttgcagtcgaggaaaaagaacatgtcaacgattacaggcagagatttgatgcttccagcacagcactacaagttttacatggaagagacctaaatggcaaaacagccttagtgacaggagccaatgcnnnnnnnnnnnnnnnnnntgcacggtccttagccaaacatggttgcagtgtcataatggcttgtaggaacttagctgctgccgaagaaagctatcaatcaaatcagggaagataagccagcagctggtgagaactgtatagccatatatctggacttaacttcattgtcatcagtggtacagtttgccaacactgtgtataagtaatttcgacaaaatacacatgttgatcttaaaacgcaagtgtttttggttcttccttt

SEQ ID NO: 15363 - DNA, 1181 bp, Diabrotica virgifera
  misc_feature (1115)..(1143): n is a, c, g, or t
ccgtatccgtcaaaagcttactgtctagagaccagaagggtgacttgatcgcaggtatatacttcaagttgttgcagaatggagacgagtttaccatcttctatcaaaacatgggcaagcagcgaataaaactaaggttctccgattttatgaaaccggagattgacaaaggattactggagaaaatctcaatatgtaacgaacagctgaatttaccagagaacaagttactgaacatcatccggacatctggcacaatattgagagatacatcgttcctgttacagttactggacgtggaccgttgtattagtattttgtcggctaacaactaaactccatattatcttacatttcttttaccttcagccttcgcttttatttctcccaattcttatttaacttagttttagtcatgcgtttattaaacaaatacatattttattatgaaacgcacagaaacataaatattttaatcttttaaacagttattgagtaaatttagttttgtagttttagctcttgtttgaaattgacatttatatattttactttatgtttctgggcacttcatacaaattaaatatgccgaaatcgtgtacctatattatggaacctcgctatatttaatcaatatttatcatgttttgttgcaatctttgtaaattttttgcccacttatttttgcacacttctcggacaacacgcttactaaactttaaaaaatcggctttactcagtgagttgtttcaggaatttatatgctcctctgttaccctgattgaaatctttccccattttttagtatttggtcgttttcatatctcctcttctttcttctacatattgtctgcctctcttcgttcttcttcagatttttcgcgcatttctcgtgtttctcctttgatatactggacgtataagtgctttcttttcttttgtctattggttggttatattcttcatccaactaaagctcttttcttttgatgtggtttaatttccatcactcttttttttttcgtttccccatggcatccccctacttcttattccattctttcttggatcattcccccccccttggggggagagagggtccccaattccaattnnnnnnnnnnnnnnnnnnnnnnnnnnnnngtggattttttctgggggtcttattttctttccccccc

SEQ ID NO: 15364 - DNA, 56 bp, Diabrotica virgifera
  misc_feature (33)..(54): n is a, c, g, or t
caacaagcgggaaaaaaccctttaaaaagtttnnnnnnnnnnnnnnnnnnnnnncc

SEQ ID NO: 15365 - DNA, 985 bp, Diabrotica virgifera
  misc_feature (299)..(317): n is a, c, g, or t
caatcctctcctctgcgtgaaatcggcgagctttcttctttacatgtcatacttccttgagagttgcaatcctcaggactagcttctttgccccttctgttctctaaaaggtagcctcctagctcacttttcgcaggagtcaggcgccctagtacctaaactgttttcttcatttcttgttttcatggttttagcaaggttttttactgctcaatgcacttccttattcaaactctcctcctgtattagttgtatattgttgtcgttatgttacctatgattttctttcacgatgcacnnnnnnnnnnnnnnnnnnngcctatcaacatgaagttacttgttttctgcaaatataggatgattttcgaaaaaatttatcagagaaacaatttggttatctcgcattaatcgtgtttcgtggtccaaatacacttattttcccacaacttctatgggcgacttctcgatttctattagctcattggggaagaggttcgtcaccatttttgttttcccatagtttgtttatgaaaggactctctccgttacctgctgtaattattgttgtagcataattatggcttctcctaagtcatctgtcgtgagaacaatgtcattggaatatctgagatgatttagtttctttccatcgatgttaataacctttgagtcgcaccctaatccttaaaatgcgtactccatgactgttataaatagttttggcgacaaagtatctccctgctgcactcctctgtcaattttcatccttctcagtactacatccttatgaaggacaaaagataagtggagaaacttttatataggtctgttatatcgttaaattttcttttggttgttttgtaatataaattagaaaataaaagtaaaaattcttgacatttttttttggaaacaaggatattataaccagtggaactggggatcgtctatggggtggatttcaaaattaactcgaaaactcatc

SEQ ID NO: 15366 - DNA, 627 bp, Diabrotica virgifera
tcttgtccgcttaagccatacgctaaataaatacaatggggctagacacctcaaaagacattctgaccaaagaacagtagggatggtatgggaggaagtcccaactggaagaagaacacacggacgccctcgactccggtagcgagaaaatatagcaggagacctgaaagctatgggcgtggagaattgaatgggggttgctcaagacagaggagagtggaggcatgttgtagagtcagctaaaacccacgaaggattgtaacgctactaagtaagtaagatctctcatgtgaacaggtgaatcctgcaatagtcttgtagaaagctgcaccagaagctagtgcaccatgttttaatataatcgctggataacaagtcatcaggctagtagagaattatgatattttatcaccaacaactggaaattgattgaagggtcttatagaagggttacaactgatgcattcaatcctatatcattcaatgagtggtcttaaaagttctacagagtagaaatcactgatgcaagtcattacatatatatttatttagtttcgaatataatataatttgggccacattactagaggtgcgaaatatgagatattaaggctcataatgcagagc

SEQ ID NO: 15367 - DNA, 425 bp, Diabrotica virgifera
  misc_feature (16)..(18): n is a, c, g, or t
  misc_feature (27)..(29): n is a, c, g, or t
  misc_feature (31)..(32): n is a, c, g, or t
  misc_feature (41)..(41): n is a, c, g, or t
  misc_feature (58)..(70): n is a, c, g, or t
  misc_feature (72)..(87): n is a, c, g, or t
  misc_feature (89)..(105): n is a, c, g, or t
  misc_feature (107)..(107): n is a, c, g, or t
  misc_feature (111)..(112): n is a, c, g, or t
  misc_feature (131)..(132): n is a, c, g, or t
  misc_feature (136)..(136): n is a, c, g, or t
  misc_feature (140)..(141): n is a, c, g, or t
  misc_feature (154)..(154): n is a, c, g, or t
  misc_feature (174)..(174): n is a, c, g, or t
  misc_feature (189)..(189): n is a, c, g, or t
  misc_feature (205)..(205): n is a, c, g, or t
  misc_feature (210)..(210): n is a, c, g, or t
  misc_feature (212)..(212): n is a, c, g, or t
  misc_feature (225)..(225): n is a, c, g, or t
  misc_feature (281)..(307): n is a, c, g, or t
catagagggaggaaannntattgaaannngnngaggggagncactttataaagggatnnnnnnnnnnnnnannnnnnnnnnnnnnnngnnnnnnnnnnnnnnnnngntttnnttgattatcttattgaagnnagtnaaannaaaggaaatgganttagtgataaagaaataaangaagaagtgaatatnattatgtttgagggtnaaganangattgatgttgantttagttttgtaataagattattgggtatgaatgaagaagttgaagaaagaggttnnnnnnnnnnnnnnnnnnnnnnnnnnnagaatttgaattgaggtgttatatttaatgatatgttttagatgaagtatatggaaaggggaattttagaatgtttgagaatgtataaagtagtttttatgattgtaagaaaaagtga

SEQ ID NO: 15368 - DNA, 329 bp, Diabrotica virgifera
ccttgtaggccaaacaagaatatgatgaatatttggagaactacctattagctgtgagaaagtactgtgtgaaagaagatccctcaactatagctagtgctagaaaaacgttgaataggttatacttcttagatttactaaaggatattttgctctatggattgctgttatggttgttttatggctttgtaaccaggttgttggtagctgttggaaatcctttagtttgatgttttattttatatgttggaactattgatatatttatatgtttaatacattttgtaccatttggaaatgaaagatctatttataaaatatggtttaat

SEQ ID NO: 15369 - DNA, 465 bp, Diabrotica virgifera
  misc_feature (403)..(462): n is a, c, g, or t
tttttccgacttaacttaacttttttttgattttaggacctaatcttcaaaacccaacaggtcccgataacgctttagtaactgcaagtttagcatccttgcctcccctactagaaagttttatggtagtgtaccataatatatggctatactatctaataaactgttaatatactgtaaaaggtatgtaatacttctgccgtgttaccgtgtattataaacacagatgcacgtttttctgaggtacctattaaaaaatgtttacattaacatttagtcttcattattcgggctaaaagtagaaatatgcagacgcagactaaatatgcagacgtagactagctctaattttattttatagcatggtaattttaatagttaagcttatgtaatgttttttggnnnnnnnnnnnnnnnnnnnnnnnnnnnnnnnnnnnnnnnnnnnnnnnnnnnnnnnnnnnngaa

SEQ ID NO: 15370 - DNA, 338 bp, Diabrotica virgifera
  misc_feature (3)..(322): n is a, c, g, or t
tgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaaattaccctta

SEQ ID NO: 15371 - DNA, 518 bp, Diabrotica virgifera
  misc_feature (26)..(26): n is a, c, g, or t
  misc_feature (28)..(28): n is a, c, g, or t
  misc_feature (30)..(31): n is a, c, g, or t
  misc_feature (34)..(34): n is a, c, g, or t
  misc_feature (41)..(41): n is a, c, g, or t
  misc_feature (64)..(64): n is a, c, g, or t
  misc_feature (66)..(66): n is a, c, g, or t
  misc_feature (85)..(85): n is a, c, g, or t
  misc_feature (87)..(87): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (111)..(113): n is a, c, g, or t
  misc_feature (115)..(115): n is a, c, g, or t
  misc_feature (120)..(121): n is a, c, g, or t
  misc_feature (137)..(137): n is a, c, g, or t
  misc_feature (145)..(146): n is a, c, g, or t
  misc_feature (152)..(152): n is a, c, g, or t
  misc_feature (156)..(156): n is a, c, g, or t
  misc_feature (170)..(170): n is a, c, g, or t
  misc_feature (172)..(173): n is a, c, g, or t
  misc_feature (178)..(178): n is a, c, g, or t
  misc_feature (197)..(215): n is a, c, g, or t
  misc_feature (217)..(217): n is a, c, g, or t
  misc_feature (224)..(224): n is a, c, g, or t
  misc_feature (231)..(231): n is a, c, g, or t
  misc_feature (246)..(246): n is a, c, g, or t
  misc_feature (251)..(251): n is a, c, g, or t
  misc_feature (269)..(269): n is a, c, g, or t
  misc_feature (288)..(288): n is a, c, g, or t
  misc_feature (298)..(298): n is a, c, g, or t
  misc_feature (305)..(305): n is a, c, g, or t
  misc_feature (347)..(347): n is a, c, g, or t
  misc_feature (417)..(417): n is a, c, g, or t
caatcaaggaccggggtgaagatggnananngangaggagncacctttgagaggacccaagaanangcaggggagacgacgacanangaaacanacgaanangaaaccacnnncncgggnncggagacagcgaaacnagaacagnncgggcnaccnccgagaacgacgancnnagcangggcgcagagcggaggagnnnnnnnnnnnnnnnnnnngnacggcgncaccaancacggaaaagcggancgagncgcggaggaagcacaccncaacaaccaagaggacgcnccacaacggnaagcggnccagccagaccaaaccacagagaaagcgagggaggacaggcnagaacaaagcgcgacgaaagagagcaacaacagacacgaccaggagggagcgaagccggcagaagggggncccgcgacagacgacgcggaaaacaacaccgaagaacgaccagacccagacgaaacagaaggggaaagaggccggcgggaaaagcccccgacaagcccaag

SEQ ID NO: 15372 - DNA, 631 bp, Diabrotica virgifera
tcttgtccgagggaatacctatcagcctagtcactgcatctcctgatcctttcattagctcctatacctcacgaaggaaaaacgccccgagctaacgttgacgctaggcccatactgcgattgactgcttatgctttctttgtactaacatgcctataatagcccgaaatgaaacatcccgattaccacgtcttcctatctctgaattctcaaaaaaatgtgccaaaaggcggaagaccgtgtaggacaaggaaaagaaatgtgtcctctatatgtatgcatacaacaagaaacgctacgacgccgaaatgcaaagctactgtcctcccatgggagagaaacaacgtgacaagaataggaagcaactatcagatcccaacgcgcccaaacggactttatctgctttcttctggatcatttatgatgaatacgacatatcctcggctcctactcatgaatatgtcggtgcacacattgactcataattgtgtagaaggtgctatgatgcagattctcaatgcaaggactcatatgaggctttgtatgatatagactaacatcgatatgaatgagaaatgactgcgtataaaaataagaacgatcccatcttgcaacaagtgggacatccaga

SEQ ID NO: 15373 - DNA, 372 bp, Diabrotica virgifera
  misc_feature (78)..(95): n is a, c, g, or t
  misc_feature (278)..(355): n is a, c, g, or t
atttagaaacatgaagactacctttgttttggccattttagtttgcgtcggtcttaccgtcagcgcccaaaagaatgnnnnnnnnnnnnnnnnnnagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataataaaaactcaaaattnnnnnnnnnnnnnnnnnnnnnnnnnnnnnnnnnnnnnnnnnnnnnnnnnnnnnnnnnnnnnnnnnnnnnnnnnnnnnngaggaacgaatataaaa

SEQ ID NO: 15374 - DNA, 328 bp, Diabrotica virgifera
  misc_feature (58)..(58): n is a, c, g, or t
  misc_feature (102)..(102): n is a, c, g, or t
  misc_feature (105)..(105): n is a, c, g, or t
  misc_feature (171)..(171): n is a, c, g, or t
ccacaccagcacgcaccgacgagacaaaagaagcgaagcagcgagagaaccgcgaacncggaaacaaaacagcagacgaccacaaacaaaaagaaagaacgncancaaaagacgacacgcaacagcaaagcggagaaaaccaccaggcgaaagacgaagccaacgacgagngcacagaaccacaagaaacgacgacggaaagggacacgcaagaacccagcgagcaacacggcgctgcgtaccaggacaacacggaaagagcatttgatggggggccagcaacgacgcggaaacagcaacaaccgaacaagaaaaaaaagacgccaac

SEQ ID NO: 15375 - DNA, 736 bp, Diabrotica virgifera
  misc_feature (4)..(24): n is a, c, g, or t
  misc_feature (101)..(122): n is a, c, g, or t
tttnnnnnnnnnnnnnnnnnnnnnattaaaatatgtagtatttattcacagtaaaaaatagtacacaaaatcaaaataattccctattaatataactcccnnnnnnnnnnnnnnnnnnnnnngatacataagtataagacttaattaattttatgttggttttttagacatatattgcagctaaatgtttgtgaatttgatttatgcatattaagtctatttatgcaagaaatgtggtaggcccttcggcaaaagttacatttaattccaagattttgctctttaaaattataagtacacgagaagcaaagaccctcagtcagcttaggatttttaaataacgaattattcttgtaggtttccattacctcatcggtaaataaactcttttttaccttctctattgcaatatttttcaaatcacattttttgttatcttgaaaagacgaggaagatggtatatctgacaaaaatttatcaagaagccaattgtcttcacatgtattaaaagaatccttctctggtaagataggttgctcggtaagtttgttcaacattttaggcttatcatcatcttttatttctcgggttatacttttctctggttttttactttgtgttttttctttcttggcagtttttaaacttttaaccttcttggaaattttgcttactgtaacagcctttttttccaaacgttgtctttttctctcctccttttctgcagcaatctttt

SEQ ID NO: 15376 - DNA, 716 bp, Diabrotica virgifera
ctctttttagcttgcatctagtttgtatataaaattcatcaaacaaataatgcccattgaattaactgtgaaactaataccgttgaattacatcaatagctgacaaaaaagttacttagagactccgcagaaactgaaaacatccatgacagtggtattggaaagagccaataatgttagaatccccttaaataaactaaggaaatcactaagcatagtgctgaagcgaaaaaatttggtgaaagagcaaagagtagccaaagtttacataagtaagatggatctagaaagtgcagggaccagcaatggtgtgcctccaaagaagaaatttaaatatagtattggaaaaaatagtaataaatctttagcgagtttacctaaagtggttttacaaaggatatttacatatttagatgtgaggtccatacaaaattgtgcaatcctgtgctcaacgttctacaatttatcgaaggatagttctctatataaaaacattgaatttaaatttattgagatgtctcccccaagctataaaatattatatttcaaaagttacaaacccaaaaaccatagaaatattgtacgaaaatgagcagagcaaaaatgaaaatactacatgggttggtacttccactggcaaggaactggagaaatggggagacacgattgtaaccttttaaatacaaaattgccaaaatgaccaacgattaattgcc

SEQ ID NO: 15377 - DNA, 519 bp, Diabrotica virgifera
  misc_feature (16)..(16): n is a, c, g, or t
  misc_feature (19)..(19): n is a, c, g, or t
  misc_feature (35)..(35): n is a, c, g, or t
  misc_feature (79)..(79): n is a, c, g, or t
  misc_feature (82)..(82): n is a, c, g, or t
  misc_feature (84)..(84): n is a, c, g, or t
  misc_feature (91)..(91): n is a, c, g, or t
  misc_feature (109)..(109): n is a, c, g, or t
  misc_feature (115)..(115): n is a, c, g, or t
gcccgtcaagaggggnagnaaagagagagaagganaaaagggggcccccttgaaagaaagggggagggacgaagggcancgnanaaaaaangaaaaagcgaagggaccngaaagnaacagggagttccagactactaacaggctactgctaacaggtactccattacaaaacaatttacacgaactctgggctcttctcaacttcttactgccagatgttttcaactcatcggatgatttcgatgcctggttcaacaccagtcaatgtctgggagacaacgccttggtcgagagattgcatgctgtatgagaaccattcttgcttagaagattgaaagctgaagtggagaaacgcctaaaacccgagaacgagctaaacgcgtatgttaggattgagctagatgccactagaatggttttccccagcgatgatgaaagatcgtgattctctgaatggtgcaggaaaagtgcaaaaaacgcgcccaccgaataatctccttgagtaaggaaaatgcacaa

SEQ ID NO: 15378 - DNA, 692 bp, Diabrotica virgifera
  misc_feature (37)..(56): n is a, c, g, or t
  misc_feature (113)..(135): n is a, c, g, or t
cctgaagtcaatcggacgcgtttcccggtccatctgnnnnnnnnnnnnnnnnnnnncgcgaaatttttaaaactatgacgaaaatagtgttaccgtttactagcaaagtatcnnnnnnnnnnnnnnnnnnnnnnnctggggatgtctctatgagatacaccaaatataactatacagcagagcttctcaaagacagcaaaccaaaaatggggacgtcaaatttcgtattgaaaaggtatgataatataacaaagtctgaagaagatcataggctttatagaggtctggaattgtctaaccatatgaaagtgttgcttgtaagtgatccaaaaactgataaatctgcagctgctatggatgttaatgtaggattccttagcgatccaaaagaagtgtatgggctggcccacttttgtgaacatatgttgtttcttggaacaaagaaatatcctaatgaaaatgactacaataagtttttaagtgaacatggtggcagtacaaatgcagcaacatatctggatcacacagtttacttttttgatatagttcccaaccaactcccccaagcattggacagattttcccagttctttattgctccactttttacagagagtgcaacagaaagagaaaataacgccgttaattctgaacatgaaaaaaatttgcccaatgatctttggagacttgat

SEQ ID NO: 15379 - DNA, 787 bp, Diabrotica virgifera
ctccagcaataaaattgctggtaaataacttttccttgtattttgataattagcccagagtataagtcaatgtttactgtactgaaatcatatttagaaggaaggtactaccgtatcaggtatgatacagatacaccaaatctaccgtatacaatctggagtctctcaaggtagtgttttgggtcctccattatatttgatatttacacacgacataccaacaaatggaaatgtaactattacaacattcgcagacgacacagctttgttagttacaaataaaaatacctcaacagctaccgaatctcttcaaaggcatcttacggacatcgaaaagtggacaaagaaatggcgcgtaaagatcagtgaatctaaatcacaacatatcatatttacaaaatgtcgcaaaatgtcgcctaatatagaaataaataacaaagctattccacaaactgaaagcgttcaataccttggaacgcacctggacaaaatggagaacccatatatggaaaaagcgccaacagttaaacttaaaatttggtgaaacattattggatactgagcagaacatcgaagttgtctatacgtaacaaactgttggtatacaatacaatactcgaaccggtctggacctatgggattcagctatggggtacagcagcaaaatctatttccaaggcaaagataaatcgttttacaagggcggcatctaaaaattagaaaagcgttggaataattgtatcgaccctaaaggagattattttgacgaataaagaatacctttctc

SEQ ID NO: 15380 - DNA, 279 bp, Diabrotica virgifera
tctttcgtccggcccctagtattacgaaaacgtgagggcattgatcttcaaagtgtagcccatcatggtgcctatcttttgataacaaggagactcattacagggagaggtatacttctccgaatctttgatcgtacctctccgatatccactgcatcgaccactcggatccatgccgagatgatcgccgccgaggccactgccgccttttaacggacactaacaatatcttcccttcttagtaaagaatgacactgctgccttcgacaccttgctata

SEQ ID NO: 15381 - DNA, 358 bp, Diabrotica virgifera
  misc_feature (17)..(17): n is a, c, g, or t
  misc_feature (23)..(27): n is a, c, g, or t
  misc_feature (31)..(31): n is a, c, g, or t
  misc_feature (35)..(39): n is a, c, g, or t
  misc_feature (48)..(48): n is a, c, g, or t
  misc_feature (55)..(57): n is a, c, g, or t
  misc_feature (59)..(61): n is a, c, g, or t
  misc_feature (65)..(66): n is a, c, g, or t
  misc_feature (69)..(69): n is a, c, g, or t
  misc_feature (72)..(73): n is a, c, g, or t
  misc_feature (98)..(98): n is a, c, g, or t
  misc_feature (218)..(218): n is a, c, g, or t
  misc_feature (286)..(286): n is a, c, g, or t
cctcgggggcctttttntttttnnnnntttntttnnnnnatcccttcncagggcnnncnnngcgnnctnccnngccgggaacgcagagcgcgcacggnaccccggaggcgggccgaccctctttgcaggcgcggacagagcacggcggacagaacgggcccccgaaggcccaaggccgagaggcgcgcaaaacgcagagaaggacaaccaccccaagncaacagacagcgacgggcgcagaacaaaggaaacacgggcaacagcacaccgcaccacacggcagcgncgaaagacaaggaacgggcgccggaacccccacgaaggcgagaacagcccacccaagcagcaaacgagcctt

SEQ ID NO: 15382 - DNA, 625 bp, Diabrotica virgifera
ggagattctcatactactaacaaaactgttgaaaatttcagatataactatgaagagatcttaaaatatccttcttctgttaacatttatatgttccacggcggtactaattttgcatttttgaatggagctgagaatttaaaattcgatgaatgggaaacagattaccactcaatagtatccagttacgaatatgtttctcccctggatgaatctggcgactacacagaaaaatattgggcagcgaaacaattgctagaacagtataatcgtattaaaactgctcttcctgacgtaccagctgctcctaagaaaacagcgtatgcaacggtaaaaatggaacaagaaatgtttttatatgatatgcttcagacgattactcctttattcgaaaaatgtcattcccatggaaaaacttgatatcaataacggtaatggtcaaagttatgggtacatagtataccgtaaaacaaatttgaatataccgggaaaccgccatactttaaattaaaggcaaaatttgggacacagcaatggtacttaataaaggggatactccgattcccctgggtggcgaaaattggagaattaaatgggtttggaaccttcaggatatttacaatcc

SEQ ID NO: 15383 - DNA, 687 bp, Diabrotica virgifera
  misc_feature (13)..(44): n is a, c, g, or t
  misc_feature (47)..(93): n is a, c, g, or t
  misc_feature (95)..(325): n is a, c, g, or t
  misc_feature (327)..(394): n is a, c, g, or t
  misc_feature (402)..(449): n is a, c, g, or t
  misc_feature (451)..(494): n is a, c, g, or t
ccttttccttgtnnnnnnnnnnnnnnnnnnnnnnnnnnnnnnnnctnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnncggcgatnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnntaacaagcgaaattttattggagagctcaaatcgataataaacattgcgacctcttatgttggataaaagctaataattggcagaaccagctacattattaatactgtaagacttttaaaattctacttgatctgagtttacaccggggtgtccctctctgctctcctatttttaccttctatatatattttt

SEQ ID NO: 15384 - DNA, 281 bp, Diabrotica virgifera
  misc_feature (14)..(14): n is a, c, g, or t
  misc_feature (26)..(26): n is a, c, g, or t
  misc_feature (33)..(33): n is a, c, g, or t
  misc_feature (55)..(55): n is a, c, g, or t
  misc_feature (68)..(68): n is a, c, g, or t
  misc_feature (79)..(81): n is a, c, g, or t
  misc_feature (85)..(85): n is a, c, g, or t
  misc_feature (94)..(94): n is a, c, g, or t
  misc_feature (110)..(110): n is a, c, g, or t
cgttaagggaaganactcaaagaagnggaggancgggaaaacccctttagaaagnaaaagaaaagagngaagaagaaannngggnatccacggnaggagaggagagcccnaacgccggagacttaacgaagcaccgaccaaagacacaagcagcccacgaaaaacaaccaggagactccaaaaaaaggaaccacccagggggacaagacagcggaggaaaaacaggcagaacaagcacaaaaagaggacggagagcagagggcccgacacagaaaaggggc

SEQ ID NO: 15385 - DNA, 941 bp, Diabrotica virgifera
  misc_feature (64)..(86): n is a, c, g, or t
  misc_feature (649)..(671): n is a, c, g, or t
  misc_feature (806)..(828): n is a, c, g, or t
gttttccaaagaaaaatcaagaaagaaatctgatgtgatcgaactggaatgacaatttttatgnnnnnnnnnnnnnnnnnnnnnnncttgcaattttttttcgcaaaaatggtacatgcttgaagggcggctactagagaattgcctagggcgtcaattgacctaaacgcggccctggtgtaatttagaattattctaccagggttgccaagcagattatattcaataatataatatgtttattacctgatacttgttaagaaaaacaaattttcattacaattttatacatcgttgctatattttttattctagttgtctttggttcagctcatatgacctttttttcgttttttatgatttagataaatgacatttggcaatcttacaaatacgtaatcccttaataacgtgaaccttatttctacctaaataaggggataccttatccgttaataaagtgatacgttatttttcagttagtgcgcatgagcagaataacgtgtgacgtttaacgcaactgaaatgaggggcttaaaatctctctaataatattttacacactaacaatcttaactacttgagtgttttgatatcccatgcaatattacctaatgaattaaagatacataagtctagattaatatgnnnnnnnnnnnnnnnnnnnnnnnatgattgaatatgttcacggccaacctagtaatgtcacgtaattgttgttgcaattaatgtttggcttgaataatcacgaatgactcataaattgtagcaattaggtattggaaatgtttaagaaataataaagnnnnnnnnnnnnnnnnnnnnnnnccatttaagttccataaaacccagaaatattcattccgagtttcgaccatgtatgccaaaatgaaacatttcgctatattaatggtttttggcaatagtaaactatatgaaaa

SEQ ID NO: 15386 - DNA, 841 bp, Diabrotica virgifera
  misc_feature (761)..(782): n is a, c, g, or t
gtgaatcatgtgtttaattaagttatagtatttattctatattaaattacgtagaatataatctctctgtgttgctttacacattaactatgtataaaaatgttacaaaggatgattggtccaaggagaatacagagaatcgttttggcaacctttatattttccgttctacatatatttggagtttttcatcatatttttgagactgatttttatacaaactttcattatccctacgatggggatatagaacatttaatacagcaattgaaggatggcaagccacctgatgttttacctattaattcctatcactttgaatataacaagaaatgtgtttcaaaatgttccagtatgaaacagttaagattggtttatataataaagagtgctccagagcattttgatcgcagaattggaatacgcaattcatgggggtatgaaaggcgattttctgatgcagaaataagaactgtctttttggttggagaacgaaattcacatgctttaaaagagtcattaaaagaagaatactcaaagtttcatgatattgtccatgccaattttacagatagttactacaacaatacttacaaaactatgatgggcttgcagtgggctgtcaggtattgtccaaattcacaatattatatgtttgttgatgatgattactacgtgtccaccaaaaatgttttaaaggatttgaaaatcccacaagtattcagaatatgtaaagaacctcttaatggagttagtccacnnnnnnnnnnnnnnnnnnnnnngtttataatgatttaaatgaggatgaaaaattattttcaggttatgtatttccatcccc

SEQ ID NO: 15387 - DNA, 65 bp, Diabrotica virgifera
gcaattatgagtatctcgaatggttgtgacactatagtgttgattccgggcggatgttagaagta

SEQ ID NO: 15388 - DNA, 1047 bp, Diabrotica virgifera
  misc_feature (2)..(803): n is a, c, g, or t
  misc_feature (816)..(879): n is a, c, g, or t
  misc_feature (885)..(937): n is a, c, g, or t
  misc_feature (941)..(965): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagaaaccctannnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnncccnnnnnnnnnnnnnnnnnnnnnnnnngggggctcgccgcgttttttttttggccgaacctaaaaaactaaggccccagcgccggtcggatcccatttgtgaggtggcc

SEQ ID NO: 15389 - DNA, 180 bp, Diabrotica virgifera
gcgttccaatgctttaaatgtgtcggtcaggggctggttgagttgctggatactggcggcggtgcgttggctgtcgcggctgctgtcttcggcaatctgccgggttttctgcgcactgccggaggcctgctcgcagctcttggcgacccccatggaggtcgcggccaactgtgtggagga

SEQ ID NO: 15390 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (166)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctannnnnnnnnnnnnnnnnnnnnnnnnnnngaaagg

SEQ ID NO: 15391 - DNA, 704 bp, Diabrotica virgifera
aacgtcttgatgcctctcagaaggttcagtgcaccctcttctgcatcgatgggattctgcctctcaaagagagcccagagacaccgtggaaaggtaaaggattgcccgatggatgatccctcgaaagctgtctgcttaacggccttcactaggttacgcgctggtatgacaccgcgtggaagaagagaggcacagacctgactctcatataagaagatggagattgtaaaggttgaaacaattttggaaactccacccatgaaacttgttgatgatgtcagttacatccaaactcctcatggccttagggctttacaccacagactcgtgctgagcatctctctgaacattgccacatgtgcttctacaagatatgctactggaacaaaaataagggatttaccatagcttccaatacatggagtgatggattaaggaacaggaccatcgagaaggacttaaagtaacactgctacatactggaaagtggatatagttattgctcatactcaaatgaaattgtatatgctacgtatgaagaaagaccacattatggaaatctccatcgatgcagctactgtagctgacactgtagcttgagatacataacactttgtctagactattcctattgcccacgatttctgctcactatgacatgattgattgcattgaagttactaatgatcttggatacaaaggtg

SEQ ID NO: 15392 - DNA, 757 bp, Diabrotica virgifera
  misc_feature (593)..(593): n is a, c, g, or t
gccaacagatgtgttttaaactacactgcgcgtcattaataataggccacctaaaatttttggcattttttaatttttacgaactctactagaaattgattatcattagatttttgtgtaatgtttaagaatatgtatgttctaaagcagtatgcaaccataaataacaaatgtcaaaaaaaaacttctcccaaaatgatgattttaatggaaaatttataaagttaacgtagtaaattttttctgacaaaaattacaattaagtcgtgattttcaatattttgtattaccacatctattttaaattacactcctcatccgacttgccattaaattgatcaagttctggatgttgtcttgaccaaaagcactcattcttccatgagcgcaaaccgaaggtactcacgatttaatggagcaggtattctgtttcttactcttcgtttgagttggtcccaaacatgctcaatcgggttcaaatctgggctttgagcagcctaattgaggcgctcagagcaacagcggcctaaccccaagaacgaagttttgagataaatgcaatctttgcattcgtatttacattatgcttatgngatggcgctacaaattatgtagcgctatttagccaaatgtagaggtagattgtgtagacctttgttaatccgaagattaatgttgctgcttttattgatatatttatctcaaaatgctcaatttgtgggtagaccactggtgttgagcgcctcatcttttttgt

SEQ ID NO: 15393 - DNA, 757 bp, Diabrotica virgifera
  misc_feature (81)..(81): n is a, c, g, or t
cataaagcgggcggagagaggagagggaggagggagaggacccttcaaaggaacaaagaggagatcggcaaagagggccancaaaagcacccgcgcgcgccaaaacagcgacacacgccccaaccccaccggcgaagccgaacacggcaccgaagcgggacggacccgcgcagcggaaccagcaggagccagcacaggcagcgacgaagcgcacgaacgccgcgacaaggccgggggagaacaccacgccaaaggaggcaaaaccgccacccacaacaccaagaccacaaacgcaccggaacagaccaaaccaaggcgagaagggagcgcacaaacagacgacgacgatcacatgacggacggcgacggaacccaaaacaaggggggggcgggaggccacgctatcttgtccgtgtcactagacagggccacagacggaagatgcaagaccggcgtgccactgtgcacacctacgaccgatagggccggaaaccgggatgcaatctcggcgaatcctgcctgcacacgcatcgaaggagggtcccaaagtggaaagaagctgggcatgcacgagcccatgaacctcccccctgaaggcgcaaaaccactacccagacaagccggaggggccctgagagctacccctcggcacaaaaaagcgacgcccggggcacaatctcgaaccgaaccatcccggctgccacttgccgccaccgaaggggattgcccccaccccgccccccggcccccccaagaa

SEQ ID NO: 15394 - DNA, 896 bp, Diabrotica virgifera
tcttgtccgcgtcataataaatagtctagcgatttcaaaacaaaaatagttgtagaaaagcaataatgcattaaataaacactaaacggctataaccatgactacaaacggaaaaataaacgccgaaacccaattgcaagtgacaattggtaggttgctacaatctgttaccgataaaagctatctagtgttggaatctgtgaaatgttcattgaaaaaattggccgaaaaacacccaaatcaagtgttaaactcgtgttgtcagttcataacaaaatccccaaaaccacctcctgaacatgtttcatccatactctacataatggaactagtctgttccgaccatatattgaagatcaacggggatactattatacaaacaataaatgttagcctctccattatgactgaaaatattagctgggactcccaattacaaaggcctgcgtcagggatacttgtagcccttgggagggaacattatgtacaggttatggatgctctaagggaaaaactgcagccttcggtaattccccatcacatggtgccctatactttgggtgccttagcaagtgccaatgccatcggagtagtaccgtatttgaaagatatctatagtattatcttaccacttcttccatctttgcgaaccgagatactaaaacaatctgtttcatttgctctgggcaatttttgcgaggccctcacagagtatatctcgaattcagaaaaggttccggatcccactataagcctagaaactttcagcgaagaaatcagcatagcttataatatacttttttctaattgggatcattcccgcgatgccaagacaaacgaatgtgtgctagaagccataactttgatatatccagttctgtctgagaatatagcgc

SEQ ID NO: 15395 - DNA, 105 bp, Diabrotica virgifera
  misc_feature (3)..(20): n is a, c, g, or t
  misc_feature (24)..(25): n is a, c, g, or t
ccnnnnnnnnnnnnnnnnnnaggnnagggaagagggggacggccctttaaaggaaggcagcgacaacgggcgaccgaggaggagaacgacgcaggagacccggcg

SEQ ID NO: 15396 - DNA, 393 bp, Diabrotica virgifera
gatactctcgaaactatctgaatttctggtgtgccgagcatccggggcagaagaacggatcattggttatttctccagctgcaccatttataaagaaggaaagggtgctttccatgtctgtatacacatccatcgctgcgtacacacttcaatctagcttgccttgaacccatggaacaagttccaattctcctcatgcattcctgtcatgaaagatgccgcagctggacatgatcccaccaaacatctcgcataacttaactaaaccaatcctgaccttaaggaatgcgtcacaaatgccagaaaggaaccagggctaccaacaagattcgggattaacctcagatccaacagagatagtaagacattccagatgagattgacagctattat

SEQ ID NO: 15397 - DNA, 649 bp, Diabrotica virgifera
  misc_feature (536)..(559): n is a, c, g, or t
aacccatgccatttttgataccattaaaactgaaattattgaggaacccaagagagaaagtacacatgatgcatttgaatatgtggatctaaaggaaaattttataaagactgaaatacagcaagatgaccataaattatttgaagaagaacaaaaaatccaaacaagatattcaaattgccagttcatcataccaatgcgatcaacctggaagttcaaaggacatggataatctacaaattccaagttcgtcaacaatatcttcagaaattaaggaagtatcatcttcaactactatagaacgtacttatggacaaacaaaattaacatcctatatagaaaggaaaacagtctgtaagaataaggaagagacagacaacgcattaatgttactatttatttatgacctacaaccattccgtatggttgaaagtgaggcttttagggaattgacctttggcttaaatcccaattataccctaccagacagaaaaacaatttccaaaataatgattccacatttatatgaacagtgnnnnnnnnnnnnnnnnnnnnnnnnaaaacaaggatcgacattttgcattacaacagactgctggacttcaagaatatatgaaactaagtaaattaggggttacagttcatttct

SEQ ID NO: 15398 - DNA, 378 bp, Diabrotica virgifera
  misc_feature (28)..(89): n is a, c, g, or t
  misc_feature (91)..(160): n is a, c, g, or t
  misc_feature (169)..(202): n is a, c, g, or t
  misc_feature (204)..(245): n is a, c, g, or t
  misc_feature (248)..(270): n is a, c, g, or t
  misc_feature (273)..(347): n is a, c, g, or t
agcgcggaattctgaccgagcttaagannnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnccccataannnnnnnnnnnnnnnnnnnnnnnnnnnnnnnnnngnnnnnnnnnnnnnnnnnnnnnnnnnnnnnnnnnnnnnnnnnnggnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnncctcagggataaccaccgggcattttttttt

SEQ ID NO: 15399 - DNA, 629 bp, Diabrotica virgifera
  misc_feature (522)..(537): n is a, c, g, or t
aaatctaagacgaatgttgctccaaaagcggatagtaaggtcacaagtaaatctgccacatatctaaataatgaaatcataaaacaaggagatgctgttcgcaagttaaaggagcaaaaagcagcgaaggctgatattgacacggccgtaaaagtattattgacattaaaagctgaatataaagctgtagctaatactgactggaaacctggttgtgtacctcctacagcttcagtttctaagaacgattctgctattggtgacgagatcaatgcgaaaatcgcagcccagggcgaaaagctaaaatcacaaaaagccgacaaagcagcagtagaggccgaagtgaggcaattgttatcattaaaagctgagtacaagtctgctactggaaaagattggactccaagtcaggcatcttctaccaacaaaattacaaatcagacatcttctaccaccaaaccaaaacaagaaaacgtgtccttagacgaaaattcaattctccagcaaatagctctacaaggnnnnnnnnnnnnnnnntttaaatctcaaaaggccgataaatcaactgtcgacaacgaagtcaaggagctgttatctctaaaggatgattataagacattaactggaaa

SEQ ID NO: 15400 - DNA, 1280 bp, Diabrotica virgifera
  misc_feature (42)..(61): n is a, c, g, or t
  misc_feature (87)..(119): n is a, c, g, or t
  misc_feature (158)..(181): n is a, c, g, or t
  misc_feature (193)..(225): n is a, c, g, or t
  misc_feature (227)..(281): n is a, c, g, or t
  misc_feature (315)..(357): n is a, c, g, or t
  misc_feature (369)..(400): n is a, c, g, or t
  misc_feature (648)..(677): n is a, c, g, or t
  misc_feature (729)..(748): n is a, c, g, or t
  misc_feature (838)..(856): n is a, c, g, or t
  misc_feature (915)..(935): n is a, c, g, or t
  misc_feature (1168)..(1195): n is a, c, g, or t
tctttctccgatttttatttcttttcactcctaaaagattcnnnnnnnnnnnnnnnnnnnncttctatttaatgatagtcaattacnnnnnnnnnnnnnnnnnnnnnnnnnnnnnnnnncaaatttatcctttgtaccttgcgaatcaggcattatcnnnnnnnnnnnnnnnnnnnnnnnntttcgaatttcnnnnnnnnnnnnnnnnnnnnnnnnnnnnnnnnncnnnnnnnnnnnnnnnnnnnnnnnnnnnnnnnnnnnnnnnnnnnnnnnnnnnnnnncaattcctttaagaaataaatcacatttatttcnnnnnnnnnnnnnnnnnnnnnnnnnnnnnnnnnnnnnnnnnnncaaatattttcnnnnnnnnnnnnnnnnnnnnnnnnnnnnnnnnattccattttccaatacaaattacgattacaaattctcctattttaaaaaatgggatcatttattttcaaaaatcatcattctcatccttcaaaaatttttatccacaaaataaacttccataattcaatttacgatggagcaaatctccctaatcacaaattggcttttcccccccaaatataattgggttccaaccggaattccccaccctttttttccccggttattcaaaacctccccctttcnnnnnnnnnnnnnnnnnnnnnnnnnnnnnntgaataatttgaacggcccccggaattttcaccccgctcaaaggacccaaannnnnnnnnnnnnnnnnnnnaaagccgccaagaaagggggggagagaaaaaaaaacttgcttttcttttattttttttagaaattcttttttctcgctcacaaaacctcnnnnnnnnnnnnnnnnnnnccagaaaaaccccccaaaagatcttctcacaatctccccccacgctttttacaaatacnnnnnnnnnnnnnnnnnnnnncctctcttccttgcgcgcgggacaaaacaaacaaaattatctcctcttttcaccatcctacactaaacccccacaacattctgcccccccccacctccctcccaccccccccaaaaacacatccccctcgcgcacgacccccaggcagattttattttcgcggggggacatctctccctctcacacaccactcctccccccctcccccctcctctgtaatttcctctctcctnnnnnnnnnnnnnnnnnnnnnnnnnnnntcctcctccttcctcccccactctcccatccaccccttttctcctccctccctctctcctcctctccccctccctcgccctcctc

SEQ ID NO: 15401 - DNA, 71 bp, Diabrotica virgifera
gttttcgtttcgatttcgggcttccgttatattttacttaaactgtgatctaccattaccaggttttaata

SEQ ID NO: 15402 - DNA, 1131 bp, Diabrotica virgifera
  misc_feature (122)..(139): n is a, c, g, or t
  misc_feature (189)..(218): n is a, c, g, or t
  misc_feature (307)..(333): n is a, c, g, or t
  misc_feature (477)..(501): n is a, c, g, or t
  misc_feature (669)..(692): n is a, c, g, or t
  misc_feature (869)..(895): n is a, c, g, or t
  misc_feature (976)..(1019): n is a, c, g, or t
ctcggttatttttgaatcgatttagctcaaaattggtacacacactaagtaaaatatttaaaagggtatgacgtagagctgtacccaaaattttcttaaaaaaatttccgacaagagggaannnnnnnnnnnnnnnnnnatctgatatttgcttacatactccttgaacaacgacaaacatcgttctgnnnnnnnnnnnnnnnnnnnnnnnnnnnnnncgacacaagtatcaggttataagtagttatattccaaatcaaaaaatctaagtgtccgacaaaaatattggggcaaatccaaaggcggnnnnnnnnnnnnnnnnnnnnnnnnnnnctgtcttttaaaaaatactgggttcgtgcaacccttacctttaaaaccatttttccgacaacattagtaggttataagtaattatattcttaatcaaaaaatcaaagtgtcggacaaaaatattggggcaactcgacagtcggnnnnnnnnnnnnnnnnnnnnnnnnngtatactttccaattatgcttgggtcgtgcatcccttatctttacaaccatttttccgacaaaagaagaaggttacaagaagttatattctaaacaaaaaaagaattgtctgacaaaatgatggggaaacgaaagaaaaattaatcttttaggttacacggggggggnnnnnnnnnnnnnnnnnnnnnnnngcggttcccgggtaatttggaaccattttatggaaaatggcaccccgctaaaaaaggttttaaagggatgccgaaatcggaccccaaattttttaaaaattcccaaaaaagggaaaatttagaaaattgggactggaaattggggaataccccctgaaaagaaaaaactcttcgttnnnnnnnnnnnnnnnnnnnnnnnnnnncacagggtacgggattggggataaaattcccacacaaaaaattcgggggcggcaaaaaatttggggcaaaccccaggcgcnnnnnnnnnnnnnnnnnnnnnnnnnnnnnnnnnnnnnnnnnnnnggggccgggggatacctctttcttttgcctaatattttcccacaagaaaagataaatcataaaaaattatttttccctaatacaaaaggattgctgttggtaacattcttcg

SEQ ID NO: 15403 - DNA, 1285 bp, Diabrotica virgifera
  misc_feature (957)..(975): n is a, c, g, or t
  misc_feature (1026)..(1044): n is a, c, g, or t
  misc_feature (1086)..(1127): n is a, c, g, or t
  misc_feature (1129)..(1147): n is a, c, g, or t
cgagcagaggactccatcagaattcataatcattattgtccctaaaataaccgcaacataatagtgtggaaaatgtagcatagaagtccctatgcgacactctatcaatcgcttcttccttattaccttactctacccattccagatgccaaatgacactctacgtatatttggattgactcatcatgagaatatgccaaatgcaaaactaagactttatatcttgtaccaacatgcccatcataattaccatcgaggaactccttacgtaattcctgatctctcgccacaggacactactcctatgtctttctgtgtcccgtatctatgtacaaagatccattcctcaaaggactctaccaaacacccctatgcgatacatacaaatacaattcaactcccacccagaccaaccatagagtaacatccctcgagagaatgaagagcgatacaacaagaaaaaccgggactcgtaatcaaacaggaatacacattgttaaatatgtccttgcacccgcttgattggtccaagcacgggattccagcaccccaatgaccttactactgtgcagctggagcgaacaaagagtatgttcgagatattgtctatgcgcactatatgcgctgtttggatgctgacgccacaatctccgcaagcgatgctgatgtgatgcctgcacagtgtgaataccatgtaagtactcgcgtaagcatttcaattggagatgaagtgaggatctctatgcatattttacagcgagtagcccgagattatggagtaattgcacttttgatcccacaccgatggaaggagactggaatttagttggagttcgccccatcttttcaaatttcgcaaagtaaaaacccaatggggttgtggggaaatgaaaaagcccttggaaaaacttaacaaaaaacccccctagggacatcaaaaccctacgtgccccaagnnnnnnnnnnnnnnnnnnncgccgcccttctctggaaaaacccaaaacatccttcttttcaagaattttnnnnnnnnnnnnnnnnnnntcgggggggcaagaaccacaaattccccccggggtgggggcnnnnnnnnnnnnnnnnnnnnnnnnnnnnnnnnnnnnnnnnnngnnnnnnnnnnnnnnnnnnntttattcacacattgttaaaagggaaaatttcccaacacaatgcggggggtttaagatgaagctggacgggcacacgtgttcgtcccccccctcctagatttacacacatacttttccttcttctccctttttttttt

SEQ ID NO: 15404 - DNA, 920 bp, Diabrotica virgifera
  misc_feature (262)..(279): n is a, c, g, or t
atttacattagcaatgttcaaataaatcttagaatttagaattttcgcttgtccaatcggatggttatctgtgatatttaacattaaaaacagctttcaagatgagttcctcagaggagataaaggctgagtatatgtccagtttggcagaccttaccttcaacagtaggccattgataaatgtgcttacgatgttggcagaagaaaactcacccaatgcccctgttatcgttgaagcaattgaagaacatctctcaaaggnnnnnnnnnnnnnnnnnnattaactaaaatgtggggctcataataaagtaacttcagtagggggaattttcaaataacctcattaattttaaaacagtagtatggtttatcgtgtagtaacggtatagttactatattgaatcataatttcttatatttatcctaactaacattattctaacaatacgaattggttcctttagacttaaattaaccagtgattccgacaccaagatatctcatttcttttgacagttatagtttcagcaggttcacttttgcaaaatcagtaacaatatccattgattttgattctatatttattttttggggcacattctccaatgtgcttctctcatttgaaatacgtgatggggatgatggacattcttataagtgggcttgtagctttttattgataatttaaataaatagaacttaatcgatttatatgtggttcatcatcatcactgggttttcaacccctagggggggcttatctggtttacgatcggttcattttttctatccatgaataaggttttccaatattaacttaactcctccccaaatcacccgggccctaaaaagggggtccccggcctgcccctttcccccccttccccgcttttggggtataaaaaagggattttgggggg

SEQ ID NO: 15405 - DNA, 696 bp, Diabrotica virgifera
gaatattttagttaacgtatccctatgttattgcgcgttcttttattttgcactaattgttgtacatattatgtgtataattattgttaacactcctattgtacaagttatgggagccccctaacctggtactgaggtaaattccttttaatgttccccatattcctaatgctatgaccccaacggtatcattgagatttcaagtaaccactccctgtggatatatgggaggaagtctttgacgcgaactattgaaaataaaatttgatatcaaccaactgtctatatacaatgcggagctactgaacattgattatatgttaatgtttataccccaacgtatccatcaccagacctacaaatcccagactatggtctatttctatggaggaggatttataaatggctctgctaatttccacagtgtacggaccacatagtactgtatgtaacaagacgtcatcattgtgacagattcatatctattaagaatattaggatatctttctactgtatatactgttataccgatgaactactgtttaaaagatcaacaacttgcattgaagagggctcagcaacatattcaatcgttttgatgaaaacccacatagagcaacgacttttggacgatgtgctggtggaacttctgtaactcttcatctcataaatcaaaactcgacaggtctatttaga

SEQ ID NO: 15406 - DNA, 415 bp, Diabrotica virgifera
ctcagatgggcaaaacaatctgagataccctcaatatgtaatcttttccttccaaaggaaaagattacatattgagggtatctcagatgggcaaaacaatctgcttgtctggattcatgggaatcgatattcctccaccaaacggtccactatggattttgggagacgtctttattggtaaatactacaccgagtttgatatgggtaacaaccgagttggatttgctgagacggtttaaaatttattcataaatcaatagttatatactattacataaaaaaacattgtgcatacttgttcatatgtgtaaaataagacttttttagtgcactctagaattattagttagttgctctcttagttgttttcgaataaaatagttaataacttactgaattagattaatgattgaat

SEQ ID NO: 15407 - DNA, 906 bp, Diabrotica virgifera
  misc_feature (64)..(93): n is a, c, g, or t
aaaatttctaaaggcgataaatattttaccgataatagaaataaaaactgttttagttagagcnnnnnnnnnnnnnnnnnnnnnnnnnnnnnnataagattcttacaaaatttactgttaaaaacaaaatattaccggcgcttaaataatgcaggctagattataggtctacaaaattattatacaaaatatatctataagcaacaaccagtgtcaaattcgcataaaaatagaacggggggttagacaaggagacccaacgtcacccaaactttttaatacggtgctagaacatgcttgtaagaatttggattggctgacaaagggaataaaaatagatggagaatgatggaggtggagaacagcttacgtttcaccgacgatatagtcataatagctgaggatgtagaagtgccaagaggtgtggtacaggaactcgtcgtggctacagaaaatgttggtttaaatataaacatttagaaaacaaaaataatgacaaatttggtatccgaccagcacatcagtattcgtgagaaaaaaatataactcgttgatagacatatttaccggggacatgaaattatgattgccagggataatcagacccatgaactgaagagaaaaatcggtcttgggtgggcagcatatggaaaggtaagagaaacttttaaaagtgagttgcttacatgtctgaggagaaaggtatttgatcactgcgtcctcccagtcctaacatacggagcagaaatacttacctgaacaaaagcctcagctaccaaactgacagtcatacagagaagaatggagcgatctaggttaggaataactatgcgacacaaaatatagaacatagagatcaggagaagacccaaggtgactggtgtcatcgaaaggatagccagacta

SEQ ID NO: 15408 - DNA, 843 bp, Diabrotica virgifera
  misc_feature (276)..(306): n is a, c, g, or t
  misc_feature (392)..(414): n is a, c, g, or t
accagtcattggcatgcttacaaaagataaaaggagtttacgtagatcaaggtctagatcaagaagtagaagaaagaggtccaggtctagatctagaagaagatcaaggtccagaaggcgaaggtcttcatctagatcgagaagatcaaggtcacgggaccgtagaaaaaggtcaagatcacgaggtagacgacattctaggtctcgagatcgacggtcaagatcgagaagatcaagatctccgagaagatcccgatcgaggtctagaagaagatnnnnnnnnnnnnnnnnnnnnnnnnnnnnnnnaaagtcccgagatcgcgatagaaaatcaagagaccgctctagagatagaaaaaggagcaatgaaagagaggataaggataaagatnnnnnnnnnnnnnnnnnnnnnnnggatatagaatcaccagaaaaggaaaaaacgcccaaagaagcaaaagaaaggaaaagtgacaaagaaggcagtgctgaggaaaaacgaaaatctagatctagaagtaaaagtaagagaaggtctaggtctagagatcgtcgaagggatcgaagaagaagtagatccaggggaagtagaagaaggacgccatctccaagaggtccaagaagaaggagcagaagtagaagtcgagacagggacaagagaagagataaaaaatctgataaaagagataaggaccgaagagtaagagataaaaggtctagatccagagataaagaaaaagaaaggaagtctaggtctagatcgcgagatagtagatctactaggtcccattctaagggtccaagggaatatgatgaagagggaaaaggttttgacactgaaaa

SEQ ID NO: 15409 - DNA, 792 bp, Diabrotica virgifera
  misc_feature (675)..(675): n is a, c, g, or t
gagcaacttagctgacgacctttacgtaaatgcagcttcagctgttggcggagttggggagattgttggtgactatattcaatctctgatgaaaaataataatctggacttggatagaacagctgtaataggacattccttgggagctcacgttgcggggatagtaggtcttgctcttcgtggaaaacttgactatattgtcggtttggatcctgcattacctttgtttttaattgttcacgatgacttcagattggacgccacggatgctaagtttgttcaagtgattcacacttgtgccggttttcttggtatcgacttcaatattggacattccgattacttccctaacggtggaagagaccaaccaggttgttggatggatgtagtaggtacatgtgcacatggaagatcttttagatactttgcagaatctataaaatctgggggattcattgcaaggaaatgcaataattacaatgattttcaatacaataattgctccaaagaatcctctaatatgggcgaatatcatattgataaaagggcttccggtgcatattatttggacaccaatgatgatccaccatatgccaaaaactgaccgaaaatgtatacgatcattaaaataatataaaggcattttagagaaggcgaaaacggcaggttcgttanaaaagtgttcccatgagactgttttgcatagtcttgtccgtgagaatcccaccagtgaggttcggggaagtgcctacgtgaagggtggtccaagggttttttttcaattttttttga

SEQ ID NO: 15410 - DNA, 807 bp, Diabrotica virgifera
  misc_feature (2)..(14): n is a, c, g, or t
  misc_feature (43)..(60): n is a, c, g, or t
  misc_feature (304)..(318): n is a, c, g, or t
cnnnnnnnnnnnnncaacaaccaaaaaaaatttactaaaaacnnnnnnnnnnnnnnnnnngtttaggccgctacgggccccgttgaaatcccaaaaatagaacccgcggggtttggtacgaaaactatcctcggcaggaacggggaagcccgggggcaagtcaaatctcaaaaaacggttggccggggattaacaaattttcccggagaccgcagggaatgacgaagaacccaaggggatagaagaatgccttgctcgaaaaccggaaggggggggaagggcaagtttctataaaacgtcaaannnnnnnnnnnnnnngtagcacagtattatacttaataggcgaatgcgagcgggggagggacaatgtcctctcttgccttcacacaaaaaatatggagaaattaggcgagggttactctagatttacatcgacgagaataattttgaggttatttaacagccggaatcagagactcgacggggtattgctaatttgagcgacgccttcaccaaacgcaaacaattgacacggatgtgcaggggagtggacttcgcctgccttcctaatgactccctgggggggggattggacccggacccggggggggaccatcgacccctgggtggggtatctggatacggggagcccggcggggggatgcccgcattcctttggaagacgcccgcgctcctgggtccccgcagggggcgtttcattggcccatccccataacctggtcccctttggggaagcccggggcggggtaaaggaacggctgggattggccggggaaataaggcccc

SEQ ID NO: 15411 - DNA, 1200 bp, Diabrotica virgifera
  misc_feature (356)..(387): n is a, c, g, or t
  misc_feature (576)..(599): n is a, c, g, or t
  misc_feature (701)..(722): n is a, c, g, or t
  misc_feature (847)..(875): n is a, c, g, or t
  misc_feature (988)..(1009): n is a, c, g, or t
  misc_feature (1106)..(1123): n is a, c, g, or t
tcttagtccgtgcgaataaaatttatactgaatgtgatggtatggtttatgaatcaagtgctataaagatggatttaagatttgtgccagagaatatggaatttgatgatgaaccaaaagaatattgtgataaattgccagaagttaataaatatcagccaagatttttcactactacagctctacaacaagcaaaagtggaccttacatgggacgagactgatcctaacagaatagaagtcacagagaaattaagttccggcaaattagatgacctatcacagaaagacctacaaaattatctcgccagtagtagtggtgaagaagacagtgatgtacaagaaaaggaagagtcnnnnnnnnnnnnnnnnnnnnnnnnnnnnnnnntagacaaatacaaggctttgttattagatatagaaaacaaggatacaagtaagaataataaggatttagaaatggagatatcttggggaattaatttgaaggagaaaactgataagctagctaaagataagagttctgaggacaagacgccattccaacaatatttagacaagaaaaaggagaagaggnnnnnnnnnnnnnnnnnnnnnnnngaacagaagcaggatgatgaagattcagatatgccgtcagacattgatgttaatgatccttactttgcagaagaatttaacaatcccgagttttagaaaccnnnnnnnnnnnnnnnnnnnnnngtcctaatagtgatgatgaaaacgatcagaaaccgccggaactaaagctattatttgtgaacaaaaattaccaaaaattccttttccttgaaaaaaaatacagagagtgaaaacgatacaaattnnnnnnnnnnnnnnnnnnnnnnnnnnnnngatgttgggaaagccctgaagaaaattttcaaagttattgttcaaaaaataaaaaattctcctgttctatttattaacccatccccacaaaaattgatccctaacaactcccnnnnnnnnnnnnnnnnnnnnnnggtcgggaaaatatttaaccgcaaccaaaacaatgtaaatcaactaggcttgaaaaagggccaaaaaagagggggtaaaaccccataaaaaaacccnnnnnnnnnnnnnnnnnngcctctaatttcacccttttctttgttggagaattcccacttcaataaaagaaaaacacaaactttaaatataatct

SEQ ID NO: 15412 - DNA, 815 bp, Diabrotica virgifera
  misc_feature (543)..(560): n is a, c, g, or t
  misc_feature (772)..(772): n is a, c, g, or t
aaatcaatctgagaacaaagagtgctagtatcatgttatttaaaccaattgatttttctaaatttctatatcagttaatagtgttgttttatgaacttgttgactgagtaggagcatttttcgattccaaaaccatggatattaatttctttatgggtagttttttttactatgggacatttctttgtacacaagcaaattttattaacactggaccctagatggtcatttcatttcttgaaataacttttttccttcaaaatatcctttttctttaattttctctacatttttttaaatatgtatattcctcgtcttttttgtatcaacattgttataagcttttttattaaacagtattccaggttttatttggaacatttgggaatataactttgatccagaattattccagtctgagtctgtattcaatcttgtccagattacagagatgctctagtaatcgtggaagcttagcagtactggaagactaggattttgattgagatgtgataattttgattctttgaagtaaatattggnnnnnnnnnnnnnnnnnngaatcatatagacgaaacaacattttagtcttgattctctcgtgttatttgctcttactgaaaagtattgatcaacttttaaataaagaaaatactgtacctcaaaaattatgtatttaaaaattcggtggatgttatttggtaaaggattaccaaataacacttttccttgaatatatatatattgaactttttattttgtaaatttttgntaggtttagaattattgagtaatttttacacatattatctaat

SEQ ID NO: 15413 - DNA, 127 bp, Diabrotica virgifera
  misc_feature (12)..(119): n is a, c, g, or t
attaataagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 15414 - DNA, 1180 bp, Diabrotica virgifera
  misc_feature (678)..(696): n is a, c, g, or t
  misc_feature (903)..(924): n is a, c, g, or t
  misc_feature (978)..(1018): n is a, c, g, or t
  misc_feature (1152)..(1172): n is a, c, g, or t
ttgaatatttatcgaaaaaaaaagtttatcgaataaattttcctcgtttattgagggtggtattcgctgacagttctaaaaccctcagaagttaatgaatagaatcatgcacagaagtaagtcaaagatatggtctttcacaaaacaataagaaaacaaaatgtttgttgatctctaagaacactcaacgaaaaaggtacgtaatatcaataaaaatgttaattcagacaacaaacgcaattcttaaaatttgtccaattcttggttttattgggacaacaaaacgatattcatcaattcattattttcgttcgttgagccaatgtattacgtttattgaatggatgaacattcattatgtatacgataatatcactttattggtattacgaactctgttcactgagtcaacgaacactatttattgatattacgaactctgttcactgagtcaacgaacactatttattgaaacaacaacgtcgttaattgaccgacgaagactattcgttgtgtcaataacagtgttatttctcctaacgtattttatttatttctacaattatttccgtttattgttacaattaattccgttcatttccacaataaatacggtttttcttacaagcaattctattcattcttacaatcagtttcgttcattcctactatgaacgnnnnnnnnnnnnnnnnnnnctgaatgcaatagcccaatgtatgatattaattgattaataatgattttttaaatccctcttttttgtccttaacctaatggactttatactgtgggatttttcatatgatttcacttatacagggcactgggataagtgttacactcccccccccccctattaacttatttgtttttagccctaaacaaaaagcttcggacgggcnnnnnnnnnnnnnnnnnnnnnntattataaacattcatggttttcaaagtttaacccaaccccccttcggggggannnnnnnnnnnnnnnnnnnnnnnnnnnnnnnnnnnnnnnnngaccgtcaggtggaaaagcctctttttaaaaggggttggaaaataggggattcccaaaaaagggtaaaaaaccctttttaatcctttttttttggaaaggcgggggggggcggcaaaaatttttctcaaatccnnnnnnnnnnnnnnnnnnnnntgcgggcc

SEQ ID NO: 15415 - DNA, 1131 bp, Diabrotica virgifera
  misc_feature (152)..(173): n is a, c, g, or t
  misc_feature (805)..(830): n is a, c, g, or t
  misc_feature (899)..(915): n is a, c, g, or t
  misc_feature (918)..(951): n is a, c, g, or t
  misc_feature (1031)..(1050): n is a, c, g, or t
  misc_feature (1080)..(1100): n is a, c, g, or t
  misc_feature (1106)..(1129): n is a, c, g, or t
ccttttaaaaacaacattttcaaaacctaaatattttactttaacggtgttttaattaacttgtttcagtatatttcgcagtaatggcagatattccggggttctccgatccaaataatataaaggaaactaacatccaggatgatacggcnnnnnnnnnnnnnnnnnnnnnnggtggaggattccagtctatgcatttgaattacaatgttcttaaagggattacaaaaaggggctacaaacagcccacacctattcaaagaaaaactatacctgtaattatggaaggcaaggatgttgtagctatggctaggacaggtagtggtaagacagctgcttttttaataccactatttgagaaactgaaaatacgttcagccaaaacaggggctagagctcttgtaatgtctcctacaagagaactggcactacagactttgaaattcataaaagagctgggccgtttttacagatctaaaagcagcagtaatactaggcggagactcaatggatgatcagttctcgttaatacatggaaaatccagatattattgttgctactcccaggtagatttttgcatgtatggataaaaatggatttaaaaattgaataacggggagtatgtagtatttcgaaggaggcaagataagattaattttgaaatggggtttgggagaggagtttgattgaaatcttttaaagaactaccagaaccaagaaagaacagtccctatttttttgctacatttgcctaaagggtttttatcggaatttgcttaaaaccggggttaaaatggatccccnnnnnnnnnnnnnnnnnnnnnnnnnnggaggccccaaatttcccctggaaaaaaatttaaatatgggtggggattttttcccctggtccaaaccnnnnnnnnnnnnnnnnngtnnnnnnnnnnnnnnnnnnnnnnnnnnnnnnnnnnccctatatataaaatttttatatccccgcaaaacaagaaagtttttttttggggccccccccaaacaccttctttgtttnnnnnnnnnnnnnnnnnnnnttggggtaccttaaaaacaacaaatagggnnnnnnnnnnnnnnnnnnnnnccattnnnnnnnnnnnnnnnnnnnnnnnngg

SEQ ID NO: 15416 - DNA, 810 bp, Diabrotica virgifera
  misc_feature (714)..(714): n is a, c, g, or t
ctcatttatattggcaattcagacgtattttaaagtagaagactttaaaatgataccgccaatatttatgagttgcgttcctgggacgactttactaaaagatagttcattcgattacatgaaatcaatcccaactcaagaatatccgtcacaaaaaatcatagcatgtgatctgtctttaaaaagacaatcaaatgcaacgatgacagtaaaattttcgcgttaataaataaagttctctttggtttcatcaacatctttcttatattcctcgcataaaatattaattaactttttgacttcttcttttttgaggtgttccatcctatcatttcatttcctctggcgagactcgtgggtcgggtaggttcttgaaagtagcatattggtttcctgtaccaggaaaaaatgatttcttcatctgtgaacattccgaatatatcaacaactgattcgttttcaaacagtgaataatctgattcaggaaatcgtttctcgttatatatgaaatctcccgaaacccaatcccgggctgcagaaacttttggatataccatatgagcaggtgtagataatatagatatcatttgtcaaagaaatattatatactgtcgattttgactattgaataagaatatcttcgcctattataattccatcagcagttctaacttctgcatcggaaagtagctgacgttacctcaaactttccanatctccgccctcgtactcttctcccgaatcctcatccgtcagagtagccggatccggtggggctatataaactccctctatagagtcatctatctc

SEQ ID NO: 15417 - DNA, 530 bp, Diabrotica virgifera
  misc_feature (10)..(29): n is a, c, g, or t
  misc_feature (45)..(81): n is a, c, g, or t
  misc_feature (98)..(120): n is a, c, g, or t
  misc_feature (124)..(148): n is a, c, g, or t
  misc_feature (166)..(252): n is a, c, g, or t
ttcgtccgcnnnnnnnnnnnnnnnnnnnntagggatgagctcccnnnnnnnnnnnnnnnnnnnnnnnnnnnnnnnnnnnnnctcatccctaaaaatcnnnnnnnnnnnnnnnnnnnnnnncccnnnnnnnnnnnnnnnnnnnnnnnnnatattgtaaaatatgagnnnnnnnnnnnnnnnnnnnnnnnnnnnnnnnnnnnnnnnnnnnnnnnnnnnnnnnnnnnnnnnnnnnnnnnnnnnnnnnnnnnnnnncctattatcactattaaaaacctgcatatctactataaatatatagggcaaataaaccaatccgcccaccctttttatcacctgcccatgaaaaacacgctctttttgcattaaaaataaaggctcggctgcgcgctgattaatttgaatggaaggggcacccccaccctcgcccgcgagcataatgaataggtccctctccgcaagatggaatgaaggggtgtgagaaaaaaaaaccggtctattatttaatcaagacagaatttcaactgtaagat

SEQ ID NO: 15418 - DNA, 163 bp, Diabrotica virgifera
  misc_feature (73)..(107): n is a, c, g, or t
gaaaaaatcaggtggggggggcccggaggggtatactctcccaatgggatcttccccagggggaaaacattcnnnnnnnnnnnnnnnnnnnnnnnnnnnnnnnnnnnccccatggagagaaaatttttaaaattgtggcttttgggggggggggaattttccc

SEQ ID NO: 15419 - DNA, 889 bp, Diabrotica virgifera
aaaattaatcttcacaaaatgtgttgcatgtatgccaggtaattaacaaagctaatgagttttttaactatttgaacactttactataaattataacataaataatttgacagcaactttatttctgtttaggtattataaaaaaatagtttatgtttacgtacagtaaaacttatttaatcattcattgaaaaagtttatatttgcctcctttacataataggcctggatcccgcgtaccaaaaaaaagttttaccgtaacatgatcagacccattctcggctatagctgtcatttatttggatcagcgaccaatacacttctaaataaacttgaaattcaaaaaaataaatgcttaagattatgcctaggttatttaaaatccactccagtccaaataatggaaaatgaagcagtggaacctccattgcatttacgccgccaatttctcagtgataaatttacaactcgaattctgtccaaaaaatgtaaaataccttcaagatctacatgatctatcagttttagacctaactcataggtactggagaactaaaaaaatctatacctttggtagaaagttattccaagtacggaaaagtaccgggaagttatctataaaaagccaaatttccccctttactaacagtgcaatgacaaaaacattattttccaacaaggtaaaaacatgttatttaaactcccatcccccgccaaatatgtttgaattccttattagaaaaaaatgggccaaatttttccgaaccttttttcccgagggactaaaaaaaccaaatggaaagggttgggcccaatttccccccaaataaaaaaattacccccccccatataaacccccccctttggagggtccaaaaacccagcgaaa

SEQ ID NO: 15420 - DNA, 165 bp, Diabrotica virgifera
  misc_feature (90)..(123): n is a, c, g, or t
agcttattagctgtgtttttctgtctagtgagcagtgatcaaccacaaaagacaacatgtgtgacgacgatgttgcggctcttgtcgttnnnnnnnnnnnnnnnnnnnnnnnnnnnnnnnnnnccggaaatgacgcaccccgtgccgtcttcccctcaatcgtcg

SEQ ID NO: 15421 - DNA, 593 bp, Diabrotica virgifera
gccgagtttttccttccctctttaagtcaagatgatgttaaacaagaacctgttagtaagagaatgaggtaccaagaagaagatttccataaatctggtgctgcgttaggtcctgattggtacaaaaatcttattatacaaggggctgggggtttaagtatgccatctactgtaaaagtccattacgaaactgaaataacactagttgagagatcgaaagacgctaaacatgctttggaagtaactttatccaatggtgagaaacttgattgtgatttaattatttctgccactggtgtaactccaagaatgtcttttaagtcacttaattcacttgaattatcagaaaatgatgaaataaaagtgaatcaatatatgcaaaccaatcttccaaatatatatgcagctggtgatgtctgtagtgccaattgggacctagcaaaacattggtttcaaatgaagctgtggacacaagcaagacagatggggtcgtatgcagacaaatccattgatggacacttaaacaaagaagaggtcttgcaagatttttgtttgaaatgtttgctcattcaacaaaactattttggatataa

SEQ ID NO: 15422 - DNA, 213 bp, Diabrotica virgifera
  misc_feature (9)..(29): n is a, c, g, or t
  misc_feature (32)..(44): n is a, c, g, or t
  misc_feature (92)..(104): n is a, c, g, or t
  misc_feature (106)..(133): n is a, c, g, or t
  misc_feature (147)..(163): n is a, c, g, or t
  misc_feature (165)..(181): n is a, c, g, or t
caaaaaccnnnnnnnnnnnnnnnnnnnnnggnnnnnnnnnnnnnggggcccagggggggtatcttccaaagggttcccccaccggggaaaannnnnnnnnnnnngnnnnnnnnnnnnnnnnnnnnnnnnnnnnaatagaggaaaacnnnnnnnnnnnnnnnnncnnnnnnnnnnnnnnnnnttattcccctccaattttgccctcccggggac

SEQ ID NO: 15423 - DNA, 749 bp, Diabrotica virgifera
  misc_feature (220)..(238): n is a, c, g, or t
gtttatctaactttatatcgtttttcatttaatataaagtgtgatccaaaattattgtcaccatagatggctctgaacggcagagatagctatacagtgcatgtctattcttaattcagatatactttccagtttacgtcaactttgcagtgtacgtcaacttaacaaggaaagttaggttatgtagagatgttggtggtggacatatacagcatcttgnnnnnnnnnnnnnnnnnnngttacttataattttgttaattctttttatttttgattaaagttctgtgctaaaggttttgactgattttttatgttttataatgttaatcaaaattaattgataaaccaatgatataaattcaggttaaaggtccgatccaataattgtggatcgctcgttattattaaacattaggtaccatttcgtcgccttagtactataacttgataactccaaaattgacgtttttgagataactagttcacaagatgtatttcatttgcctccatattgtgtaaaaacttgatagctcacttcaaacgggttaagtatttatttatgattgacgaaagttgataaaactcaaatgccactaatagtcagtgctaaaacttgacaagataagttatcaagctattatttaatcgaaataatcgtgaatacgacatacactgaatgctataactagataactcgagttatctagttttagcacgtgtttctctgaaaccattgaagttaccacata

SEQ ID NO: 15424 - DNA, 751 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (169)..(192): n is a, c, g, or t
  misc_feature (203)..(248): n is a, c, g, or t
  misc_feature (250)..(345): n is a, c, g, or t
  misc_feature (382)..(401): n is a, c, g, or t
  misc_feature (515)..(535): n is a, c, g, or t
  misc_feature (626)..(650): n is a, c, g, or t
  misc_feature (713)..(740): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaacccggtgtgagccaggttggtttctatcnnnnnnnnnnnnnnnnnnnnnnnngtacgaaaggnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaaggaccaaattttactaccgggggttgggaannnnnnnnnnnnnnnnnnnnggcccccaaaattaaattcccggggccgcgctttttaaaacccccgggatgggaaaaaccccggggtaccccaaattaatatcccttgggaacaactccccccttttcccccannnnnnnnnnnnnnnnnnnnngcccccccacgccccccccttcccccaaatttggcgccccctgtaaaggggaaaaagggggaccccccccctcggacgcgcccattaaaannnnnnnnnnnnnnnnnnnnnnnnnaacgcgcgcaggggggaacctcttcaacatttttttacgcggcccccctaaacgccccccccnnnnnnnnnnnnnnnnnnnnnnnnnnnntttcttttttt

SEQ ID NO: 15425 - DNA, 559 bp, Diabrotica virgifera
  misc_feature (138)..(164): n is a, c, g, or t
  misc_feature (214)..(237): n is a, c, g, or t
  misc_feature (275)..(290): n is a, c, g, or t
  misc_feature (515)..(542): n is a, c, g, or t
ttcgtccggatgaatatcgaatacaccatctacaattccggccgaatcttcctttatctagcatctatctcgtgggctgtttggtatgagatttaagtttaccaatacaatttgtttataatactaaacaactcaaannnnnnnnnnnnnnnnnnnnnnnnnnngaattgtattataactaccgtcaccatatatacaattttgggagtggtgnnnnnnnnnnnnnnnnnnnnnnnnctggttaaattcaaatagacgaaaatgaacaaacaatnnnnnnnnnnnnnnnntacaattattattgacctgaagaaattttgaagacatatttatgacaaaataataattttaacacctgtaaaatcattaaataatattcaccaaattgtacttaagagattcgcctttccaatatatctacttaatttttgctactgtgatcatggattaattggtaaaggtgttttgggaaactggtatcattgtgtttttgggttaggtccaatttctgctcnnnnnnnnnnnnnnnnnnnnnnnnnnnnttccagcttttccttgc

SEQ ID NO: 15426 - DNA, 749 bp, Diabrotica virgifera
  misc_feature (2)..(169): n is a, c, g, or t
  misc_feature (172)..(187): n is a, c, g, or t
  misc_feature (189)..(208): n is a, c, g, or t
  misc_feature (218)..(257): n is a, c, g, or t
  misc_feature (262)..(329): n is a, c, g, or t
  misc_feature (332)..(371): n is a, c, g, or t
  misc_feature (393)..(411): n is a, c, g, or t
  misc_feature (425)..(443): n is a, c, g, or t
  misc_feature (498)..(517): n is a, c, g, or t
  misc_feature (528)..(546): n is a, c, g, or t
  misc_feature (604)..(648): n is a, c, g, or t
  misc_feature (665)..(748): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnngnnnnnnnnnnnnnnnnnnnnggttttttannnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnnnnnnnnnnnnnccttaaggggataaaaagccgnnnnnnnnnnnnnnnnnnnaagggtcccaatcnnnnnnnnnnnnnnnnnnnccacccctcaatggtgggaattaaaaggtttatataattgggggggagacaagcnnnnnnnnnnnnnnnnnnnncttggtcctcnnnnnnnnnnnnnnnnnnncaatgagattcgggaggttttaaaaccgcgggggggggaccccagggttgtggttttnnnnnnnnnnnnnnnnnnnnnnnnnnnnnnnnnnnnnnnnnnnnnacaaaaagggggccccnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 15427 - DNA, 660 bp, Diabrotica virgifera
  misc_feature (11)..(30): n is a, c, g, or t
  misc_feature (55)..(70): n is a, c, g, or t
aataaacaatnnnnnnnnnnnnnnnnnnnnactagtgatcttattcgtatacagnnnnnnnnnnnnnnnntaataaaaaacactggtgaatttacaaaagtaaattataggggaggaaatgaagacgtcatattaacagtcatgctggaaatccagtcatttttaaagagcagaaattatattatagaaaaggacatcccaaatacaatacatgacatgcagctacaagatattgtcctctttcttgctcttaacacatcctacaagcattctttgattatggaggaatactcacatctcatcaacattacaccccctctatccaagtgtctctttgctaatgttgtatatgggcttgatctttgtaagtactattgttccgttattgaaaagctgccaatacaaaatagcgtggaactcttggatgaagtgtcgcagtgtttgaagaagtctactccagatatacatctgaaatatgccaatatgttccttacagctactgcaaataaaatatccagcactacttattccagcgaggtagaagacgatgttatcaacttatgtgaaagtagttaacaaatattaatgaatctgtccggtatgtataccaaccaataaaagactggaagaaagttaaaatctataaccacatgggacact

SEQ ID NO: 15428 - DNA, 196 bp, Diabrotica virgifera
  misc_feature (4)..(41): n is a, c, g, or t
  misc_feature (61)..(74): n is a, c, g, or t
  misc_feature (77)..(99): n is a, c, g, or t
  misc_feature (107)..(129): n is a, c, g, or t
  misc_feature (159)..(190): n is a, c, g, or t
cagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15429 - DNA, 442 bp, Diabrotica virgifera
  misc_feature (2)..(181): n is a, c, g, or t
  misc_feature (221)..(240): n is a, c, g, or t
  misc_feature (310)..(332): n is a, c, g, or t
  misc_feature (350)..(365): n is a, c, g, or t
  misc_feature (368)..(423): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagggataaacgcggcaattttattggaaagttcaaannnnnnnnnnnnnnnnnnnnacccccaatgttgggatataagtttttaaatgggggggacacactttaattttttaaagcttggtgtccnnnnnnnnnnnnnnnnnnnnnnngattttggggtttaaaannnnnnnnnnnnnnnnacnnnnnnnnnnnnnnnnnnnnnnnnnnnnnnnnnnnnnnnnnnnnnnnnnnnnnnnntccaaaagaggggcccccc

SEQ ID NO: 15430 - DNA, 680 bp, Diabrotica virgifera
ttggaaaatatcacccttcttctttctttgatctcttctgcctctttcttgcaaaatattcatcatttagccaacacacgaggtctattagaaatacaatcactccaggaacagttctcatccttttagctgggtctcacaaaggaaagagggttgtattccttaaacgactggactctggtctacttttggtaactggaccttttggaattagtgtctgcccattgcgacatattaatcaacgatatgtgattgtctgatcatcgtatacaaaaaagaagttagagttttagtatggaaataataagttccagggaacaacattaagtttgtatggcactattgagattaatgttatatgataattttcttggatgattcctgcatattgttacatagagcaagacatataactttaagattaggattaacgttacgatatatgattgagattgataatttatggataaatacataatactatttatatattagctcattgagatccgcgtggaagtcctccgatcttataccatatatagtttgtattgaaaccattagaaacggaagttcgacgctgaaacattcctcaaacgctgtaactgctaatataatcgcacgacacttaattattatctttttttagaaatactggaccaaaaaatatcaatacaaacatg

SEQ ID NO: 15431 - DNA, 692 bp, Diabrotica virgifera
catcgtgatcattgaagataaatatggaatccttaagaacatgatggaatccacttcgattgtcttactgcgaattgatctatacgtgctattgctaatcggacgaacatgcttgtatattaatactatatgaccgcccctctgtcgacattagggaaatcgaatccacatacatacaaagaataccctgactatcacatactaatctagatattaccctgtgccagccgtaacatgtggaaaaccctcccacgacacaaagactctcacagaaaaccatatgggtgactgaaacaatacatatatggaaaaagatacagctctatgctcatgttctttctgtgaaattttatgctgaatttaaaacaccattcccagactgtgaatcacattgtccatggtgtttaagatgatgatcgggaccatcctgaaacccccatttctatgaaggattcgagtacagtcctcgaccgataactttccacaagcaccaccgaaaagaccgattgcaacttatgaatgatcttcgaggaaagcctgttgaaggatttgcatctaaatgtcactacctgcaagaaggatgctagaatgagacgtaattttttcgtttatatataccttacaagtaaaaggattgctattgattgacaaccactatttatgctatccttttaataaatattatgaatatg

SEQ ID NO: 15432 - DNA, 350 bp, Diabrotica virgifera
  misc_feature (55)..(75): n is a, c, g, or t
ggataacagtcaaacaaatatttaatcgagacggcgcagcgtccctaatgaatcnnnnnnnnnnnnnnnnnnnnntgtgtaagaaaattgtcggcataggttcttctactactactactactactactactactactactactactactactactactactactttaggttttaagttatagactcttactttgtctaaaatgattagcaaaattttctaaccgactcatagactagaagtaataatataactgcgatccgcttggtatagccaggcttgatgcttttattgttccatgcagtagggatggtgcgcggactcgattaaatatgcgactgtgcagtaatca

SEQ ID NO: 15433 - DNA, 780 bp, Diabrotica virgifera
caactgagcctctgcaacggataattttggcggaggcctcttgttaacaaagttgctctaacaaaatcattaatttttttgggccactttgctggatcataatcactaagaacattgtttagtgtgacggtagtagtgacatcagtaagtagatgatatagatgctgatgattgtcctagatgactgtcgatggactgatagggggcggcagctgacgtggatgctgatgataaggctaggtctgggtgaatgttggcagactcaaagggagcggtagcagctgtatgttctctaggttgagcaatattgtcagcatcagtgtgtaacgattttaaaaatttacctagagaaattttaagccgtttagtttcaatctccttctctgctctctttttcctgcactgacgaccagaaaaacgttttctaccatccattattgctctcacacaattatttttaataacactagacacttaacagtattctggcacacaacggtacggaaattgcactgtacaacaattgatctaaactgatttaaaaactaaacacggtaaaatacctacaagcttatacaattaaacgaaatacaaaaacacaataaaattgttaacagcacatctatgagatctatggaaacttggtaacaaggtatacgaagagcgtgagtcaacagatatcagttatcagtcggtgctactgcatcagaaccataaaaagaatcctgggagggaggtatggtgaaaggttagttctgatcccactattcttatgcgatg

SEQ ID NO: 15434 - DNA, 729 bp, Diabrotica virgifera
ctcacgatttacgcgtcatcttttacgattgcttgtattagtgttgaagataaacatcttattagcttattatttaaaactataagtaataattatagaaagggacaagggactacatcgggtagctctatcttgtagtcgctattaactcctatagtcgctggaattgaggctggatcatttggggagtggtgttgtatgtgaagcaattactatgatggatgcaaagttgttggaagaccgattgcctcaatttattcccgaacctttaccagaccttactcacgatattccccacgaaagcatcgaatcctatactatccacgaggctgaccacgacgttgatttggacattgccatgtttttgaactttttggagaatgaagaggtaaatgaatcggctgaaaatatgatacgaaaatatggagtaggaacatgtggaccaagatgtgtttacggagctaccgacggtcctctcgatgtacatcacagacttgcagactttctggatatgtcacagtctatggcttattcctacggttatgccgatatatcaggctctattgcaggatattgtgcaagatgtggcactggatttctagacgaggaaaccgactttccaatactactaggagtactagcttgcgtaagaactattgtgtattttgaccagaatgatgcacatagtgtgacaagagaagtgaagagagagatgaagaatgagaataa

SEQ ID NO: 15435 - DNA, 223 bp, Diabrotica virgifera
  misc_feature (173)..(211): n is a, c, g, or t
taacagcgtaattttattgggagagttcaaatcgataataaagattgcgacctccgatgttgaattaaagtttaataattggtggaacagctatattaattaaattctgtttcgatttttaaaatttttacatgaacttgaatttaaaacccgggggggagccacagtttggnnnnnnnnnnnnnnnnnnnnnnnnnnnnnnnnnnnnnnncaaaagggaccc

SEQ ID NO: 15436 - DNA, 565 bp, Diabrotica virgifera
cccacgcgtccgcaaaaacaaatgcatcacaaggcaatccaagtagtttttttcaagtcccatctagtgtatcagataattcatccaatacaagtaagaccttctcctctgccaatacttctaatatacaacaatcttgtatagtatcttcaccttctactacagttgctaaggaatatagagttcctcaggctcctgcacgtactacatttttaacttctcctaatgcttcccgtactactatcgaaaaggcttttgcttcaccgcctagtaaacaacaggcgtcatctgttcaacagcagattcaaactaaagcccagacaaaaatttattcagaacttggcaaccaacaagaaagacaaaggccaagtaatgaagaaacacaaagtcaatcatctccgatcagcttctctatcatggatgcacctggacgtttaaactatactggtagtaattcatctggaaagagaccacctcagttcccacacaattatagacattaccagcaacaacaacaaccacaagggagctctaactctggagaatttcagagggctaaaagggg

SEQ ID NO: 15437 - DNA, 749 bp, Diabrotica virgifera
  misc_feature (84)..(102): n is a, c, g, or t
  misc_feature (239)..(256): n is a, c, g, or t
  misc_feature (512)..(527): n is a, c, g, or t
gcttttactggtacacctagaagatctattggacaccaaacaattgcaatatttatttattcatttagcattctttaatagggnnnnnnnnnnnnnnnnnnnggctagaaaatatcaaattaagtgattacttaattttgaaaggagtcatatcagatgtgttatatgcttgcactattttagaaactaaaaacgttcttggtaaaatacattttagaattcattaaatttttgaccgnnnnnnnnnnnnnnnnnnaaaagaccgcagtaaatgacgaagaaaatatgaatataaatggttgaattgctgaacaattggaagtagtttgtaggcctgttcctataatatgttttcgatgatttgcatcgctaaccatagataaataataggcaaatgcgagtgaggaagtgactatgtttaatatttccttctcaaatataaatatggagaaattacacgagggttaccagagatttagatcatcgagaataattttgagtttatttaacannnnnnnnnnnnnnnncgacgtcgtattgctaatttgagcaacgccttcaccaaacgcaatcaattgacacggatgtgtaggggtgtgcacttcgcctgccttcctaatgactcactggtggcggatttggacctggaccgggggggtacgatcgacccatggctgggttatctggatacggcatgtccgctgtggggatgtcgtcattccctttggaagacgccagcgctcctgttt

SEQ ID NO: 15438 - DNA, 788 bp, Diabrotica virgifera
  misc_feature (64)..(82): n is a, c, g, or t
  misc_feature (622)..(622): n is a, c, g, or t
catcattcgaagcacaatcacgattcaagcgattcagacagttcttccgattcctccagttcgnnnnnnnnnnnnnnnnnnnataagcattcgaacagacataagagatctttacattaccaacctaatgtgcctgagatagattcccctgttgttaaggagcttttagaaattgctgccaaacatctcggctatgaaaattcccagattgttaccattcatgtaactgatttagatcctcattattacatgttagatgtgatatttgagaagaatcgtgtctacgcagagtgtttggtatacatgaaacttaacgatgttgatactgcacagtctacagtagataaagttaaatgcgtcaatcaggatggcacacctctttctagacacgtaaggcaagttccaggaggtatatctcctatttcaaaagatgatccaaaagtaaagcgttacttaaaagatgggttgctacatttggataaagagtcctcccatgaattcaaatttaaagtagtcgaaattttggaggtttctagacaggttgtcagcggttctctccatcgtatcaaagccaagatagctttatccgattgcaaaaaagagagcaatattgacgcttctncatgcggtgtgcaggcaaatggtcagtcaacaatttgcgatttcaaagtttgggaccaaccttggattgaacatggaagagaaacaaatattacttgtcatgatgactcacttgaaaaaaacaacatcattcgttcagattacgaagatcacttgacgataacgat

SEQ ID NO: 15439 - DNA, 900 bp, Diabrotica virgifera
  misc_feature (84)..(101): n is a, c, g, or t
  misc_feature (121)..(139): n is a, c, g, or t
  misc_feature (784)..(823): n is a, c, g, or t
ggcaacgtgtggcaaatatcaaaaactgcaaactgtatggtgttccgaatgtttttgatgggcagcaaatgtgttaaacaatgnnnnnnnnnnnnnnnnnnagattctatggtctagagtnnnnnnnnnnnnnnnnnnntgagttaattgattaaagaacgtggggacaaaatgatcccttccggctttctagataggtaagctaagcccgactttttagtgttaaacagtttttcaaccgcggcactatataaagacctctttttcagtaagtttgtgcaaaaaaatcaaatcggaatattttatcgaacggggtcgacaatacaacctggactaaatgtcgaaaagagtggaggtcgtagctcagcaatttacaattcttatagtaggtacttgcctactaagctgaagtgctcacgttcgattccccatcattgatactagaaattgttcagtttctaatttaactgagctgccaatatgtctcggaggacacaaaaatgaaaatcatcaaattaaaaatcactaaaatacaaattctggaagaagtagcagatgagcaccatcgaaaatctggggcaaacgcttaggtaaggctcatgccattaacaagtctgtgaagttgaccccatataggaattaatgttaggaaaaatatatttgtgtcttccaagtcattttttcttttatttttgccttgattgcaccgtctttttcacttttttccctaatttagtcctgtgcaacatttgaaataatttcccgtcctttcccaaaggaaagnnnnnnnnnnnnnnnnnnnnnnnnnnnnnnnnnnnnnnnngtttaccccttttccattatattatgtaggtaagaataaaaaaacctggatccccccgcaaccaaaaaaaagttttt

SEQ ID NO: 15440 - DNA, 618 bp, Diabrotica virgifera
  misc_feature (372)..(392): n is a, c, g, or t
ctacaatactatgacttcttctttattctgacttcaaatagtaacaacactgatgatccagaatatgagcattgtctatcgcgttaacataaaatcatcccaattgttacttccatttctgaaagctaagttgtatttgttagagtatgaactcgtgagcatttgtgtgtgaacttgaatgaaatggactcgaagctacctgtaaataaactcactttgcattttaaccaacaaattgttttatcattcggggagttgatttgttcgtttagtctgcgatatgtgtgcatcttcaaatcgaaatgctgattcttcctctctagtttcatccatcctattgggaatccatcatatgaattcccttggagttannnnnnnnnnnnnnnnnnnnngttttgattatttatgtaaaatcacgaatcgtagagctttatttttctgtatttaccatgttttgcaaaaatatgtacatctttaaaattcacgtttctttgttattaatgtaaccagtgttcagtctcagggtataatgggaggtttttgttcaatgtctaggtatttcacaattttgatggttattaaataaaaccaccaaggggtgccactttttaaattgcg

SEQ ID NO: 15441 - DNA, 705 bp, Diabrotica virgifera
  misc_feature (541)..(541): n is a, c, g, or t
agctctagagaggcagaacaatatataaacactaaatcatatttatcacgtggccatctttctcccgatgcagattttctttttgcaagttctcaattgacaagttatttttatatcaacacctgtccacagtggcaaagcatcaatggaggtaactgggtcagagtagagtcagctgtaagaagggtagctgacaaataccacactacctttttaataataactggcactcatgatgtactggaccttcccgatgtacatgacaatccaatagaaatgtatctagtttcaaaacgcaaactaccagtgcccaagttcgtctggaaaatcatgctcgacgaaaattctggaaaagcaatagcctttgttagtttaaacaatccgtttgtccaagaaatcacagaggatgaacagttgtgttcagatatttgtgagcaatatggttggggatcaaaatattatagtgatttctctaaaggttatatttattgctgtgatgttaatgaattaagagaaactgttgacacaattcctgttttanatgttaatggtattttacaagcttagcgttttaagatattgaacaaatatatttacataaataaatacatattataatgaaacattttctttttctaaatcaaacaagaagtttcaacacataatatgtttctgattgtcatttgttactaataacacgattgc

SEQ ID NO: 15442 - DNA, 509 bp, Diabrotica virgifera
agcctcgtatgacactactattttaaagtttaagaagtaaaaacaagcatgccacatacaccaagcattattattattggagcaggtgctgcgggtattgcagcggccacaagattgttgaaacatggaatatcgaattttaaaattctagaagctgaaaatcgaataggaggaagaatatattctactcagttcggtggaagtatagtagatgttggtggacagtgggttcatggagagaaaggtaatattgtttacgatatggtgaaagatcttaatcttttaagttcttctgtcaatgattatgaagataatacattttatctttccaatggcacgcaagttaccaaaaaacttagtgaccatctttttgcaatatatagtgaggtagttgaaaacgcagaggatgctcgagatatgcaccatccctatgctgatattttataaaaagtatatcgaatatcattacaagttcaggacgacgcaatgcttagaatatccaatattta

SEQ ID NO: 15443 - DNA, 776 bp, Diabrotica virgifera
caaggaaaattcttaggagttacagagcactaattaaaaaaaagatttgggagtgctgatttgtttataaataaaataacacactttctgcagacttgtcataccccatattactaatatatgcaatcttaagattcgattttagcaataaaatagctggtaaataacttttcccaaaattatcaacaaatgttgcggtggttgcatagccaataaatccaataaacaggaggaccaacccaaattctgagcagtgtcaaaatgataacgttaatatccccagttgtaactaatatcaaaatgaataagaatcgctataaattgcgaccatcatggcggcgtcgaaattaaatagcgacctcgaaatgaattagaatcagggtcctgattttgatttctaggaaataataacctgtggagttaatcattgttccaagatatgcatattggtctactcgttcgacattggttccgtttatgaagagattttcgttatttttttgagatttcgatattctcataaattttctattcttgacgttcgttgctagaccgtattcttgtccaaactccgctattctggtcaccagtctctgaagatccttaatattttcggctaagataactgtgtcatccgcatatctaatattgttaatgggaactccgttcacctttattccagctgtttgacagtgaagagcttttttcaagatctcttccgagtagacattaaaaagaattgtcgacattaagcatccctgttcaccccacacccc

SEQ ID NO: 15444 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15445 - DNA, 458 bp, Diabrotica virgifera
cgtctctggcacttagatcacacattgggttaccttttatattaacacaatgttggatgaattggccagatacgtgatcgcgtacaatttacttggtaaattagaaacgctacttacagaagtccacgaattctttttagaggagaaaaatagagaaagctgtaaccatggtattagcagtaccaagagaagatataggcatcaaaggatgaatataagaaggaacatccacatgtgaaagaatcataagtctaagactgctacgaatcgtactcacttacatatctccttcacatattccaaggcctaaaataaatctactagatactcacagaattgaacttttagatagacaaaatcgtcccactacaagaaaggaacattgagcatgatatctctccaaattaacatggtccacgcgggcggtgtcaccctccacatctccctgagtatatcct

SEQ ID NO: 15446 - DNA, 486 bp, Diabrotica virgifera
tgaaattattcacgtttagttgttgagtgaatctgtttcttctgcggtttcttccacgatggattgttacagcacgaagaaaattttggtgctctacgttggaggaaccattggaatgaaaaaaaatcataatggaactcttataccagcgcagaatgcattcttaaataaaattaaaaacaatcctgaactacgacgcaaaatgggcgaatctctttttagaagataggttaaaagaaaacgaaatggtattaccacagagttgcggagacaaaattatttacagaatgattgaatattctccgttactagattctagcaatatgacctccaaagactggattagaatagcgagagatattgagttttattataacaaatatgacgaattcgttgttcttcacggtactgacacattggcgtatacttcttcagcgttgtcgttcatgttagatggcttaccaaaaccagttattattacaggat

SEQ ID NO: 15447 - DNA, 993 bp, Diabrotica virgifera
  misc_feature (5)..(23): n is a, c, g, or t
  misc_feature (850)..(869): n is a, c, g, or t
  misc_feature (929)..(949): n is a, c, g, or t
aactnnnnnnnnnnnnnnnnnnnttgtgtcattctctggaaatgatgtcgttgtggactagcaaattaagtcaggatgtacctaagaagattttggatatattaaagaacggcattggtctgaaaacatccactcctgcagtcaaaatagcctacattcaatgtatgatcgccactttcaacacaaaaacaataccacaagcctcaattttcatccccatccttactaaatccgttgaaaaagctgtcgctcaaccaacaatcgcattatcggtaacggagggcctctgtgcagcactgttgctgtttaaacttgccagtgtccaaaaagataaggataacgatttccagagtgtttggaatgccgtgctggatatggaaaaacagattttcttcgcggagaagtatttgtcgactactactgaagaaagtctcatatacgtcatgcaactctgcgaagtattgctcgtacagtaccccgagaaactaaagaaaccagaaccaattcacagagctgttctgtattgcacaacagtttgttccagtagtactagacggaaatgtctagcaatactcaagcgaatagtaggcagcctaagcggagctgctatagctagatctttgttccaagaactacaaaggtttttagaaaccaataaagtaatcaacgagaaatcggaggataacaaagagagtgacaacaattttttgagttctcctaccgttgtggaaatgataacgacattgtgctccttggctggttatcccccgaagatgtgcagtttctagttatcaaattcttactgccacctccttcccccttctgttgggaacttaatggcaaatttgtnnnnnnnnnnnnnnnnnnnnccttccctaaaaaaccaaaagattttgggggctcggcaactttccccctcccaaaccccnnnnnnnnnnnnnnnnnnnnngcacacactttaacaaaagaaaaagggtttaccccctctccccc

SEQ ID NO: 15448 - DNA, 582 bp, Diabrotica virgifera
  misc_feature (92)..(117): n is a, c, g, or t
cagaagaagatgaaaaacgaagggtagatatccgtcacatagatatttgctccgtggatccacccggttgcactgatattgacgacgccctnnnnnnnnnnnnnnnnnnnnnnnnnnaactggaagtaggcgttcacatagccgatgtatcacactttataagacccggtaccgctatagacatagaagctgcttcaagagctactactgtatacttagtcaataaaagaattgatatggtacctgaacttcttagttctaacttgtgttcattgagaggtggagaagaacgatttgctttttcgtgtatttgggaaatggataaagaagcaaatattttgaatactcgtttccataaaagtatcattaaatctaaagcggcaatgacgtatgaagaggcgcaaattattattgatgataagagcaaaaacgacaccgttgcattttctttgcgaggtctcaatatgcttgctaaaattttaaaagaaacgaagattagaaaaaggagcccttgttttggcgtctccagaagtgaaaattcctatggactctgaaacgatggaaccactagatgtagaagtg

SEQ ID NO: 15449 - DNA, 127 bp, Diabrotica virgifera
  misc_feature (86)..(110): n is a, c, g, or t
tgaagaaacctttttaaaactttgaaatgtggggggaattaatccccttatttccccgggcaaaaaacaactcctcctccccccannnnnnnnnnnnnnnnnnnnnnnnngggttggaatatcaccc

SEQ ID NO: 15450 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15451 - DNA, 656 bp, Diabrotica virgifera
  misc_feature (63)..(88): n is a, c, g, or t
  misc_feature (108)..(128): n is a, c, g, or t
  misc_feature (145)..(180): n is a, c, g, or t
  misc_feature (353)..(353): n is a, c, g, or t
  misc_feature (454)..(454): n is a, c, g, or t
  misc_feature (503)..(503): n is a, c, g, or t
  misc_feature (574)..(574): n is a, c, g, or t
aataaaacgaccgtttgtggggagagaaatttttgaattcccctttaaaaaatggtataaaannnnnnnnnnnnnnnnnnnnnnnnnnttatgtatgtagatgttagnnnnnnnnnnnnnnnnnnnnnagtttattatgaaatannnnnnnnnnnnnnnnnnnnnnnnnnnnnnnnnnnngggtattgtgttaaaagatgaagataaagataaagatggtaaataattattgaaagtagttatgtgtagatggttgatagttggagaagatttatttaagatgatagagatttagttaatataatttgtggtagaatagaaatatagaatggaaatgttgtaagaaggatttnatgatgatgaaggagatgttggtataaagaagtgtgatagaaatgaaattattatgatgtatgtatataaaatggtatgaatttttgataaaggttgtttntatggttttggttgtgtattgtgtggtaaagtaggtattggtatgaaangatgtattatgagaaggaattataagattggtaaaaaggaagatttgtatgaaaagggtatttaaagtagnattttaatgatgggtagttatgttgaagatattgaagatgttgaatttggtaaaatatgtgggtttggtggtgttgattaat

SEQ ID NO: 15452 - DNA, 156 bp, Diabrotica virgifera
  misc_feature (75)..(93): n is a, c, g, or t
  misc_feature (117)..(141): n is a, c, g, or t
tctgttttgggggggggggtattttcccccaatttgacccccggggaaaaaaaaaacctccggccccccataacnnnnnnnnnnnnnnnnnnntttggggtttagaatatccccccnnnnnnnnnnnnnnnnnnnnnnnnncgggaggggagatat

SEQ ID NO: 15453 - DNA, 929 bp, Diabrotica virgifera
  misc_feature (739)..(753): n is a, c, g, or t
ctgtactcatgccttagagccatgtttggattatctgttagtggaatattagtttgtattttttcctgtatgctagtctatcagcttttaagtcacgagaagaagaaaatgtattgggagcagcttgaacttcgatgccgatcgttctatcaacaacattctggaccgcccagtaaccatggatcagtaagaggtcctcccatgcctccatctacatactgcagttgctgtgaggaatgtcgatatccatccattacaaccggcccacaggtttatccttgggataatcacattactaacgagaggttttggactccaggtagagttggtaacttttattctccaaacccagaagataatactccaaatatttcggacaatcataacaatagaataagatcattaagtggctggagctggaggaggttaccttggagtaggagtaatgttggacaaaataattctcaaagaggcaattccatagcataccaaggaggtgctagcagtgcagacagtcaatatggattcagtaacagatcaggagcagacacaaatatgcaagatcaaatagctggctcgacaggatcgtacagcattttagacaatcggcttccaccgggaggggtatatgtttggggacctccaccaccgtattcgaatccaaattctccagctagaagacctattcaatctccaggaagataccaccacattcatcaccattcccacggacacgaannnnnnnnnnnnnnnaacgaaaacagtcagttcagtagaacctcccgtcggactagacctcattttaataacaaagataactatgaaaacaccacggaaaccgaaattcatcacggaaatgataacaatgaaagtactgacacatctagttgcgtagaaagagtttcacatactttaccagtgagaaaaat

SEQ ID NO: 15454 - DNA, 99 bp, Diabrotica virgifera
cagagtattactagcatttgaaaggctactggaatagtctggctgtgtagagtactaatgaccaattgtcatcaacaactgtactgattttccgttaat

SEQ ID NO: 15455 - DNA, 105 bp, Diabrotica virgifera
ccaattttaaggatataattctatattgtaacatatttttaatgatgaataacttttttcccgagcgaaattcaaatttttttcaataacccgtataacaattat

SEQ ID NO: 15456 - DNA, 866 bp, Diabrotica virgifera
gggggatgtgtcacgagaaaaatcttatttctctggactaacagtgcaacaagttttttaatagctaattaagtcacacatttagaagagatctactatactggatgaggtatttaaatgcagaaaagctggtcgctaagtggcaaacaaaatgtatagttggtcaagtccgggtcctaaccatgagatggcgactctaattaattttcgatatgacatttccgtagccctaacctcaaaatttcatgtcattcggtttatttccagagacatgttaaccgtagacaaggcatactaagcaaaaaagcgtaacgcgcgactgtcgatcggtggtctatctaactctttttactaagcgataccgctcataagacggacaaaggtgactagaccactcaaaatgaatattgaccaatggcgtccttaatatcggcgttacacatcgatgcacagagcggcccatagctagcctaatgtacaggctaatatatctatgtttatttcccgagttacagagctttaagtgaggctagacgctgcttttgagagttttataactaatggattcaaagcaatttagtgtgttgatttatcactgttatttgatgggaaaaaataccgaccttatcaccagcgactttagactaatcagtttcattagccacacacttaagatacttttaggctagaaactagagaggcaccgattttctacgtgttctattttctcaaaaataagtttttgagttccgaaaaaacttttatgtttggtatggttggtttcttctcccttccaaaaaggcttttgaccaagttaacccaggatagacctttttccatttccccgccgcacccaaaccccccta

SEQ ID NO: 15457 - DNA, 364 bp, Diabrotica virgifera
  misc_feature (13)..(14): n is a, c, g, or t
  misc_feature (18)..(350): n is a, c, g, or t
gcctgagccctgnncagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctaagcttgg

SEQ ID NO: 15458 - DNA, 428 bp, Diabrotica virgifera
gtagcgttacagaaattaaaaattattacgtaaaaattctaaccttccaaataagggaaaatggcaagtaaagggcttttaaggaatttaaataattatagcaagttttgtaacttttcaagtataaacagagctttatcatcaggcaagataatttacaataaatcacaatcttctggtggttctattcctaatgtacctggcctttctgacaattgtgtaaaagtgcccagctcacctgtaggtcctggagctgcaaaaaatactgggtataagaatccagaatacttctgttatgataaaaacagttacttcgaagctgaagtagaaatgctagaacatcgttgcccccaaccatctgtgcatgtaccatactatcctacctccaaatagattaaatttagttaaagtttatgttttagaatagt

SEQ ID NO: 15459 - DNA, 196 bp, Diabrotica virgifera
ctgagactcaagacgggagggaatcgggagtaattatccttctgaacaccagagactgatctatgcaggcaaaatacttacagatgaaacagctttgtgagaatataatatcgatgaaaagaaatttattgtagttatggctacaaagccaaagcaatcagagaaaacagatagtggagatggaaactctacgccc

SEQ ID NO: 15460 - DNA, 714 bp, Diabrotica virgifera
  misc_feature (80)..(97): n is a, c, g, or t
  misc_feature (147)..(165): n is a, c, g, or t
  misc_feature (402)..(402): n is a, c, g, or t
tttcgtccgattgaatataatgccttttatctaccttatgtagataatcttttgaaaacaaaaacgaggattctaatgcnnnnnnnnnnnnnnnnnncacttacacgagacagatgaccatattttggtacaaacaaaaccaatcgnnnnnnnnnnnnnnnnnnncactggaaaatatgtatcaaacttaatttgagtgatacattcaagaagaagtaaccttgaactacaaataggtcgaatctctctgcgaaattttacttaataatatggtaaatagacttggaagcgtacgcgagttgttggctccatatggtacccttgggcgttaatgggtcaattggacatttttctatacatacatatatacaattttagattatttatttctaatttagaaantatgcgaatattgaaagttgtctatactttatttcacgttaagaacagcacgtttggcctatgcagatcagtgttgtcaggcatgtgttgctactagactgccgatataagattcattctcgataagatagaagcggcatcatcgctctcttatcttccataagaaacacagcacagtcctatctacgcaacctttcgttcttaacgtaaaacgctgtatatgttattcgttctgagtatttagcttttttgatctatcgcttttatgatgacccaaaacgatagttggtgaattgtacctttgttgtacta

SEQ ID NO: 15461 - DNA, 465 bp, Diabrotica virgifera
cccccccttttatgcgcccaattagtgaagcttttatgctgagagtcccctctaacacggtgcatttacttgatttccaaagaagcaaaatgggataaagagaagatatcatatcaacatcatggtcatgggacacgtaaattgagatgaaatgactactactggacatttaattgaaaaatgtgccgagatcagaaaacgaattatcgaaaattcccaaaaacaagatgcaatatttggtaatgaggtactacaaatatgccgtgttaatacataaaattatggacgaaacaaagcgaggtattacaaattgatatcgttttgcgcaaatgggaaagatctaagtactatgtaaacagcattgatgcacccaggacacagacagatcatgaaacaacctgaacactgttacattatactctgactgtgagaagaattataagtgcaactgccacagcagaatat

SEQ ID NO: 15462 - DNA, 185 bp, Diabrotica virgifera
gagaatccgagcataaacgtaaccatgcggaaaatgtgcgtaagacgaggtgcgcaagattatggtgtatgagggatcattcaagatatgcgctggtgtactgcgtctagacttaagcgccgatgagagagcgtggtattaccattgagattgctttgtggagattggaaacagctaagatatta

SEQ ID NO: 15463 - DNA, 418 bp, Diabrotica virgifera
cctttaggggacctctgtgtcatcactaggttttttttaccccttttaaccatgtctgacgaataagaagggtactccgtatgagtatgtggaggaagaataggcttaatcaggctaccccccctagaaataaggaatgggatgatgatgcctgttcataaattttgcatttcagcgataatccgagatatgatctagcggaacgtgcgttagagacagctggacaaaacggtgtatgaagaagtggaagagaaagggcatgctgcctgtgaccatgcacgtatctatgacttaagatgttaaattgtgaattgttttatacagaaggtaaagaatctagatatacaatttactgtattttttctacctaacgtggatagcggaggcggatacaataaagaattagattgctctttga

SEQ ID NO: 15464 - DNA, 249 bp, Diabrotica virgifera
aagataaagtagaatatagtttgttcccccattcttctggattagataaattttgtgttagaggagttaatgatgtatatttagagattaagagagaggtagtagaatgagaggtcatgtaagaaatgttaatgggaggatgggggaattaaatatgtattatgtgtaaaaaaagaaggaaaggagatgtagatgaagttaaatttttaggatttttgaaagaaaatgaatttaggggtatgtggataa

SEQ ID NO: 15465 - DNA, 491 bp, Diabrotica virgifera
  misc_feature (38)..(68): n is a, c, g, or t
atttaacatagcagaacaagtgtgtactcggctgacannnnnnnnnnnnnnnnnnnnnnnnnnnnnnnactgccaaacaatataaaacataaatgaattacattctcctatggcttttctgtaacttcaaccctgatgatactcttctcctatataggtaaacttgtgcgaataaatcttggcaaccgtattttcacaagctcttagatatggcaagtttgctagtaaagaaaagagtaaacgtttttcaaaatttctcatagagatccctatagcatgactcaagcattattatgtggaggctctgaactgcgacgctgggggattcgacatggctactgctggatacctgctgaaatatggagccccatgaattgtcccagatttgataaatctaggagaggggatgcaactaacttcaatcaagtccagcaaattagaactctggataagtgtggcagggagcgctacgaagccatccaatcatttaa

SEQ ID NO: 15466 - DNA, 519 bp, Diabrotica virgifera
ccttaaagggaatccaaccggatgacggcttagagcggtcgcccttttttcagcgattgttttacagagaacaaaggagcgggatgcgatttgctgcgtaagactgccaccatcacgttgccccagctacgctaacggatctgaacgaggttagcacgagctgattgctcatctatattcctcagctctaatcaacatgtattatacacaatggactgccactggtaataaggctggtgaaggtaagcgcatatgactcataagtgagtcatccgaagcgcctagaaatacaaatacgatttacattttcttcttgtacaacaaagattgaaccaggcatatatggagcagatggatgtctgatatactaactgagactagacactgtcccagcacccatccaagttctattttggtagcttttatagagaatgacatttccaaatcgggacgccggataaccccatccacccatcacacccttcaaccatccgagtgaaatctaaaccaaatcgtctt

SEQ ID NO: 15467 - DNA, 386 bp, Diabrotica virgifera
  misc_feature (61)..(61): n is a, c, g, or t
  misc_feature (73)..(73): n is a, c, g, or t
  misc_feature (78)..(78): n is a, c, g, or t
  misc_feature (108)..(108): n is a, c, g, or t
  misc_feature (346)..(364): n is a, c, g, or t
gcgtacatgagtgcgggtttgtatgtgtttattttgcttattcttgccataaggggagacnggggggatgganggggngatggagtggtgggaggggggggtgggggngtgagaagagggcccccgcgcggttaggggaagggaagataagggatgggaggggttgttgtgttggtgatgaggaggggaggaaatgggagaggagaggtgggagggggaggggggaggaggtgagggggggtgggtgtggggggggatggagtgagtggagtgaggtaggaaatagggaggtggtaggggtggggggtgggagagtgaggatggaggtggaggggggaggaattgnnnnnnnnnnnnnnnnnnngggaggggggaggggggtgggg

SEQ ID NO: 15468 - DNA, 919 bp, Diabrotica virgifera
  misc_feature (11)..(722): n is a, c, g, or t
  misc_feature (733)..(794): n is a, c, g, or t
  misc_feature (796)..(835): n is a, c, g, or t
  misc_feature (845)..(892): n is a, c, g, or t
  misc_feature (894)..(917): n is a, c, g, or t
ttttcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggaatgannnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnataaagttcnnnnnnnnnnnnnnnnnnnnnnnnnnnnnnnnnnnnnnnnnnnnnnnnannnnnnnnnnnnnnnnnnnnnnnngg

SEQ ID NO: 15469 - DNA, 713 bp, Diabrotica virgifera
  misc_feature (25)..(25): n is a, c, g, or t
  misc_feature (51)..(68): n is a, c, g, or t
ttcatccgcatcattcgatctttgncaataattttgtggtgctttgtggcnnnnnnnnnnnnnnnnnncaaacatctgggttattctcgaaccacaataacacattcttatgacctcatgatgaatttgagcgaatggaggcctcaggagagcataataaaaaacatcgaagagactttgcagttagcattagtaccaaacagcgatgctcagaaaactgttcaggacaggctaattcttatgaaaagtttgacagacttcccaaattatctgttattcattttggggaatccaagtttttccgaagatatcagatcccttgctggaattgtactgaaaaataacatccaaacatcacatgctacgttgagtgccgaatatttactaaaaattaaaagtgaatgtcttcgcctgttgaaagatccttcaagggaagtaagaatcagtatcagtaacatcattgtgataatcgctaaagataacctaaaaacttggccagaaatagttccttacctaactaaaggatttgtcgctcaagacgaattcagtgaggtagcattaacaacattatttaaagtgtgtgaagaattaatcaacagtcaaaaacccccaagatgaaatttacaagataaccaaagaagtttttccaaaaatttgtagaatttgtgggactacaaaaatgtaacgttcgtcaaaatatagcgagacttacc

SEQ ID NO: 15470 - DNA, 602 bp, Diabrotica virgifera
  misc_feature (271)..(290): n is a, c, g, or t
  misc_feature (422)..(441): n is a, c, g, or t
cgttctgagatgagcagggatgtgcgattcctagatgctccttccttcccaccaacggagctttggcaacagctactaagtcttcatgatagagtcacatagattctactcactggtcgtgagttcttgaccaccaagattgtggaggccctgataggtatcaccacacttaatctacttgttgcactacccccgtatacgactggtgtggtaaagagaaaagggccggaccgtttgcccttcccgacaggtgtgccatcggaatgagagnnnnnnnnnnnnnnnnnnnnaagtcttcggtgagtagtattgagcactttatattattttcctactccaaaataatcatatgcagattttgcattttatgtcaaaaaaatatttagtgccatgttaaagaagactactattttgatataggnnnnnnnnnnnnnnnnnnnngtaccgatagtttttattctttaaaaaatatttgttcggtacagctatttttatacaaattttattgtaatctcgtttgaaaattaactttttaaattcgattatgtccggttttcacagaactccgttgaatccagaaaatctaagataatgtatatatc

SEQ ID NO: 15471 - DNA, 169 bp, Diabrotica virgifera
  misc_feature (2)..(44): n is a, c, g, or t
  misc_feature (55)..(131): n is a, c, g, or t
annnnnnnnnnnnnnnnnnnnnnnnnnnnnnnnnnnnnnnnnnnacaatatatannnnnnnnnnnnnnnnnnnnnnnnnnnnnnnnnnnnnnnnnnnnnnnnnnnnnnnnnnnnnnnnnnnnnnnnnnnnngccctcgcctggccccctgaataaattttgaatggccc

SEQ ID NO: 15472 - DNA, 577 bp, Diabrotica virgifera
  misc_feature (12)..(12): n is a, c, g, or t
  misc_feature (16)..(17): n is a, c, g, or t
  misc_feature (26)..(26): n is a, c, g, or t
  misc_feature (35)..(35): n is a, c, g, or t
  misc_feature (67)..(67): n is a, c, g, or t
  misc_feature (71)..(71): n is a, c, g, or t
  misc_feature (95)..(96): n is a, c, g, or t
  misc_feature (130)..(130): n is a, c, g, or t
  misc_feature (135)..(135): n is a, c, g, or t
  misc_feature (139)..(139): n is a, c, g, or t
  misc_feature (181)..(181): n is a, c, g, or t
  misc_feature (184)..(184): n is a, c, g, or t
  misc_feature (220)..(220): n is a, c, g, or t
  misc_feature (228)..(228): n is a, c, g, or t
  misc_feature (297)..(297): n is a, c, g, or t
  misc_feature (310)..(311): n is a, c, g, or t
  misc_feature (546)..(576): n is a, c, g, or t
tttctgggggangaanngagaaatgnggaaataanaatttccttttaggtttggatttgatgtttanaatntagtaaggaatatgatttataganngatgatgaatggtggaagatagctatattttatnaaatntatngaaaataatttaaagattatgatggtaatgggataggtgatntanaaggtgtgatagaaaagttggattatattaaagatntaggagtnattggagtttggttgtatgatattttgaaatgtaaagaagatgataatggatatgatataagtgattanagagatattgatnnggagtttgggagtatggaaatatttttggagatattgtattatgtatataaaggagggataaaagttgttttggagtatgttaagaattatatgagtgaatagtatgaatggtttaaaaaatatgaaaatggagagaagatttatgatgaatattatatttggaaagatggaaaagatggatgaaaaaatgaatatagaaagaatagggttaatgaatttaggagataatgaagnnnnnnnnnnnnnnnnnnnnnnnnnnnnnnnt

SEQ ID NO: 15473 - DNA, 279 bp, Diabrotica virgifera
  misc_feature (3)..(35): n is a, c, g, or t
  misc_feature (37)..(51): n is a, c, g, or t
  misc_feature (53)..(113): n is a, c, g, or t
  misc_feature (137)..(178): n is a, c, g, or t
  misc_feature (181)..(206): n is a, c, g, or t
  misc_feature (210)..(250): n is a, c, g, or t
tgnnnnnnnnnnnnnnnnnnnnnnnnnnnnnnnnntnnnnnnnnnnnnnnnannnnnnnnnnnnnnnnnnnnnnnnnnnnnnnnnnnnnnnnnnnnnnnnnnnnnnnnnnnnngttggatggaaaaacaaatggccnnnnnnnnnnnnnnnnnnnnnnnnnnnnnnnnnnnnnnnnnnccnnnnnnnnnnnnnnnnnnnnnnnnnncttnnnnnnnnnnnnnnnnnnnnnnnnnnnnnnnnnnnnnnnnncaattattctataacacaaatttatttca

SEQ ID NO: 15474 - DNA, 437 bp, Diabrotica virgifera
  misc_feature (167)..(187): n is a, c, g, or t
agttttagtcatgaaacaatcgcaacaaattgcactcgatctctaaaattaatatagaattttagagctcttgtgcaattacaactgaaaattcgatgaaatagaattattttgacataatattcgaaagtcaaatctgtagacaaacagtggttttgaatcgtcgnnnnnnnnnnnnnnnnnnnnntcatgctaaccaattatattgaaagtttggttttgacaaccttgtcaaagaattaatttaatttgtgtattttcatatttaattaattcaattaattgattaagatttggtcattttttaaacgctcgaaggaaaatgattattcgtaactcttgcagaaggtgtcttttccgcgctcgtctgcttgtcaaaaaaacaaaacgacgatgttacatagaagaagctaacacacccctgccccctgtcaacg

SEQ ID NO: 15475 - DNA, 573 bp, Diabrotica virgifera
  misc_feature (540)..(540): n is a, c, g, or t
cgcgccgacccccccttttcctttgtttatctcaattatatagatgaagctccccattgggtactgtttcagacagacccgagcactgggatatacattgaggatagactagaacatagcgtgttgaaagtgacgaacaactgttactaccagggatgtgtcattttctgctgaaggcggatatctttattgacgacttggaaaacaacattgaacaccttcgagactcagaagaaagacgacagttgaaatagccgttcgtggagaactttgctttaagacggagaactggtgtcactgctttgagtgaatatgttgaaggaagcgatgaacagcctggaaagtacactgtaactaatcttggcaaagctgctttggatattgagttgaatcgtatttcaccagttcaaactctcgaactccgccgcactacggtagagtctaatacatttgttttcttttgaactcacagatcaattccaatctacccgttccggaacgctatcaacacaggccacactgaagatgcgtcttaccacntgaggaggagatgttattgaagatcttgaggat

SEQ ID NO: 15476 - DNA, 578 bp, Diabrotica virgifera
  misc_feature (11)..(11): n is a, c, g, or t
  misc_feature (18)..(18): n is a, c, g, or t
  misc_feature (23)..(23): n is a, c, g, or t
  misc_feature (25)..(26): n is a, c, g, or t
  misc_feature (67)..(67): n is a, c, g, or t
  misc_feature (104)..(104): n is a, c, g, or t
ttttgagcggncagagangaaangnncgcgaggaggaaaccttttaaccaaaagcaaaacacaacangacaacacagccagagcaacacccaccactgaaaagnggacagaacgcgaacatgaaccactaattaaagtaaaagactagttgggaaaagtcggattactgcacacttcttagtacattctattgtcatctgtcaagttttgacaattcaattaaaaagtgtcaccctttgtaacttgattgtgtaccatgattattcactaattattatgcaacccattcagcagctctgtatcactatgaagatactttcaaggcgcttgaaattaaaagaaactgaaattgctaggatgcgtctaataatttgagcagtgactgtataattatgttatttttggtattagggaaatactgatccaatgctttgagtaaattcctactcaaaattccgcactgcgcgaaagaaataagatcaattaatttatttattgtagagtgttttcatattatggctttctttatacgactttgggaagagttattaacttatcgtactttatattttattgca

SEQ ID NO: 15477 - DNA, 345 bp, Diabrotica virgifera
ggtcgcttttctgtaacacgagactgaattcagttatgattcttattctttaactcaacaattgtctgaatacaatgagcatatgccatatgaaatacaatttgctatgataaaatacccacatatggctaccttgcctttatcaccacttgatttccctcttaactacagtaggaaaactgatcgagcacccatgaactagcatatgcggcacgctgtgttttcctgaacaccgacttccaccaattcttgctcagagtcttgctcagcgccgattatggtgacatgatctccatgcgtagattttttttactcaagtacagaggaagactgttgccgagatta

SEQ ID NO: 15478 - DNA, 351 bp, Diabrotica virgifera
gcattgtgaaaaaatgaaggatttgtttggtgaagtgttcagttttaagtaaaaaaacataaagaagcttttatggagtctcaggattacaccactaggtctggaagtctgaagaggtctagcagtttcaaaaagttgttgaaattgcccaactggggatcttctagctcaggttattaaagttgaagaagtaaaggctagcaacaccagaaggccacaagttaaacaattccacgattcaaagatcagtttcccattacctaaacgtatccaacacaaatcaatgaaccgtttctcagtccgcaaacccagaacatactttttgaaaattatgttattatgggtagttga

SEQ ID NO: 15479 - DNA, 336 bp, Diabrotica virgifera
ctttcgcggatggtccactatctatacctaatgtgcatggcccttgacgagtatataatgcgcctctcttctgagtatgttagagaatattgaggaccttctaactggagatatttacttcgctacgccacaaacgagtatatttccaatcgaacgcgaacagctgcatatgctggcacaacatctcgacaaccacatcgtcgaggaccagcgtcactaaggtatgggacactggttcgcacatatccgtcaggaacatatatgcattgcttaccggcgagggaccaccgctaacggcattcgttatatcccaaccctagcccttaaattcctgtt

SEQ ID NO: 15480 - DNA, 656 bp, Diabrotica virgifera
  misc_feature (12)..(30): n is a, c, g, or t
  misc_feature (172)..(382): n is a, c, g, or t
  misc_feature (384)..(403): n is a, c, g, or t
  misc_feature (421)..(438): n is a, c, g, or t
  misc_feature (548)..(563): n is a, c, g, or t
  misc_feature (565)..(577): n is a, c, g, or t
cctttcgtgtannnnnnnnnnnnnnnnnnngttatattgtttgctggaaaatacagtccttaggatgctcgtcacgacactacaattgtttgtatagttcctataattaacttataaatgtcataatatgatgtgttctttatgttataaaattttatcgaatcctaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnncaccggggggggggaacnnnnnnnnnnnnnnnnnngggccccaaaattatttttccggggccgctttttaaaaaccgggggggggaaaaacccgggggtccccccattttatccctttggaaacacccccccttttccggggtgnnnnnnnnnnnnnnnngnnnnnnnnnnnnncccctcccaaaattttgccaactttatagggaaaagggacccccccctttgagccatattaaaacgggggggggggggg

SEQ ID NO: 15481 - DNA, 803 bp, Diabrotica virgifera
  misc_feature (144)..(166): n is a, c, g, or t
  misc_feature (297)..(313): n is a, c, g, or t
  misc_feature (453)..(473): n is a, c, g, or t
acggtctatatcaaggctatagcagattgtaccattttgcaaagtctttgagtaatcctaaaaaagcagatggtaaaaggaagaaagttgatacagacaaaacaacgcaatcttcgcaggctgcagctttgaaaaaagaatctnnnnnnnnnnnnnnnnnnnnnnngattccagatacaatatggaactttcctgttgtgaagaaagcgttgagtttattacatgagcccaagttaacatggacgacggttacagaagcaaatacagtaaaaacgaagaaggaactccaccagcacnnnnnnnnnnnnnnnnnatatctggtacaacaagttaaacgccgaaaagacttggaaacgttaaccaaaaagacctatttcgatcatgtaacgtacgtagcttcgattatatttaaaagaataatcaaaaggttggaagagtttgtagattttgacnnnnnnnnnnnnnnnnnnnnnttggaatgtttcggaattattttgaatctggttaatgcacagtacaagtccaatctaaaatcatttttaagtaaagttgtttcagaagaagatagtaacactgaagacatgataacttcactaaactctatagttgaaatctaccagaaaatatttgaaagaggcgaagaggaacttgccgatgatcttgaacagagaaagttgtctttaattgccattactactctaaattcgctaatttctcatgttcctgagaccagcagtattctatcagtacagatggtagaatggttaaaaaactacgcctaccataatactctttcctcgaaa

SEQ ID NO: 15482 - DNA, 574 bp, Diabrotica virgifera
gaaaaagccaaaacgggggaaaacgcaaaatcgacagcaaaactcaaggaaggagaaaaacaacaaaaacgaagaccacgtcaccactaaagacaaaacttcataaaaggaccaaatttcacaataagaacccacagactaaaaccgaaaaagtatctaaaggactacgatacacctctaagcacaaccaagatctactgaacagtactgggaagatgaagccctaaacctacaacctaatacatgtcactactatagtgatatatggactacagaaagacacgcgatagtattctcagggaatatccagaatactacaccaagaatacagataacgtctcatatgaacaagatggcacagaagttcgcaaagaagaaggaaaggtggctgcttctgctttatatcgattataattcaaatggaagtagtatagacacttctaaatcctcagacatatgatcaaaaagtgcatttattgcgatcgacatctacggaggattttggcacttctaccgcaagagtatacttaactgacgccatccaaacagacaaggctccgctccgaattatgat

SEQ ID NO: 15483 - DNA, 684 bp, Diabrotica virgifera
  misc_feature (491)..(511): n is a, c, g, or t
  misc_feature (575)..(592): n is a, c, g, or t
  misc_feature (619)..(649): n is a, c, g, or t
gtttaaatatgtacaggctataactgtgcaacataagaagtacgaaagtaaatggcgctaataattattccaataaacaacaatgtaatttgcaatttactttcgttcttcttattttgcacagtaaaatattcgttgtcgaagtaatccaaaacaggcgtatgttcgtagaatagggtgtagcacatttttgtatagagggttgttcatgctgaaccttgggaatattgacgaaaaacgtggaaaactgcgaatttaccgatttctacctcctctcccccccccaaacccgacgctggaatggtgtgacttttttctgagcattacgtggccatatggagcagtttggtgttggaggataactttcactttggatgtctgggatatgccattatttggatcaactgtatcatactatagggtgtattttctttctttttagcatatgttgatagttttatactatttaaacggaaggtatttaaaattannnnnnnnnnnnnnnnnnnnngtaaaactttcgattgaaacaataatattgtaattgctatgaatttggtacatagctagcatgnnnnnnnnnnnnnnnnnncttttattcaatttaaattatcctttnnnnnnnnnnnnnnnnnnnnnnnnnnnnnnnatctatatcggatgtacttatacagtgtcacccat

SEQ ID NO: 15484 - DNA, 506 bp, Diabrotica virgifera
tcttgaccgctctctgcattttgtacaccatctcctactgtcgcgcagacttattctgagagtacaggttcctattacaagactttctattagttctgttgatttaacgaccagaattatgagcactgcggttactttacctacaatgaatataaacccaagtatgaagtccgatccaagacctattacaccacctaaacatcccgatacaacatcgccttcaatagcccaaacctgtgaggaaaagctcttcttggataaaaccacgttgctctttcccagatagatgcattaaaattgtcaccagagaaattatcgacgacatctgcatcctcgactccagtagtatcttcctcgatacagcttcatcatctgaggagcttcacttgcctatgtctcctcctttgcttgctatccactcccatataagaggatccgcaaggagtgacgataatactaagaaccgaagtctttgtaagagtgaacagcgacgataaatgcggctt

SEQ ID NO: 15485 - DNA, 431 bp, Diabrotica virgifera
  misc_feature (251)..(267): n is a, c, g, or t
caatttggagtggtccttcgaagcattatttggctacattttaccaatcagcctgtattcgggtctaggataattggttccttatatttatgaggataaaaccccattctggcctaaacaagctggatcttccttggagtgccggaaatgcttcgaatatattaataccgactgattgctttggaagggatgattattcagttattctgcaagcatgaaactcctcgtttacttgatgtcagcgattttannnnnnnnnnnnnnnnncgattccaaatcaacatatatacctgattatgcttgcggtgactgtacacgcgatccaaccgtctgtaacaggatcctttgtggcactccatattgttggaagtcggacgggaaatgtcatcatcatccagagcattaaccttgaatggacttaccctgagttg

SEQ ID NO: 15486 - DNA, 425 bp, Diabrotica virgifera
  misc_feature (12)..(12): n is a, c, g, or t
  misc_feature (20)..(20): n is a, c, g, or t
  misc_feature (48)..(65): n is a, c, g, or t
gcgacgaaaggnaaagaagngacacactatttgcggactttgcatacnnnnnnnnnnnnnnnnnncaatcataagattcgattccagcaatggaattgccggtaaataacttttccttgtattttgctaattagcccagagtattaatgatttttagcgtttccctatctgtacctattctcctcagaacattttcgttggtggagtggagggaacaaggaaggactatgaagtggagaagcatctagagttcaaatgttgcaagctcgagacatgaaagatgcacttgacgaatgagaaatactaggacagttgaccggacatgtatcacactcatcaccgtacggcgactcaaccagcctgagctatagcaggagaagatctccaatgagaagacttacatcgtagcatcagactcaatatcc

SEQ ID NO: 15487 - DNA, 616 bp, Diabrotica virgifera
  misc_feature (26)..(46): n is a, c, g, or t
  misc_feature (48)..(73): n is a, c, g, or t
  misc_feature (75)..(120): n is a, c, g, or t
  misc_feature (122)..(139): n is a, c, g, or t
  misc_feature (141)..(266): n is a, c, g, or t
  misc_feature (279)..(291): n is a, c, g, or t
  misc_feature (293)..(316): n is a, c, g, or t
  misc_feature (318)..(330): n is a, c, g, or t
  misc_feature (336)..(355): n is a, c, g, or t
  misc_feature (357)..(375): n is a, c, g, or t
  misc_feature (400)..(421): n is a, c, g, or t
  misc_feature (423)..(447): n is a, c, g, or t
  misc_feature (579)..(601): n is a, c, g, or t
gaggttaaaaataaaattgtatgtannnnnnnnnnnnnnnnnnnnngnnnnnnnnnnnnnnnnnnnnnnnnnngnnnnnnnnnnnnnnnnnnnnnnnnnnnnnnnnnnnnnnnnnnnnnngnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctttttgtgnnnnnnnnnnnnnannnnnnnnnnnnnnnnnnnnnnnngnnnnnnnnnnnnngtgagnnnnnnnnnnnnnnnnnnnngnnnnnnnnnnnnnnnnnnngtgggaaggaggggtggatgaaagnnnnnnnnnnnnnnnnnnnnnngnnnnnnnnnnnnnnnnnnnnnnnnngagcttggatttttttgaaagacgagaaaccttattgaggattatatagtattagggaaggttgtttaagtttaaatgtttttatgtgatgacttttttttagttgggggggatgagaaaataaattggacnnnnnnnnnnnnnnnnnnnnnnngtaagggattttttt

SEQ ID NO: 15488 - DNA, 475 bp, Diabrotica virgifera
cctcctcttacctactgcacgtacataattctccttctgtttctcgtactgcattcatcgtcttcagcgcctgcctattcagatcctgagaacatagctaaatcgtaatcagactgcaccctcagactctacaccagacccactcgcagttctatccagtagtactcctccaatgtctcccggagatgcactaaaaactcataatatagtgcaccgtacggatacgcctcgggaaaccgctaagtaagtggaaatcttatcctctgtaataacctctcggagctccaggataccaggacgtcgactatcccaacattcttactagttggatcggctacggatgaagcttctactgatcgacgcgacataactatactgcgtctttaaaggagacatgtgctactgtggatactcattctgaggctgaaccatcaactctgaggattaaaatgtcgtatacgtaatcgatgtatat

SEQ ID NO: 15489 - DNA, 1068 bp, Diabrotica virgifera
  misc_feature (4)..(386): n is a, c, g, or t
  misc_feature (393)..(430): n is a, c, g, or t
  misc_feature (450)..(463): n is a, c, g, or t
  misc_feature (466)..(488): n is a, c, g, or t
  misc_feature (496)..(518): n is a, c, g, or t
  misc_feature (548)..(579): n is a, c, g, or t
  misc_feature (586)..(667): n is a, c, g, or t
  misc_feature (678)..(705): n is a, c, g, or t
  misc_feature (724)..(743): n is a, c, g, or t
  misc_feature (747)..(762): n is a, c, g, or t
  misc_feature (764)..(778): n is a, c, g, or t
  misc_feature (780)..(796): n is a, c, g, or t
  misc_feature (805)..(830): n is a, c, g, or t
  misc_feature (1017)..(1045): n is a, c, g, or t
ctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnntaaacctaaannnnnnnnnnnnnnnnnnnnnnnnnnnnccactaacatgatataatnnnnnnnnnnnnnnnnnnnncacnnnnnnnnnnnnnnnntnnnnnnnnnnnnnnngnnnnnnnnnnnnnnnnncccatatannnnnnnnnnnnnnnnnnnnnnnnnncccgccctaaaaaaaaccaacatttaacccccgggggggggggcaccaaatttcttttttttaatgggcccccaaaatattttattccgggggcgcgggttttaaaaaagcgggggggggggagaaaacaccgggggggcccccccatattataccccctctgtgggccaacccccccctccttccnnnnnnnnnnnnnnnnnnnnnnnnnnnnngaggcgccccccccacccccccc

SEQ ID NO: 15490 - DNA, 532 bp, Diabrotica virgifera
  misc_feature (53)..(76): n is a, c, g, or t
agggccgggatggaggggcgggcgccccttttgccctttgagggtattagatnnnnnnnnnnnnnnnnnnnnnnnncccaggtagtattaacattgatttggaaagaatgaaaagaggcagaagaagatactgtaaatctcttggtctctggaggctactaacgcggtatattcaggagtgttacagatcaaatatagactccgagggaggtctcgaaagaccaaacataagaaagctatgatgttcaatgtcgagaaaagtatgagtagtgagataagttagcgagggtcatagttcattgtaggatgagtgagagcgtggtatcacctatgatgatattctatgtgatcactatgatgcggatgaataggaatcctgcattaacggcactgtatacacttatttaatagagaaacgtgagcacagggacattacgagctaagagcgctaggatcaatgatgctgttgggaatcgtgaatctgaaactgggtatacaaaggatgtgacagatattgaagcatgctattcat

SEQ ID NO: 15491 - DNA, 533 bp, Diabrotica virgifera
  misc_feature (27)..(90): n is a, c, g, or t
  misc_feature (142)..(154): n is a, c, g, or t
  misc_feature (156)..(168): n is a, c, g, or t
cgtctagttctcgtgatcttttttacnnnnnnnnnnnnnnnnnnnnnnnnnnnnnnnnnnnnnnnnnnnnnnnnnnnnnnnnnnnnnnnntaagtattgacaattttctcaatttttaagcattgtcttctacaccatttcnnnnnnnnnnnnngnnnnnnnnnnnnnatacagttgattctacaaggcaagattgtgaataggcaagactgatgtgaatagaataagatgggtcaatgtggtcgccatcatctcattgaagataggaaccttctctgcattaacagtaattctcacattgtttccgaaaactcaggaaattatctgaaaaactgcaaccgatatttcataatgttgccagatttctgctaatgattgtattttaccctccagtagtcatgtagaatttgagaaaaagcatagtagattcgaaagaccgatattaaatgaacgttagtttctgaaaataaaatgcacccaaatccttggacgtgtatgttgaattatacgaaaatgtttatcaagaaccatat

SEQ ID NO: 15492 - DNA, 916 bp, Diabrotica virgifera
  misc_feature (10)..(42): n is a, c, g, or t
  misc_feature (48)..(915): n is a, c, g, or t
cccccgccgnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 15493 - DNA, 1039 bp, Diabrotica virgifera
  misc_feature (2)..(69): n is a, c, g, or t
  misc_feature (74)..(115): n is a, c, g, or t
  misc_feature (119)..(146): n is a, c, g, or t
  misc_feature (172)..(228): n is a, c, g, or t
  misc_feature (233)..(268): n is a, c, g, or t
  misc_feature (298)..(352): n is a, c, g, or t
  misc_feature (360)..(427): n is a, c, g, or t
  misc_feature (443)..(531): n is a, c, g, or t
  misc_feature (544)..(589): n is a, c, g, or t
  misc_feature (595)..(624): n is a, c, g, or t
  misc_feature (626)..(705): n is a, c, g, or t
  misc_feature (733)..(751): n is a, c, g, or t
  misc_feature (759)..(802): n is a, c, g, or t
  misc_feature (831)..(893): n is a, c, g, or t
  misc_feature (897)..(910): n is a, c, g, or t
  misc_feature (913)..(935): n is a, c, g, or t
  misc_feature (944)..(960): n is a, c, g, or t
  misc_feature (962)..(1017): n is a, c, g, or t
cnnnnnnnnnnnnnnnnnnnnnnnnnnnnnnnnnnnnnnnnnnnnnnnnnnnnnnnnnnnnnnnnnnnnttttnnnnnnnnnnnnnnnnnnnnnnnnnnnnnnnnnnnnnnnnnntctnnnnnnnnnnnnnnnnnnnnnnnnnnnnataattcccccccccctctttgtgannnnnnnnnnnnnnnnnnnnnnnnnnnnnnnnnnnnnnnnnnnnnnnnnnnnnnnnncgctnnnnnnnnnnnnnnnnnnnnnnnnnnnnnnnnnnnnctgttgtggttggttgcaggagaggggagnnnnnnnnnnnnnnnnnnnnnnnnnnnnnnnnnnnnnnnnnnnnnnnnnnnnnnngtgtgtgnnnnnnnnnnnnnnnnnnnnnnnnnnnnnnnnnnnnnnnnnnnnnnnnnnnnnnnnnnnnnnnnnnnntcttttcttacctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtcgggggggnnnnnnnnnnnnnnnnnnnnnnnnnnnnnnnnnnnnnnnnnnnnnngtggannnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnntttccctctccccaactcaggcacccgnnnnnnnnnnnnnnnnnnngacaaatnnnnnnnnnnnnnnnnnnnnnnnnnnnnnnnnnnnnnnnnnnnnccacaaaaaacctccccccacccccttcnnnnnnnnnnnnnnnnnnnnnnnnnnnnnnnnnnnnnnnnnnnnnnnnnnnnnnnnnnnnnnncacnnnnnnnnnnnnnncannnnnnnnnnnnnnnnnnnnnnngggcccggnnnnnnnnnnnnnnnnntnnnnnnnnnnnnnnnnnnnnnnnnnnnnnnnnnnnnnnnnnnnnnnnnnnnnnnnnggtggagggagaaaaggaaagg

SEQ ID NO: 15494 - DNA, 303 bp, Diabrotica virgifera
  misc_feature (26)..(26): n is a, c, g, or t
ttttaggggacgtcttgacagaagangaaaagaatgagagcccctttagaaaatcgtttaaaacaaaagaaaaatagctgctcgtgataaagattaattagatcaaatggaatatgtgttcctccttaggtagaacgctttgaggatataaatctaggtaagaaatcagggagggagaggggattgtttgatagtaaagaataaagttatgtcctatctataagatttaagaaggaggttggtaaaggatgatgatcaagttgagaaagttattggattgaatcaaaataacggaggatctga

SEQ ID NO: 15495 - DNA, 262 bp, Diabrotica virgifera
  misc_feature (12)..(12): n is a, c, g, or t
  misc_feature (19)..(70): n is a, c, g, or t
  misc_feature (74)..(142): n is a, c, g, or t
  misc_feature (151)..(151): n is a, c, g, or t
  misc_feature (153)..(253): n is a, c, g, or t
  misc_feature (258)..(258): n is a, c, g, or t
aaaattgtatantttagtnnnnnnnnnnnnnnnnnnnnnnnnnnnnnnnnnnnnnnnnnnnnnnnnnnnnattnnnnnnnnnnnnnnnnnnnnnnnnnnnnnnnnnnnnnnnnnnnnnnnnnnnnnnnnnnnnnnnnnnnnngaccgtgcntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaanaagc

SEQ ID NO: 15496 - DNA, 187 bp, Diabrotica virgifera
  misc_feature (174)..(186): n is a, c, g, or t
ttgacctactctgaacaaaaaaaaaatcatcaacatgaactcaaataataagaaaatgaaagagataaccctcgatatagacaaggggactgagaagaccgatgcaatggtaggacaacaggaagaagccagcgatcgtgttgtaaaggaaaatgaagaatggagtgatctagnnnnnnnnnnnnnt

SEQ ID NO: 15497 - DNA, 886 bp, Diabrotica virgifera
  misc_feature (9)..(43): n is a, c, g, or t
  misc_feature (46)..(885): n is a, c, g, or t
ctccgtccnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 15498 - DNA, 486 bp, Diabrotica virgifera
  misc_feature (7)..(39): n is a, c, g, or t
  misc_feature (44)..(45): n is a, c, g, or t
  misc_feature (50)..(69): n is a, c, g, or t
  misc_feature (80)..(81): n is a, c, g, or t
  misc_feature (111)..(111): n is a, c, g, or t
  misc_feature (114)..(176): n is a, c, g, or t
  misc_feature (184)..(278): n is a, c, g, or t
  misc_feature (319)..(319): n is a, c, g, or t
  misc_feature (351)..(351): n is a, c, g, or t
  misc_feature (391)..(412): n is a, c, g, or t
  misc_feature (444)..(473): n is a, c, g, or t
gctcggnnnnnnnnnnnnnnnnnnnnnnnnnnnnnnnnnctaannttatnnnnnnnnnnnnnnnnnnnntaaaagcttannattttttaaagacgagaaagacctatagangtnnnnnnnnnnnnnnnnnnnnnnnnnnnnnnnnnnnnnnnnnnnnnnnnnnnnnnnnnnnnnnngggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaaattttattggagaagtcaaatcgataatanagatgccgacctcgatgttgggattaagtttnataaatggtgtagcagtaatattaattaagtctgttcgannnnnnnnnnnnnnnnnnnnnnagtttaaaccgtggggaacccaagttggggtnnnnnnnnnnnnnnnnnnnnnnnnnnnnnntaacaaagggacc

SEQ ID NO: 15499 - DNA, 313 bp, Diabrotica virgifera
ttgatgcgacgtcttggttcttgactagagatacgctttcaatcagactgaggagatcctaccatatagaacctgcgcagactagatactagtccgccagctaaccagatcatgatgctagttatctgatctttatttagtgtggctatagaaagaattggattaacgagacacgtatcgcctttgctatcagaggaccaagtggtgggtggtgtgcgaggcgttatgatgaatcgagatatacgataatctggagtcgtgatagagtgtccatttaaagatattacgattatagcgcctgaaataaggaagc

SEQ ID NO: 15500 - DNA, 729 bp, Diabrotica virgifera
aggcccacccactttgcccgactatgtatacatgtgtatttatgagaaatgaagacatgtactatcgcctataccgtctaacacacatcaggttatgccgactacgaaaggcttcattggatcatacagacctaccatctgaaagcactggctatatcgtattctgcccccactctgaacatcatgccaaatattatggtacaacaatgaacgtttataaattcttgcttaataaaaaatacgttcttctgctaccacaaagatatgagatacgacgataggaactcgatagttacagaggcattaggagatagataaagaatgcctggactcgtggtctttttgtcaaagagatgttaggaatcttgtgtttccaattatcaagcatctatcatgtgaccataatgctcaggaaactatatgacaccattgcctggacacggcattgtgctcattccacattcctcaacacaagtatttagatattctaccagggagatcgtacctccacaaataccattgagctccttgacaatagatttggaacactatgccagtacatgcatattatctgctcaacaggaattctgatggcttccagtgttggatgaaagtgtgcttgctttcttcataaccttattccggactggcaaaaattgtaactgcatttgacactactcctatgcatcttaagacctctattaagtccttctgatgatccctttaaga

SEQ ID NO: 15501 - DNA, 624 bp, Diabrotica virgifera
  misc_feature (12)..(450): n is a, c, g, or t
  misc_feature (452)..(515): n is a, c, g, or t
  misc_feature (517)..(614): n is a, c, g, or t
cgggcttaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccatttttt

SEQ ID NO: 15502 - DNA, 917 bp, Diabrotica virgifera
  misc_feature (761)..(761): n is a, c, g, or t
  misc_feature (904)..(904): n is a, c, g, or t
tctatttatgctttgtatttatgcaagtaaaaagaggtactaccctagacaaaacagcacccatcatgttatcatggctacaagaggcttcattggatcataccaaccaccatctgataaaactgtttatatcgaattttggacacattttgaacttcagtccaaacatgatgttacatcaatggacctttatcaattcttggttaataaaatatttgtcattttgctaccacaaagatatgacatctacgttggaagtgatattaagtgcattagagaaagtagagaatccggactcatggcctttttggataagggtttttaggaattttgtgtatccagttatcaagcaactatcatgtgtccataatgctcaaaaaactataggaacgattgctggtaaactgcatttgctcattccacattcatcaacagaaatatttagttattttaccagtgatatcgtacctccacaaatagcattgagcttcttgacaatagttttggaagactatcccagtagatgtatcttaaatgctcaacaggaaactgatgtcatccagtgttggatcaaagtgtgcttgctttcttcagaaccttattccgcactgacaaaaattgtaacaaaatttgacacttttcccatgcatcttaagacatatattaattcttcagatgatcctttaagagcacttgttgagtattttgggaagtgacattaaaacccatcttcaatctagtagtattcaaaaattctgtgnacatctgttttggtaacattgacaaatggttgcctcaatatttaaaccacccagaaaatgaatctgtcatatttaaagtctacatctctatatcacttgcttttcttgcagtgtgggagctttgctgtataaatagaaataanagtactagtccat

SEQ ID NO: 15503 - DNA, 536 bp, Diabrotica virgifera
ctcctatagggaaagtggtcgcctgcgggaccgggccggaatgccgcggggcccccgctcgcgcccacataatatgttggaatcatactagaatatgagaattcctgcaagatggttggagctacgtcaggaatcttagctagagctaaattcagcagaccaggagccctaccagagtagaaccccgagcagatcgtagtcggcagacatccagaatcatctgcacaatcatgtatcttcctctctgtagctatagatgtacttaggatttcgagatcgtccgtcctagctatcagagacccatgaggtctacggtgtaagacacgctacgagccttggacataggcgagaatccggagacgtgaactatgagcaagaaggatattacgaaccttgcgtttccacttagcaagcaacaatcatgtgaccatacaggtccgaaatgtatagcacggattgctgagacactgaatttgatcattgcacattcctcttcacttgtattaagatagcatccctgtggtatcttacctcca

SEQ ID NO: 15504 - DNA, 854 bp, Diabrotica virgifera
  misc_feature (53)..(75): n is a, c, g, or t
cacaaatgtttttgtaataaacaaataatatggaagataggcggacctataannnnnnnnnnnnnnnnnnnnnnnaacatttaatagcttatttaaatatggaagtagaattattgaaacctggaactgttcctatttcccctgaaacgatattatggtttgaatttttgttggatccgaatttgttattgaagcatctagaaaagttatcagcagatccccctccttcagagctcataacaaaattttatgatgtcatctcagagactttaagaaacaatcccgacactgagaatggagagattatcaacgtagaaaccaataatggtaaaactaagcctcctgccaaaacaactgctttaaaaatcctgtctcttaaagttggagcctttttaaaatggaatttagttcaaataagaaacctaccttttaagacgcaaataagtctcttacaagatctcatgtatttcacaaacgataaaaagactgtagaaataccaaacgttgaagaagaagacgttaaaaccgcctcgccaccatatttgttcgctctgttgttatttcacaggtggctactgagtacttctatgcacagaataacttcaaattggcaaatcagatacggtataaacgacatttcaaaagcagacgaatctatcatatgctgtcccgaaaacatcaacaaaacagtcaatttcctaaccgaagccctagaatggcaaatcatccctgccttactaaccttcgactgcttcaagctacccacagaatctaacgactgtatagaattcgaatggacgaaaagtgaagagttaaaaaagaacgaattttgtgcccagatcaactacgatttg

SEQ ID NO: 15505 - DNA, 521 bp, Diabrotica virgifera
aaatttttgtgttctctcgtggttattttccacctgttgtctggttctcctttctttattttcctctctggatgataaacaaatgcttgcctcgctctgttgctttaatatatcgacacatttttggcaaagcaacgcaagtgacacttttggcaaaaatcatgtttttccattaaaccaacactaccattgtctagaaagtactgccgaagtgtagtaagcctagaattactttaaacataatatatgtataggcttactacactttggaagtgccttatgaacaataatagcgttattttaaaggaaaaacatgattttaaaaaatgccacttacgccactttgccaaaaatgcatcgatatcctcaaagtatggccaatccagtttttcccttgacttatcatgattttttcttagagatttgtttacaaaagtttgaagttttttatttgtagtttcgtcttgtttccatgtttctgccatggggtgcattgtcgattcttgcgactttgccatttt

SEQ ID NO: 15506 - DNA, 827 bp, Diabrotica virgifera
ctgctctcatgtttgtgtttgcttcacgaagtacgaatggtttcatagagtcgaagaagaaagttccaactgagttcaccacaccttgcaaaactcccattcctttgaaatccatgtcaatattagcaattttcaagtccatgtccatatcttgggcctctaacgttccatctacctgcacctccattgtgtatcccgggagaacccataccggagtaccttgccttgacgagacatgatgtaaatcctatgcctaagcgtaatgttgtatgaaaaccaaattgcaagaataggcataaggtatatttaacaataactcatttaatatacttgctttgcaaaataacgttatatctactatacaagatgaaggctttgacggtacaaccatcgcgatactgggattttagattttaacaaagatggaaaaattgacttcaaaaatagttcgctgcttcaaatattgacaaatctataacttacaatcaaacctaataagtaacatagaaagatgatacctttccacaaaatcgataatttgtattaaattagacttaaccgctaaccaattgcaagtcattggacacgtttttaaaaaccctgccaaatcctaaaatagaactgctacttgtattggaaacccgaatcaaaaacacctttgaaagtggatgcttttggtggatctgagatctaactgattttatttttctaaggtaacccaactggcttcctaactgcaaaagcaatgattttttaaggcaccctatccctttttttggatttcacttaataaacaaattttcaaaattgtttaaggaggccttaaa

SEQ ID NO: 15507 - DNA, 603 bp, Diabrotica virgifera
cttcctccgggtgggccgtgtgttattgttgcgctagtaatcgttatattttataattttgacataaacgcattgattgatataactgtccacctcgcgaaatgatgctaccacatatattactcttacagcagggagctgcctcttcccatggaacccctccattaagctcaaacttaaatgcctgccacaatgatacgtatgctgttgtagcgacattggtgtccaggagtatggataagctcgtagcaacaagggaaggacatgcttctatatcttacaagggtacatctatattgagattattggatttcgttctccatgctatgaaaacttttgtagatattgataagtcacaatatggagaaggcggtgactgtacgacgagagcgagtattactgagtcaggagagttttctccacaaataaagccttacggtgatgaggatgttcagccgaggataatactcctagcaggcagagtagcgtacctgatttgccttgagacagataattgaaatggctgttgatatcaaaaaagcatatgctgacgaattacagactactttggagagtctgggctcgtcccgccatgatctcaaa

SEQ ID NO: 15508 - DNA, 134 bp, Diabrotica virgifera
aaacattgaaaacctaaaccagcaagcaaaactaccacccaaccccgaacacactcatacccaagaatcgcctgttccacgactaagaagcgaacgcccactgctaccaccgccaccccgaagcacgctaggag

SEQ ID NO: 15509 - DNA, 1265 bp, Diabrotica virgifera
  misc_feature (712)..(738): n is a, c, g, or t
  misc_feature (857)..(888): n is a, c, g, or t
  misc_feature (910)..(925): n is a, c, g, or t
  misc_feature (927)..(951): n is a, c, g, or t
  misc_feature (1012)..(1030): n is a, c, g, or t
  misc_feature (1101)..(1174): n is a, c, g, or t
  misc_feature (1205)..(1236): n is a, c, g, or t
ctacttgggctgtttatcaatcttaaccttgtttttagtctcattttgcttttctgcctgtaagtcctcttagtgttgatttcgctatgttggccttatggactgtggcttctacatgtttttggaaggttaatcctttgtccatgatgactcctaggtatttagcttcgtttttccactcgatgggggtgttctgtaccgtcagctgttcctttggttgttgtcttcctttcttgtatagaaccgcttgtgtcttttccgagttgatggctatcttccattttatactccattcctctatttcttgtagtgctgtttgcaggttggtcactgctatatctacatttctgtgtttggccgctatcgctgtgtcgtcggcgtataggctcataagggtacctggtgttctaggtacgtcagcggtgtatatcgtgtacagcaggggtgacaggaccgctccctggggtactccagcctccgggttcccgagttcggacaggacttgtcctatccgaaccctgaaactccggtcgcccaagtacgacgagattagcctcgtcatcgcctcgctgtacccgtaacctctcattttgtatagaagccctgtgattcaaaaatacggttcagagctatttaaccctccaccccttcccccttccctcaccatctaaaacgtgatttttttttaaatcacacgcatagttgatgcgtnnnnnnnnnnnnnnnnnnnnnnnnnnnccgcaaaaaagcgtttaactttttttggagattgctgcatgtctatttttttattttgtctattttatgaaagcatgtatttctaattgttttaatattttttccgtaagggtgtgccnnnnnnnnnnnnnnnnnnnnnnnnnnnnnnnntcttttcccatttttataaacnnnnnnnnnnnnnnnnannnnnnnnnnnnnnnnnnnnnnnnngtataaataataaggaatccctccaaaaatttcaaaaattggggttaaacccttttcaaannnnnnnnnnnnnnnnnnnaaaaaaccccccatttttttagggggttaaacggggttttttccattttttttaaagtccctgaaagggannnnnnnnnnnnnnnnnnnnnnnnnnnnnnnnnnnnnnnnnnnnnnnnnnnnnnnnnnnnnnnnnnnnnnnnnnttcccccaaaattccaaataaaaacaccacnnnnnnnnnnnnnnnnnnnnnnnnnnnnnnnngggcgcgccaacattttttatggtaagcg

SEQ ID NO: 15510 - DNA, 845 bp, Diabrotica virgifera
  misc_feature (562)..(562): n is a, c, g, or t
  misc_feature (582)..(582): n is a, c, g, or t
  misc_feature (653)..(653): n is a, c, g, or t
  misc_feature (720)..(720): n is a, c, g, or t
  misc_feature (784)..(784): n is a, c, g, or t
  misc_feature (812)..(812): n is a, c, g, or t
agaaagtgaaggaacaaaaatcatggtcagagctaaacgcgctgcttataggaaagacatattacatcccaaaatggacgaaagtcactacatcttgagaccagacacaattccacccgccaggcaaatgttttatcagttttgtgatgtactcctacccgaaattcaagagatgatgcagagattaccgaaagcccaagcaaaattagatgcaaagaatggttggttgcctgttaattttttagatcaatgtcgagaaatagcaaacaaatatgtaatgaagaacgtacaccagcagttggtcgcttacagcttaaaaacaggcaacaagaccaacatataagacaattaagaaccaggaataatagacaaagagaactccgcacaaatgatgacagtcgtctacaaaacagggaccagcgcgttgaaaggaatataaggaccaaccaagaacgtataaacgaacgaagacaacttcaagaacgtcgagaggaatcccaagacgaacgaagacaacttcaagaacgtcgagaggagccccagttaggaatcacagagaacnaagtcgtgaacgaatgctanaatcacgtaacgaatatctcagtccatcacgttatgaaacaaacttacgaaacagtgagaggaggattgantatagggaaaggatgtagaaattcgtgaacgtaggcaggaaaacaagaaagaaatcgagaagagacnttcaggtacaatcgagacaacactttggaaaaaaataggcaaatacgttcattaaacggtcgtncagaaagacgaacagcttttgaagcgancatggatgcacgagaatcacgaaatctctcaac

SEQ ID NO: 15511 - DNA, 611 bp, Diabrotica virgifera
tagacctgtttcatgtgttttacagtgtggcgctctttagttcaccgataacatatcacgagtatgtattgttatactggagtaagaagttaatcaatatggtaacgctatctttaaaatgagatcccgctggcacatcatttcacccacatgagagcatattgccaagacggctgcggctactgtagaaaatatggtaggagtagcagggtggtaataacagtgatgcgaagtaagagtaaagggaacacactagtggaagattcgcatggatatacctaaagtaaaatatatgtactgcccgatagagaggatagggaaaatatgctagttacgcacgcggcaaatatgaacaacgcgtatgtcgcgaaggaccctcagtcaacgccattgatgttcccttcaacaccaaggcactgagagtaaacacgccccagaccgtgctggagatctccaacgaaggaggaatggatgaaatcatagtttccgccggattcttatagcaatcgataggacataacccatgccctagaatagtactcaggagagtgggtctcgcaacatcgtgcttctcttcaaatgttattcactggccccatccgtccccccga

SEQ ID NO: 15512 - DNA, 276 bp, Diabrotica virgifera
agaggatacctcccagattccgatttaaagcttcaacacacccggcacgcatgaaatcaactaagccgaactctcattgaacgctgcagggcgcagcaatggcatagtatagcactccggagatggagtcagccacaccggcccaatctacgaaaaggtaagcacttccccccgccatcctccgataggacttgtacgatcgagagttgagcgactacctcatgaatattcttaatgaaagaggggaatctttcaccaccaccgctgtaagggaaa

SEQ ID NO: 15513 - DNA, 688 bp, Diabrotica virgifera
  misc_feature (418)..(484): n is a, c, g, or t
caagatcttcaacttccatcacgactgggtcttatacaccaacagtcaaatttaggaataactctaatgatttgggtggaaccactgtgaccacttctcctcttgttacttccagtactgaagactacgtttctgattcatcccctgctcctgatggtgaaagcagtggcagggatgataatacgggaaaaattgcagctattgtgatatcaacagtgggagctgtatcgctcatattgttggctggacttttgtatattatgaggaagagacaaaaacggttcaactataaacaaagatgcagaccagtaagcttggaccattacaatgtggataatgtttccagttttaatagccaaagaaggaaagctgaaagacagtcgaagagatcatacggaaatccagctttcgatgatcnnnnnnnnnnnnnnnnnnnnnnnnnnnnnnnnnnnnnnnnnnnnnnnnnnnnnnnnnnnnnnnnnnncaaagcagaattctctcgaatacctcaaatcacagcgaaaataagcgaactaccggatggatgcgagaccaaaaatagatacgccaacgtgatcccgcttccagagacaagagtctacttacaaccaatcgatggatatcctaccagtgactacatcaatgccaattatgtaacgggtccgaagaacacaaaaggttactatat

SEQ ID NO: 15514 - DNA, 540 bp, Diabrotica virgifera
ctgaatgatgaaaggcaccctgcatggacgcattaatcacgcggggtgtggggggtgcgcacaccgagaccgatacacacgccagccacctaccgaccgctcctttctctctcttcccttcctttctctccccgctcgcccgctttccccccccagctctatctcgatcgctccctccatgtatgcgatctattgattgacttaccctccaccccccccaacttgattaaggagatggatcacgcacggagccatccacctgacagacagactttctccctttcactgaggaggccacgctcttactaaagaactcatgctcgaaactgaaagaacactcactcctatctctctctattcattcgattgataaagaatgtagcctatctctgtctatcgattgaaaaatgaactgactgatctaacatttaacgcgcattttaactaaatattaactctcacttactatgtgggacttttctttcaaatgtacgcgcaagccctatctatttatttatctatctacatacatatatgtat

SEQ ID NO: 15515 - DNA, 59 bp, Diabrotica virgifera; identical to SEQ ID NO: 8339

SEQ ID NO: 15516 - DNA, 1098 bp, Diabrotica virgifera
  misc_feature (261)..(277): n is a, c, g, or t
  misc_feature (838)..(861): n is a, c, g, or t
  misc_feature (944)..(957): n is a, c, g, or t
  misc_feature (959)..(994): n is a, c, g, or t
  misc_feature (1061)..(1074): n is a, c, g, or t
  misc_feature (1076)..(1093): n is a, c, g, or t
ttcaaacggactacggccacactacaagagcccagtctaccctttccaggatgacacaccctagctcgtcaatacagacatctatcatataagtcaccgaacgtcaattcactgcccgtcgactgacaacaccctgactggacacaccttgatctccccgaactaaatccccctgtcgcccatcgccctaacaccaaatagggccataccgaacagccccccccccatctgccttcccagaatgggcaaagccagaaggcnnnnnnnnnnnnnnnnngcacggcggcagtaatggcgacgcgcgtggtgaccactacaattgcgaccgctacactggccgctcccctagcttcctttccttcctttctcttcacttccttcctcttcacccgcgacggtctaccccgtcaagttccataacggggcctacctataggtttacgatacatcgatccacaaaacctcgaccacaaagaagttgatcatagtgatgcatcacccagagagacatcgccccgacatacgacgttgcaccctacgaccttaatgtcgaagtcctgaataaagcagtcacgacactcactgctatatcactcaatcctatcgcgttatattgtattgagccaatagcgatctagtggataacaaacgatcggatataacatgaactgattgcacataaaatcaacatataatcgatcacaatataaagcgctcattatcaggtagatgttttcgacaaatgtgcgggtaacccccaatagataatctaatatgaaaacagcccaatgagaaatccacccctgaaaaaaaggatccttaataataggaaaaggtnnnnnnnnnnnnnnnnnnnnnnnnccgtgatcccacctttttccgctttcttccctattttcttttttttcctggatttttgccctccccggaaaagtcgggccccnnnnnnnnnnnnnngnnnnnnnnnnnnnnnnnnnnnnnnnnnnnnnnnnnngtttacacccaaatgggttttccatcaaaaatgttaaaaccccccaaaaagaaaaaataaccccccnnnnnnnnnnnnnntnnnnnnnnnnnnnnnnnnacttc

SEQ ID NO: 15517 - DNA, 372 bp, Diabrotica virgifera
tttgtccggtgcgccattcgtgtgtttggctgattcacctctccccgcgaccagagctgccaaaagtgggcttgccgcagaaactcaaaagaggggaaacgacacagacgcagcacactggactaaggaaaggctcgaatggatcgagagagtccaggagacgaattgcacacacactggtgatatgcacgaagatttcttacccacttaaagatggaaccgagattgtgcaaattagtaaaaaagatccacgccggaatcgtgacgacaattcacagcctccacactggccgtccagtgtatgggagagaacaactgccggcctagaagccgaccagacagtaaggtgtattatcttaccaaacatttact

SEQ ID NO: 15518 - DNA, 256 bp, Diabrotica virgifera
ggaattccccgggccccccccccttttcctcgcttctacgcagtatgtgtttgttcctgcttccatcccttctcctccctgagagatgtgaaggggcaggaccgtagaatgagggggctgataaacgtgaaaagtgagtctcttgttttattgggatctgttgaatcatgagttatgatgcgacaaagagctcaactagatgaatttcctgcttgtcatataaagaagatgatgtcattaccgatggaaaattgtc

SEQ ID NO: 15519 - DNA, 723 bp, Diabrotica virgifera
  misc_feature (68)..(87): n is a, c, g, or t
cttttgtatgttattcaatttacgattttaaagtatcgcaatcttatcaaaagaataaaatttgttannnnnnnnnnnnnnnnnnnnataacgccttcttttgtataattacttgttttttacagcttattaaaattaatgtttaaagaacctatagttgggacatcaatggacgttatgagtgcctatgatattttccataatttatagtactggattagaatttgaatgcattcgccgtactcccactcttcgaacgttttgttagccctcaaaccctcgtctgcggaccccttcaagctcctccgtatctgcggatatttcatacaaaaaagggaaagaaaaaaaggcctcatttaaacgcaccacacatccatcatcaattcatcttacaatttgacttgatctctgttcgccaatttaaaccaatttaagtaattcaagtgtttggtcgccgagcgacagttgtactttaaacattgtaagtgtttggatgtcttaaatcgttatatatctatatagtgacgtgtccgattcgccaaaacggcttgccactgcaaacattagcaaaccctacacagtttccagcgtgagaatacccttaaaaaatagggtacattttgtttcgtttgtgataaatggatattgactcgagttttttgctgaaaaaaatgcttgaaattgactccagccttttgcaaaatcatagaaaaagggaaacta

SEQ ID NO: 15520 - DNA, 348 bp, Diabrotica virgifera
cttgatactatgaatgtgttaactatcatctccctatttgcactcagagctggtctacctgcactcctaggtaaaagcgaaaaagtcgcaaacgatgtaactgcatatctcttcaactcatagaggatacattctcaacatcctcttctacgatacagatccctgaacagtatgggttgatactcgaaggacatgcacctgatgccatatgtctccaagcaagcagaaatcactgaagaacatggaaaggctatcgactagtcctaccactctcgtgggagacacatatgcatatatacatatcccacgatacacttacggatatataccgaccgacttgaagtgctc

SEQ ID NO: 15521 - DNA, 1260 bp, Diabrotica virgifera
  misc_feature (125)..(149): n is a, c, g, or t
  misc_feature (444)..(464): n is a, c, g, or t
  misc_feature (993)..(1012): n is a, c, g, or t
  misc_feature (1173)..(1212): n is a, c, g, or t
cggacgcgtgggatttgtgatctgttattttaggtatttaataaattacaaaacaaatgagaaaattattaatcataacttacattattattgaatagagttaaccaggaaaatgccagggtggnnnnnnnnnnnnnnnnnnnnnnnnnatacaccttcatctcaagatggaatcgactataagactgaaatgcgatatcgtaaagaaggtgccaggctgatcatagatactggtacaaaaatggatttaggatacaatacaatggcaactggtgtagtttattaccacagattttacatgtttcattcctttaaacagtttcctagatatgtcactgcctgttgttgtttattcctggctggaaaggtggaggaaacgccaaagaaatgtaaagacattataaaaactgccagaggcttacttaatgatcataaatttgcaannnnnnnnnnnnnnnnnnnnnaagaggtgatgactttagaaagaattttacttcaaacaatcaaatttgatttacaagtagaacatccttatcagtacctgttaaaatatgcaaaatgtctaaaaggtgacaaaggtaaattgcaaaagatgggtcaaatggcttggaactttgtaaatgacaggttatgtaccacattatgcctccagtggggacctgaaataattgctgtagcattaatgtacttggctggaaaacttagtaaaattgaaagtatagactggataggcaggcattctaaacaatgcagaatgtgggacatggttggtagaaaatgttacctgggatctattaaaggacatttgcctccagggtttgggtttaaatattccaatcaataacaaacccccaaaaaggccaccaagggggcaaaaagggccccaaaacaccttcacccattccaagagattttaatgggggcccgaaaaaccttcttccccctgaaaaccccccccccaggggaaaataaccccccctttccaaaggggcnnnnnnnnnnnnnnnnnnnnttcttttttggggcccccccccccacgggtgtttatttctatcctaatttccaaaatttttcccaccccccccccacaactccccctccttttaaaaggggcctccccccgggggaccccccctcccccattttaaggtcccccctccccaaaaagggggnnnnnnnnnnnnnnnnnnnnnnnnnnnnnnnnnnnnnnnncttttgcctcccccccccccccgtgggggtttccccacctgggggaga

SEQ ID NO: 15522 - DNA, 332 bp, Diabrotica virgifera
aggaacaagggtgatcttgaatacttggtgtggtaagtgcgataacgagatacggtattatacaagtttagcccttaatttcgcctgcaaagagaaatacaagcagatattcttgaggggaggagacaaaaagacacaagactggagttacttcttaggtaacttggtctctggaggagtcgacggagcgtacgtccctctgctttgtataccgacttgatttctccagaatcaagctggccggcgacgactagaatgaggtgccggcgaaagggaattatttgatttgtgtaaaagcttagtcaaaagcttaatagtggacggcttgcgag

SEQ ID NO: 15523 - DNA, 852 bp, Diabrotica virgifera
  misc_feature (50)..(809): n is a, c, g, or t
ataacatcgtcgtcatacacctaaccttcaaaatattagattgggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttccccaaaaagccgtgactcagccggacaaaaaggggaaa

SEQ ID NO: 15524 - DNA, 511 bp, Diabrotica virgifera
  misc_feature (5)..(500): n is a, c, g, or t
cgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgattaac

SEQ ID NO: 15525 - DNA, 1240 bp, Diabrotica virgifera
  misc_feature (188)..(209): n is a, c, g, or t
  misc_feature (383)..(401): n is a, c, g, or t
  misc_feature (713)..(728): n is a, c, g, or t
  misc_feature (766)..(784): n is a, c, g, or t
  misc_feature (883)..(883): n is a, c, g, or t
  misc_feature (1136)..(1188): n is a, c, g, or t
  misc_feature (1203)..(1230): n is a, c, g, or t
gtgactttaggtacctcaaaaatttaatatttctagctttatttctatcaagcacggattattttccatatatttcagttgaacgcctttttcacataaaaataaaaccaaaacaatgtacacattgagaataggcggttaaaaatcaattcagttaataatagaaaacaaaatacttcaacgaagtnnnnnnnnnnnnnnnnnnnnnnggtcaatagccatcgattagctaaggaaataaatacattttaccgttgaaactcaatcaacgattttacttacaccctttagctaagaaacgtttagagtggacaaaatttatcagtctttcaagtaaacaaaataatattttatggcacttaaatatttaaaaaagagatgannnnnnnnnnnnnnnnnnngaaaaagacatttttcatttctactcgttaatttcagtccgtgtttattagcaacatgagtgactgatagctgtaacatttcaaaaccttttttcaactgctataaaagtaaatagtttatatctaaataaatattatatacaaatttatccagaattaagccacatatggctcttactccctctaatgggaaaatttacttatcacaggtaacctctgtatcaaaaggattacgctctgatgaagctctttccatgttatggcccgcgtacatcagtgtatttttgcattccccgttgtcttcttatttgnnnnnnnnnnnnnnnntacttagggatcttctagtagaatatttttgttaggtnnnnnnnnnnnnnnnnnnntaagttattttgttaactattagtatgagatccggtctattcttggtggtatgtgggtgggttgggtctgttgagccacagttctgcccccagtataancacgtagcatgtcatttttcaagcaatctatcggggaacgtattggaaaataagccggttggataccaagtttggtaaatttctaaatagttccttataatcagaacaaacgtctggcagatccaggaaagatggtagaatggttttttgggctttcttatcgcccatttgcccttttgaacccgaaggatctttgacccccgggggggaaaaaaaacaacctaaaagttttcctattccaccaaaatttccnnnnnnnnnnnnnnnnnnnnnnnnnnnnnnnnnnnnnnnnnnnnnnnnnnnnnggccctttaaaaaannnnnnnnnnnnnnnnnnnnnnnnnnnngagtcccccc

SEQ ID NO: 15526 - DNA, 796 bp, Diabrotica virgifera
gtttaatgacataaacataataaggaaatcggattcatttacgcctgttacacaatttatatgaaaaaatatagaaataagtgcaaatattgcagttagtcatttgttgctacattagatttttcccagtgcaaatagcaaaccgtgttgatcattattttatcaaatagtattgataaataccgcagcagtccttatctcgtttagttgaaatgtgccagccactatgaataattagatatttcccctataataataaaaagatgaatagttacaacaggataaacggttatgaatctattgaaattcataacttgcaagaggtatataacgaaagctgtgatgcagtaaaatttaaaatatggggtttgcgagaagacaggaccagaaactttctataccactttggatgtgtgatactacttggtataccgtatttactgttttgcttttatcccaaactgaagagtgtgaagtttaagaaagctcctttggaaagtgctacaatattgctaataacagacaattttggggtatctgagtatgttacagtccaaaatgagataatatcacttctcaatgtgactgagcttaggtattttttatatcagcataccagatatatttggcattgcgaaaccaaatcttttgtaacactccaagatttcatgccagcatagactgttgatgaatatttatatgacacaaatgggttaacctatgatgatacatgagcagcttagacttgtatggaaaaaataaaattgaaagtagaatcaagatcctactcgactct

SEQ ID NO: 15527 - DNA, 836 bp, Diabrotica virgifera
ccaatcacatcaataattaataattgtacttctccgaatgttacaattagcgtttcaaatcaaccttcaaatattccttgtaaagaaattatttttcaaatgagacttaatttcgaaaatccgtttaaatatccagattgtaacaaaactcttaatattaaaaccgttgaacatttgataatgactaagcctccgcacgttgttatcaattttcttcaagaggaaatggatatcttgaagaattgtaatattgatcccaaacggttaaaaagaaaaatacctaaattagacaaagtgttggacagtaaaaagaaaatagctaagaaagtatttcgcgaaacaaattattggtataaagtactgaatatgtttgtgttcggtctgtataaacataaagatggtaatcttcatataaactatttggagaagttcctctcacagtccaaaaatatgacgctggatcacaataagcgtactagtttgtttagctcttattcctacgtctttggatgtaacagacatgtttatgtggattaacatatataattaaaggactcattaaaaaacacttacccatactatatataaaaatgttataactaatctatttttgacctcttagtatagtagggatgtatcgctctgaatgaagatctttgcatggtatggcccagagtatatcaagagtatatttgcattcgcctgtgtcgtcttattcgtatcctaaagatctctgctcatatggatctttctagtagactatttttgttaagtatccgcatccaagaaacctaagtattttgtaactattactatgaaatccgcccaatccccct

SEQ ID NO: 15528 - DNA, 683 bp, Diabrotica virgifera
  misc_feature (10)..(29): n is a, c, g, or t
  misc_feature (32)..(48): n is a, c, g, or t
  misc_feature (50)..(204): n is a, c, g, or t
  misc_feature (206)..(420): n is a, c, g, or t
  misc_feature (422)..(520): n is a, c, g, or t
  misc_feature (630)..(652): n is a, c, g, or t
ttttgtccgnnnnnnnnnnnnnnnnnnnnccnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagatcaaatcgataataaagattgcgacctcgatgttggattatagtttataattggcgtagcatctatattattaagtctgttcaannnnnnnnnnnnnnnnnnnnnnnacgttaaaccggtgtgagccacgttggcttc

SEQ ID NO: 15529 - DNA, 536 bp, Diabrotica virgifera
gtgaagatcacctgctgatcaaccgcggccacggcctgctggccaagccggaagtgcgtcaggagctggacatggccatctataaacaatcgctggagaaaaccgccgccttcggacaaggcaccgagtactattcctacatcccaaaaggctcactgtaccactacgccaacaacctgcaacgcccagttatgacccgaccgaggccaagaaactgctggctgcggacggtgcccaggacttgaagctcaactacgtggacgacgctctggcaactagaccgacgagcagacttgcggagatgatcaaagataacgtggcctaagccttgcgtagtacggtcaacctgcaaaaggacgatccgaccacatatgtggccagatgctgatggacgtggaatacgatatttcgttgatgaactgaaccatggacatcctcgacccgaatgagaagaccaccttcgtgctgctgcacgagaccaaccagaactacatgactcgctacaagaacgacaacgtcaaggagctgttgttgct

SEQ ID NO: 15530 - DNA, 56 bp, Diabrotica virgifera
  misc_feature (10)..(48): n is a, c, g, or t
ttttttgatnnnnnnnnnnnnnnnnnnnnnnnnnnnnnnnnnnnnnnntaacagcg

SEQ ID NO: 15531 - DNA, 154 bp, Diabrotica virgifera
caaaggaaattcggcaacattattttcccctgtcttatgaatcacatggcttttttcgtctgataaataacgtctcacctgcccaccggttaattttcaatggacgcgtgcattttgaccgtgccatcggaacagaatcttcaagatctctgtt

SEQ ID NO: 15532 - DNA, 910 bp, Diabrotica virgifera
  misc_feature (754)..(790): n is a, c, g, or t
  misc_feature (792)..(826): n is a, c, g, or t
  misc_feature (848)..(882): n is a, c, g, or t
  misc_feature (886)..(906): n is a, c, g, or t
cttcgtccggcagaaagaaaatagccattcaaaatgggtaaagaattgattcatattaacatcgacgtcatcggtcacgatagattctggcaagtccacatctaccggacacttgatctactattgtggtggtatcgataaacgaaccatcgaaaagttcgaaaaggaagcccaggaaatgggcaaaggttctttcaaatacgaccatggttattatgatcaaacatgaaaagccttaactgagaaacggaggcatacaccatatgaacattcgatctcatctagtgataattctgataacatgactaaattattgactgatactatttatctgatgctacccaggacactatagaatttctatcatagaatcttgaatactccggatactttctattagatcgatttgatgcatgaacatcatacgttagcacgactgtgaacgttacgaaatgcaagataatataactataaaaacagtgaatctcgagaacatagacttgcgtgcattaaaggaagtagggaacattttgttcacctggatattacaaacatgactctctggaaaaatactatgccgcgactggccactgaataaattaaatgggcgcggtatttagaccgtgctaaggaaccataatcatccattctgttattgaaagctggcatgaagggtgggatgaacgaagaactgtctttatgtaatttatcaagaatattattttgaagttaaaaagcttaacacttttctagnnnnnnnnnnnnnnnnnnnnnnnnnnnnnnnnnnnnncnnnnnnnnnnnnnnnnnnnnnnnnnnnnnnnnnnncaaatctatttaaattgggggnnnnnnnnnnnnnnnnnnnnnnnnnnnnnnnnnnnatcnnnnnnnnnnnnnnnnnnnnntccc

SEQ ID NO: 15533 - DNA, 715 bp, Diabrotica virgifera
  misc_feature (132)..(150): n is a, c, g, or t
cccgggcgggggcggggcgggaagttccgggggcggccccctttgggggcgacatgagggcagtatactgcccccatataccccttctctacaaacccacccggataggaccgcacggataggaaaggagannnnnnnnnnnnnnnnnnntaatctgtatttttggaacactttgtggcaaaaagcataaacaagaaccgaatggcgagatgaacaaagaaacgccccacaggagaacccagaagcgagaaggtcgggaataagggagacatgagcaggagagcgaaggaccccaggagagggaaatcgtgaacaagagcaccaacaccgatacaaaccgacatgtaaaatagaggacagaaaatatatggtagtgagggtagaaaaggcggatagccaggtgctgcaataaaaaagaggataagagacgattcgagttaaaggagataaacacgtcaataataactaccgggattgcaatgaccggagatatagaagcataagcgactggtacccgatgcatgaaaaacctgcacggaaatgctctagaaaaaccaagaaaggaggtaaatagccattgaagaagaagtaatgaaaaaacgagccacagaagatcctgccttccctttgttgggtgaacaggctaacccaaggtattcttggcaatatagggattacacacgaacgaggatcttaccagggcatgaaccgcgca

SEQ ID NO: 15534 - DNA, 763 bp, Diabrotica virgifera
  misc_feature (613)..(631): n is a, c, g, or t
caatattattacagcgatattgttaaagaataagacatatttaaaaaatcacttaaattggacaacaggtttagggaattcgagacatcaaaaatgattaatttttgagttggtgctttaatttcttggagaagtgtataaaccgacaccgattggcgcgctgaagaagaacgcgcaccgttgcacgatccggtagcgcgtacgtatccactatgtggggcagttgcaggagcgcggagcacaagaggagcgcgaacatagtgtatatgtgcctctatatttatacgaacctgcatttgatatactaatagttaatatattttaaattgtttatattttgtggttacacagttgttgtttttaagtactgtataataaattatttgagtaaatatatattagcttgtgaataataatttcctggattgcaatgacataaaatattcttgtctaaagtaattggcccgaatgtatgaaagtccctgcatggaaatttcttgtcactctaagaatggcgggaaattgccttgaacgagaaagaaagagagaacgtgcaaatgcaaatcttgctttctttgcgtatttgttcagttaacatactatactaatggcnnnnnnnnnnnnnnnnnnnagcttggttttttgtgggtatgaacgttgtctgtttggaatggtatgtatgatgaagagtgttcgggatgtcttgcaatagtttatgaatttgaaaatcatttcttgtctaagtatagaatttttttctgat

SEQ ID NO: 15535 - DNA, 440 bp, Diabrotica virgifera
  misc_feature (374)..(397): n is a, c, g, or t
ttttcgcctggggaatgccgtgctggcgcaccccccattcggctttcttgttgtcaccgccgatgaagtccttcacggcgtcttcctgcatcatccggcggatgctgattttgccgggtttactgcgcacgatttttttcgcgatattcgccgcggtgtagccggacacgtccggcagcgcaggcttggccaactccagcggttcggtcggcgggctggagatggtgtaggtcttggcctgttgcagctctttggcgatggtcggcgccttgacctgctgcgcgacatcggcgaaggccgaagtgctggccagcagcatggctgcgaccagcaggctgaccgagcctttgagggcttgagggttcattgcgcannnnnnnnnnnnnnnnnnnnnnnnacgtctactctcgcgtccgactaattctagatcgcgagcgaat

SEQ ID NO: 15536 - DNA, 240 bp, Diabrotica virgifera
  misc_feature (8)..(29): n is a, c, g, or t
tttgtgcnnnnnnnnnnnnnnnnnnnnnnccgcacaagatgcttttgtcagagaagagtaagaccctctccccacattagaagggagaggcttaataatgtatccacggaacgaaggttttgaagcagaggctctcaaaagagaagaaagtcttttaaagaagagatgaagcacatgacgcgagagaggagaagcaatgaagtgagaagaatgggaagcaatcgtccatgaaaaagagaa

SEQ ID NO: 15537 - DNA, 110 bp, Diabrotica virgifera
  misc_feature (24)..(42): n is a, c, g, or t
acccttggtggaaagtaaaaaaannnnnnnnnnnnnnnnnnngggggccccaaggggggttaaattcaaactgggaattccaacacacggggaaaaaacccttggaaaaa

SEQ ID NO: 15538 - DNA, 451 bp, Diabrotica virgifera
caaagaatctgaatatgagcctcaaacacattatgaaactacaccacatgcatacatttaaaatatgcataggattccacatgatcaaccctaacaacactaaaaaaaatataccttgtttacctctcgcatgaacttttatgctcttcgattgattgggtaattctcttgccaaacaacatctctccttcctactgcatgatgaagcttatgacccttggataagaaatgatacaggcaataattattctagaaatcacaccacactcgatccgtacaaacatgctgatgcattctgggacttcagctgcaatgaaattgacatgtacgacataccgaccatgatagattatatattgaaaaccacaggaaaatcgcaggtatttcttgtcggtcattcaccaggcacaacttcattctacgttattgcctctgaaaaaccagaatataa

SEQ ID NO: 15539 - DNA, 603 bp, Diabrotica virgifera
  misc_feature (353)..(381): n is a, c, g, or t
ggggccccctctttttgtccctcttaggtgtggccgatattatgatgccccttcaatttgtatgtagtgttctactcatcctacttatttgctgagcaacgaagcacgaccattgaatatcgacgttgccccctacatttggtattcatcagttggaggtctgttcacaagactaccaaatgatgaacaaccgttgccacgaggaacatgaattgatctgtacagcaaaaaggataaaacagaattcttatgagataataaaattaaggagattgaaaattaaatccatcccagtgtcattaggataccccgttacgttgctatgcataccgataagagggaaagggaactannnnnnnnnnnnnnnnnnnnnnnnnnnnnggaaaaagagggagattgctgttctattaaaatcgaacatgatagagaggatgaatatgagtattgatcctatgacagagagatgaagattcttttattagagaaaagtgactgaagaggaggatgtaaactctatcatgacttactggacgagagatgctgatgatatagctcattaaaaatatgtaggatattagatgtagatgacaaatgatcgataag

SEQ ID NO: 15540 - DNA, 315 bp, Diabrotica virgifera
  misc_feature (10)..(26): n is a, c, g, or t
  misc_feature (29)..(43): n is a, c, g, or t
  misc_feature (54)..(73): n is a, c, g, or t
ggcttccaannnnnnnnnnnnnnnnnccnnnnnnnnnnnnnnntttctattgcnnnnnnnnnnnnnnnnnnnnggtataagtagtgtaaaaagtaaatctttaacaataacaaaaaacaattatgatttcataaatcctgttagcgaagtggtcgaagaaaaggttggaacaacgttctccttgatatgtgaactgattttatcagaccaagaaaaagaaagttcagcagtagatgaccatctaacatgggccaaaaaagaaattttgtcaaaccaaacagggtttcaaaaaatcatatccagcatacagggaat

SEQ ID NO: 15541 - DNA, 282 bp, Diabrotica virgifera
  misc_feature (9)..(33): n is a, c, g, or t
  misc_feature (47)..(78): n is a, c, g, or t
  misc_feature (81)..(177): n is a, c, g, or t
  misc_feature (188)..(223): n is a, c, g, or t
  misc_feature (225)..(242): n is a, c, g, or t
cctttaacnnnnnnnnnnnnnnnnnnnnnnnnncccttagccccccnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaattcacnnnnnnnnnnnnnnnnnnnnnnnnnnnnnnnnnnnncnnnnnnnnnnnnnnnnnntgtaatgacatgttattcgtatgtaactatatctaatttt

SEQ ID NO: 15542 - DNA, 925 bp, Diabrotica virgifera
tacattgttaatacttccttcatattgttaatatgagtactccaattgagtttgaaatccagggtggcctagacacttgacccactccccgtacccttgaccgttggttgtttctagttccccccctccccatacaatttcttgggtcactgaaagacccagaaaggtcactgatcactattacaatgttgtctgcaaaaccctggacctagatttcttggtttgtatagttcatgaatcagatcatcaacgactgtattccataatgttggtggcaatacacccgcagatggttcccttgaaggcaatccatggttgcccttaggtacatatgaacctttttggatatccactttcatgttgttttgttgattttcttcttcaccagtgcactaggtattgactccatagaaaaattactgtttaagtcccagttctttaggtatttgctcaatctaaaatagcacgtttctctagtagtatcgtgtatcgtcctttttattctctccattgtataattattacagattataaaagaatctagatgaataaatttgtttacgatctcaaaagtgtagttcctcactctatagccttgaccattgtttctatatttagctctgttgtttagacatcattcactgggttctttcttcatttcatgtgagatctacgttttctatggtagttaaaaagaaggcaatattttcttaagttttcggtaggtgtgagtgatgcagaaatttgcgtttatttattaagaaaatttccttatcgcttactgagcattatactgattattttcattcgtaggagaattctgaccaatagaaagccacaagaaatctgaaattaaatcgataattttttgataattgccccgtcgttaaggatatttacgtcaaaatgcccctccgttgctacc

SEQ ID NO: 15543 - DNA, 687 bp, Diabrotica virgifera
  misc_feature (228)..(256): n is a, c, g, or t
tgtccggtgagtgtcacaatcgtatgcagtatcttcttcgcgagtgaagtgaatgtgacctggacctcgactttgataccgcgccgtagctatgaaggtccaactatggtttctgcttataattcatgtgagctgcttgttaggaattaccaatgctgtacgctcatctatatatgcccctttgcatttgatttctgggatctcaagaaatcagtcctcaacacactnnnnnnnnnnnnnnnnnnnnnnnnnnnnngcgtaatagctgtcaaaggacagctaatcaaaggtggaggcaagctggtgtcagcctctggtcatctagtaagttcacagggagacgctatcaccaatcttggaaaacaaatagcaactagtgctatattagtgccatggatggggtcttcaggaaaagggcatcctcatgcagaatacgaatcagatcaccactacacagcaccaagtgctccagaggatatccactaccatcacggtcctcactcagatcatcacgaagactatcatgttccagaacactatccaccaccacatcgagcagatgcagctggattactggtcctaaagaaagtgacaaaccggtggcagccacaaccaccatcaaccagaccactacgcttcaacgtcggacatcagcccccaccaagcatctcctaatttcggtactat

SEQ ID NO: 15544 - DNA, 635 bp, Diabrotica virgifera
  misc_feature (24)..(24): n is a, c, g, or t
  misc_feature (46)..(120): n is a, c, g, or t
  misc_feature (122)..(401): n is a, c, g, or t
  misc_feature (408)..(445): n is a, c, g, or t
  misc_feature (480)..(502): n is a, c, g, or t
  misc_feature (510)..(531): n is a, c, g, or t
  misc_feature (560)..(590): n is a, c, g, or t
  misc_feature (599)..(621): n is a, c, g, or t
ctactggggagatctggttgcagnctctaaatataaagtctccctnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataattggnnnnnnnnnnnnnnnnnnnnnnntgttcgannnnnnnnnnnnnnnnnnnnnnagttaaaccgggtgtgaccagggtggttnnnnnnnnnnnnnnnnnnnnnnnnnnnnnnngaaagaacnnnnnnnnnnnnnnnnnnnnnnnttagaataatattt

SEQ ID NO: 15545 - DNA, 71 bp, Diabrotica virgifera
ctgggaaaaaccacctaaaacctatcttccggtaaattcctttgaattaaaaaggaaattgccgatttagc

SEQ ID NO: 15546 - DNA, 1008 bp, Diabrotica virgifera
  misc_feature (325)..(377): n is a, c, g, or t
aagttttccaatatcaaaaactatttattgctctttttacagctgtaaacagtttattggtcatttataatgtacgtttaaaataaaaactacgaattctatttatacattactataatgttggatgatttcatttctttaggtaaattgctttttttgttatgcactattcgctagacgaacgctgtacacccaacatacctgcttcttttttattttgccgtcttcaacagtaaactctaaagcgatttttgaattgtaaaaattatatacgttttaatggattttgttggcaaacaattagattaaataaaaacacatgcgnnnnnnnnnnnnnnnnnnnnnnnnnnnnnnnnnnnnnnnnnnnnnnnnnnnnngaaccaaaacagatttactattcactaatgatcggatattagaaaataccggttataggaatactttcacttggcatgaaggctattccaataaacgggttctattgtatcactaagaagcacccgtaaagtgcctgtgaatgacatctcaaaaacatctgcagaaagtattggaaatgtttttataaatagcgagacatactactaatttcagtgtgcgaatctaatggtatgtcatgctggcgaaggaaccatttgacacccgtgacaatattgttaaattgacaaattggatgaaaaacgaaattttttaacgcttgttgaaatggttttcatctacttttccgctttctggtccgtcaaggagcaatttttccccaatcaaaatattctacctacctagtagtcgatacaagagtgacaaacaagcactcaatagaaaatgatgtataatttatattaaagcataccaaaggtttttcgtggtaaaaatttcattcttatagggcgctggagagtttcttgaaccaaaaaaccccaaacaatttatttttcaaaaacctttaactttcaaaatccattcaaccccatggtaaattttggttgggggagcccctaatctttttcttaa

SEQ ID NO: 15547 - DNA, 429 bp, Diabrotica virgifera
ttttgtccggaactatgatggtaacttcacagttatcatcgttagttatactagacccgagatagataaagatctttactatttggtattcctgaaacatgttagtcagttgaatagtgtcgaatctgttgaccaccattatttttgtcttagttttattgattttcagaccaactttattgctctcgtatccgtgctctcaactcttcgcaggagattaaacattgttgctcatttgctgctataagcgtagcgtaatcgagcaaatcttaaattggagattttcctagtagctactgttactccacaggcccatcctgatgacatgttcgccataattgttgaaaacgtgacataagacgcctccttgactcacacctccctcggccatgacttgactcggatcggcggtcgtcttggccctgcacg

SEQ ID NO: 15548 - DNA, 636 bp, Diabrotica virgifera
  misc_feature (68)..(86): n is a, c, g, or t
  misc_feature (461)..(569): n is a, c, g, or t
tttctatttgccataaattgtttatattcttgtaatacactattatttgcaaatagaaaaagcattcnnnnnnnnnnnnnnnnnnngggattgagaaatacaaaaagaatgctttttctatttgccataaattgtttatattcttgtaatacactattatttgcaggatttggaaaaatttatcacagactccaaacacggtgtcatctacatgtgtatgggatcaacaattcgaggggctagatttcccgaaagcaaaaaacaggctttcatgaaagccttctccaagttaccacaaagagtaatttggaaatgggaggaagagatgaaggacaaaccagacaatgtttttgatactagatgggctcctcaacgggatgttttatggcatcccaatgtaaaattgttcattacccattctgggctattgcgtactttgaaagcagacgactgtggtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttacagatgactcttctatatctattaggtgaccaatatgtatagagagctcaatccttgtctga

SEQ ID NO: 15549 - DNA, 101 bp, Diabrotica virgifera
  misc_feature (19)..(21): n is a, c, g, or t
  misc_feature (27)..(28): n is a, c, g, or t
  misc_feature (36)..(37): n is a, c, g, or t
  misc_feature (63)..(63): n is a, c, g, or t
  misc_feature (65)..(94): n is a, c, g, or t
cctgggcaggtaccggggnnnccggannattcccgnnggtcgactccatcgttcgtcgcgttntnnnnnnnnnnnnnnnnnnnnnnnnnnnnnntgttttt

SEQ ID NO: 15550 - DNA, 613 bp, Diabrotica virgifera
  misc_feature (13)..(13): n is a, c, g, or t
  misc_feature (17)..(17): n is a, c, g, or t
  misc_feature (22)..(22): n is a, c, g, or t
  misc_feature (25)..(25): n is a, c, g, or t
  misc_feature (90)..(90): n is a, c, g, or t
  misc_feature (105)..(105): n is a, c, g, or t
  misc_feature (135)..(135): n is a, c, g, or t
  misc_feature (202)..(220): n is a, c, g, or t
  misc_feature (385)..(385): n is a, c, g, or t
  misc_feature (541)..(563): n is a, c, g, or t
tatagagggcagnaaanaccgncancaagaaggaccgcccacctttccagcaagagagcacccaagaagaggcagcggagacgacgacanacgaaacacacgaanacgaaaccaccccctctgccacggagacancgaaacaagagcacgccggggcaccccccagaacaacgagcacagcaacggcccagagaggcggagnnnnnnnnnnnnnnnnnnnggaggacggcaccaagcacggaaaagcggagccgcccgcggaggcaggacaccgcaacaaccaagacgaggcgccacaagggggcgaggaccagccagaccaaaccacggagagagcgaaagaggacaggcttgaacaaagcgagacgaaagagagcaacaacanggacgaacaggaagcaccaggtgccgctgaaggcggtaacgttattgacgacttggaaaacaacattcaagaacttctagactcagacgaaacagaaattgaaatagtcgttctagaaaacttttcctcaagaccaagaactggtgtcactgctcnnnnnnnnnnnnnnnnnnnnnnnagacgaacaccctggcaagtatacaggaactaaccatggtatgggtgtct

SEQ ID NO: 15551 - DNA, 795 bp, Diabrotica virgifera
  misc_feature (140)..(152): n is a, c, g, or t
  misc_feature (155)..(170): n is a, c, g, or t
agatagtgtgatgtgatttagttttagggttttagcgtctaatagcaatcggaagaagtggtagtagtaacgaattagtaggtttcactcagtaataattttaactctagtgaattagactatataaaattatgaagatnnnnnnnnnnnnnctnnnnnnnnnnnnnnnnggaagtatatcgtcaagctaaagtttgcctcggcagcagagcggattacataaaaacgaccgtgagacaattttttaatgagtctggactcagtgctattcgccaaattgattataaagaagcctgtaaagtttggcccgaagttcataactgcattaaccctcttgtgagttccattaaacaatgtttgaaaagcgatgtacaaaaaatttttgatacattccttgaattcatcgacgtgtcccaaagtttcttctgcgacaacaatgcggaccgtatatcgagtttagtcagcgatggctctgtacaatgtttcagcttagtagataaagatcttaaagaatgtcaaactaactttaagaagaaactaggagactcaataaacgctattaatatatggggggacgtcgattcgtataagggtatgactgggaagaacttagcggacgagacttgtagcacattccagtcttaccgtaactgcatcaccttcaaactagctaaatgcaaatctaatattcttccaaaattggagatgaatatttagcactggttcaagaagagctcaaatttctgggggttggccacgatggttttcccagtacctaatggtttgattttcata

SEQ ID NO: 15552 - DNA, 522 bp, Diabrotica virgifera
  misc_feature (340)..(357): n is a, c, g, or t
ttcaagcggtggcggcggccgaggaggaggtggtggtggccgtggtttccgcgacagaggtagccgaggaggtggatttggtggaggtcgcggtggcggcggccgaggaggaggaggttttggcggtggacgcggtggtggaagaggtggcggtggtcgtgatggcggcgaccgaggaggtgataggagaccccggccatattaaaagattaatgtccttccttttgtatgttgtaacattgccgagtgtaatggtttttattcagtgataattgcacatttttcggacaatttattaacagtattagacagcgctaatgattcatatagatgaataccnnnnnnnnnnnnnnnnnngatactgaatgtttgaaaattggctgcctgtctaaaattgttcttctgaatacatgtaatatttatattacgtgagtgtaaaatcaaattttattttccacagtggatgtacaagacttatttataatttcagtatgtaaagtaataaaataggttaagttcaat

SEQ ID NO: 15553 - DNA, 472 bp, Diabrotica virgifera
  misc_feature (408)..(408): n is a, c, g, or t
  misc_feature (447)..(447): n is a, c, g, or t
ttcgtccgcttcttgaaaagttaaaaatgtaaattttgcaattattgattgattgatgactgaaaagaacactgctaacatggaaattaggaaagatctgcataaaacacggttttgaagaaatgggcatattatctaagtgtagtctagtggctttcgaattacttaacgaaatgtttgcagcggtaggagcaggtttcttaggggttttgtatctagttaaaaaggggtttaataaatatgactcgatacgaaccttaactatacttgtagtaacgacagccagcgtggcttatatcactcataagaataacaaacaaattaaaccaaacaagaaaaaagttatatgcattactggatgtgattcaggacttggtttttccctggctcaacactctgttgatatgngatttactgtaatagctgggttcttaagtttagactctnaaggctgtaaagagattcgacagaa

SEQ ID NO: 15554 - DNA, 995 bp, Diabrotica virgifera
  misc_feature (40)..(61): n is a, c, g, or t
  misc_feature (595)..(615): n is a, c, g, or t
  misc_feature (617)..(629): n is a, c, g, or t
  misc_feature (928)..(953): n is a, c, g, or t
acgaagcaaggacaaagaagaaaagggagaaaaagtcagnnnnnnnnnnnnnnnnnnnnnncctgtggctcctcaaaagaagagttgagcccaatagaagaaaaattgagagtatcaaaagcaaaagaaacctgggattcctcaaaagaagagacgagctcaggagaagaagaaataaagctaacaaatgaaagtgaaaagaatatgattgaaacagtggtatttgaagaggaggtatatgcaaacgaggatgcagaatgtacggtaaacatatgtgaagaatctgaggaaaaagacagaaaattgatatgtggagaagggaaagaaaaagaattgcggttgatgttaagaaactacgaaaatttgatcaatgaggaaaacagagtggcgaaaaagtacgaacattcatttgaggtgaaaaacttgggaaattttcgatcaaagacttacccgattccatacaagtatcgacaagagattaaagtaaggaaatatacagggagttggttttgccttgagaaaatttatttaaaaatgcagataaattttatcgaatacaaggcggggatttgttatattcctatttgataggagnnnnnnnnnnnnnnnnnnnnngnnnnnnnnnnnnnaatataaaagatcttcaattttctcagccacgggcatgtaaatttaagaacaacctgtatacaacaaattattatatttaagtttttagaaaagtgattcgaagaagtgtacgaaactcggtaacaatgcgcctaagataaacaagttgagtgacgcggaccattatagtggtcgcgggaagattcgatcattagcccacgctaaataaaaatcagggaaatagataataggtcatttaagttttgtaaaagtaaaaaagaagtttaatttgggaaatgataatttttcttgaaaaccnnnnnnnnnnnnnnnnnnnnnnnnnngtgggatttgggggaattcggccaactcaaatttggggggga

SEQ ID NO: 15555 - DNA, 105 bp, Diabrotica virgifera
aaaacgactcccccccagaacaaacaagccccgaaaaaagggtcccaaatacacccaaaaaaggagaatcattagctttatcacaatttctccctggctcccctt

SEQ ID NO: 15556 - DNA, 776 bp, Diabrotica virgifera
  misc_feature (8)..(28): n is a, c, g, or t
  misc_feature (87)..(105): n is a, c, g, or t
  misc_feature (520)..(537): n is a, c, g, or t
atttcatnnnnnnnnnnnnnnnnnnnnncacttgaatctcaattagtcttcattttacaagaggattatgccagtcccagtcccaannnnnnnnnnnnnnnnnnncagttctaaatgaaaagagaagaaattttatacctactaacagaaataaaaaacccaaccatttttattaaaatgcatgctgccgttgcatgcatgttaccgaaaaagaagggtttcttgatttaacgagtaacaaactgtagaattgttttgttccaagggttgtgagttcgaatctcagggtaggaaatttttcatttattacaaattaataaatgaaaatggtttctatccttgtgggattggtactcaccggagggactgcagacgttcggatacaattaacaagtcggcgtcaccaagtaacaacacatttttatgttcaacacacacacacgcagtacacattacactacctagttgtgaaatcaattgtaccatgccaatggccatttgttctcaaggcctttaagcnnnnnnnnnnnnnnnnnnctccaattgagagtggttttgaaagtgacttctttgaatagtattgcttgcttaaatctgagactaaataatatgtacatcaatagtcatggtataagtacttatttatctattatttctcgtctatctcgctttatttatgccatgtcttctacacgtcacttttttactttcttggtattaattccggttgaatttataatgaagtgagggttatctgaaaaaaccatcaactattt

SEQ ID NO: 15557 - DNA, 759 bp, Diabrotica virgifera
  misc_feature (19)..(19): n is a, c, g, or t
  misc_feature (29)..(30): n is a, c, g, or t
  misc_feature (40)..(40): n is a, c, g, or t
  misc_feature (42)..(42): n is a, c, g, or t
  misc_feature (102)..(103): n is a, c, g, or t
  misc_feature (160)..(162): n is a, c, g, or t
  misc_feature (332)..(332): n is a, c, g, or t
tacgcctggcgaggtaccngggatccggnnaattcccggngntcgacccactgctgtctcggatagaagtggtcatagttcttttctttcctctagtaaccnncttagtggtagactggcctagctaccacaagtacatgggataggcagagtggacagnnntaggagctatgctgggaatatggtgataactaacgtcgcgcttctcaaaggtatcccaagaattcgacgatatcagtagcaagtccattacacacccgaagaaacttggtcgacagtcactccttcatgaaagtccagaatggctgccaagccatgaacttctcgcaaantgtgatgaagtccagagaacaggccagacaactttgggttatttccaagcctccaacggtggtcaacaatccagaggtggtcagaccagtgcttgatggttctgtgcatgtatcttcttcatgtcaataatagaggtgtatctagtagaatgaccgagaaccttctaccagttctgtgtgaacgaaactgtcaatcattttgggtacagagcttggacgccattcaaccagaagtacgtctatggagtgttcgtaacgaaacctggggcatcatgcaagagtgtaacaacggttgttaagtgaccattagtcttctcgtgcgaaggatctcctctgggttattggccaactttccaaaggaacaatctatagaagtatatttccccccactccaagcagaatcttaaaaagaatgagaagtacccag

SEQ ID NO: 15558 - DNA, 312 bp, Diabrotica virgifera
ggaagtggacctgagacggccggattccggtcaccttgccgacgattgccgcgaaaaagtttgcaaggaaaaggagtaaaaagtggatcttccagaaaatgacatggaatcctctgtgcccccggcgaaattggtaccgtaccagacaattgctctgagtgaattaagtttgaggcttaccattaaatgaatgacccaaggctttcaaagcctgaagtgaaatgcggaaatgttacattccgatgataacactgaactagcatgttaaagaaattttgagcttgctgagcgaataagaatactagggtctgt

SEQ ID NO: 15559 - DNA, 869 bp, Diabrotica virgifera
gctaagaatataggagaaggactagctgaatacggccaacttacgtggttgatgaaagtactggcagtagaactgaagatactaagtcagttaaaacaagtaacttatctgaagcagttgaaagtgtttctgattaacttacctaccgaagaaagcagacagaaagacacgttgatgggagtttccaagatggcgttaaatcttacagcgttgcatgccgaagtagggaaatcggataactttttaacaaggttaataccgtatttcgaactagatttgcctgtagtggagatgccgaattgggagtacttcgacaataacgttttgtcgcaaattctacaaagttgccaacaaaaatcctcaaaactgatagatttacgaaaattacacattatattatacgaagagctaaagacgttacaaggcactgcagtgatgggtcagatccaggcgataactcacgaaatacaaaaagtcttgaaatacgcgttggaattgaacaagaaacgaggcttgtgctattatggtccaattcgcagacgcctggaggcaagtcaccgaagtcctagtgttatatacgccaatggagatattatcggtgcaagagcaacaaatcgtcagtctcgccttactcaaacctctattgaaggacatatctaagtccgaactacttccagaagtagcgaggttactatctggagcagttctgatgttgatgtacaacattaagagatcctacgtgcgggaaaagagactggaaaagatctcagaactgggagaagactccccatttcaaatcttaaaggtccaccaaccgttgttgaaggaaatttagataatcttacgaagtggctcatggtttcagacgt

SEQ ID NO: 15560 - DNA, 65 bp, Diabrotica virgifera
atgagacagcctgacgcactaactcatgactcgcttgcaaccacatcccccttcgcagtgcgata

SEQ ID NO: 15561 - DNA, 145 bp, Diabrotica virgifera
  misc_feature (3)..(22): n is a, c, g, or t
agnnnnnnnnnnnnnnnnnnnncttctttgaaacacgagaaggtagaaacagaagaactcagataacgaagacaaaaaaaagaacgaccaggtagagagagatgacaagatagagaaaagcctaagaacgaggcaggagaagaaa

SEQ ID NO: 15562 - DNA, 930 bp, Diabrotica virgifera
  misc_feature (45)..(62): n is a, c, g, or t
  misc_feature (744)..(744): n is a, c, g, or t
  misc_feature (762)..(762): n is a, c, g, or t
gaaaaagaagaagaacattaccaataaaatttcactcactgcaannnnnnnnnnnnnnnnnntttgttatttattgtgcctctagataatttaactggttatgtgtatgtgtataactatttagagagaaagcaaaaagtttaaacttacctaagaagttagtgatatatggccaatgaagacacttcaggactagaaaacagcatcaacagtgaactagattactatgcagttttgcaatgtaatcagaactctacactagaagaacttaaacaaagttatcgcaatttgataaaaaagtttcatccagataaacaatctcaaacggggagctctggttctgaacaactattcattcttattgataaagcatataaaacattaagtgatacaaaattaagaaaagagtatgatgctcagttgacagaaaataatttcaacgaaaattctttaatatatgcagaactaaaaaaatctgatttaaagtttgttgatgaagtttgttattttccttgcagatgtggacaaaatattgaaataagtgcggatgttttacaagaagaggaatgtttagtggaatgctctgaatgtaccaattgtattttaataaaataagtaactgattaaactaaaaaacatactgaactattgttctcaaaaatcaaaaaaagacaactgattgctgctgccatcttttggtaatcaattgtgtttgaaatcacaacatacataacctcaattatnaacatgtctgagttgagngaaagtatcaccacagtttgtgaaaagaaattcttgttaaagaatcttgcagaatatactagattagacggaagagcttttgatgagtttcgaaatgtttccattgattttggtaaagactggggctgctgtcatgtttccctgggtaaaactaggtgagtatcaaca

SEQ ID NO: 15563 - DNA, 264 bp, Diabrotica virgifera
agcggatgtcaaagtacacataccaggagcgaagataccgaattactaatacttagcacctggcatctgtgtctcacatcctacagcggtggcgacagacttcctcacggcggataaatgttcgaaaaataagcatgctgttatgcgaccatatacggacttatcgaagacgggatcgtagactccttgtccgacgaatactcagcatagtccacaaacaatgagatacgcgtcttcattgatccagaagataagcttgagaca

SEQ ID NO: 15564 - DNA, 247 bp, Diabrotica virgifera
ccccgcccggtccttgtagaaacaacaatctgctatctttacatggttcgtagtataacataatagacataattacctaaaagatgaaaagtcatattttctttctgtactcgattctggtgccccggttaaactctatccccgtagatgtcatcctaagacatacctccatgccagatagtgagtgtatcgacccagtactcctcacactggatattgtatgccatgatgtagcaatgctcctaat

SEQ ID NO: 15565 - DNA, 238 bp, Diabrotica virgifera
ccttgcccggccctttatggtatctgattcagagtgctcagcttctttcgcgcgacgtgtatgagagcgtgatctgcggatcagagttggacggagtatacgaaaacgggacggagaccttttctacagagacgcccacatgacccaattgaggatggccctgtacggccaacacccagtagagatgcacgaccagtcgacagcacgcatatgcctgcatatgatcaatgcctgatag

SEQ ID NO: 15566 - DNA, 1078 bp, Diabrotica virgifera
  misc_feature (650)..(674): n is a, c, g, or t
  misc_feature (803)..(828): n is a, c, g, or t
  misc_feature (866)..(885): n is a, c, g, or t
  misc_feature (932)..(957): n is a, c, g, or t
  misc_feature (975)..(1049): n is a, c, g, or t
gtcagtgtaaaaacgagttttattaaatgaactaaatctaataacaaagacattttcatttttccctatatattagtttataataatcatctggagatttgataaagatgttacatatcttttgaatacatgactggagttactggttagtaaaccacagactgattacaaaatggaaggtcggtattatttgtactcagaaaactaaatccacaaatgattactaaccgtggttgaatattaaagctattttatacaaatttacaaattaatagtttatgataaaacttataatatgaacagtctatacaaattgtcagtggattaaaatttattatgattggcgcacataaacaattttgcaattggtcatttacacatgctttgctgattgcttaggtagggttatttttattatacttttactattttcatagtccagaaaacgcttttgggcaaaatagtcagtttggattaatcttaattggtaccaggtttaaaaaaataaaagtaactggaatatcctttaatcggaggtcgcctgaaagttctaagggtttggttaaccaatataccagggggttcttaattaaaaggaaataaccgtttccaccttggtaatggcccccaaaggagtggaagttagaagnnnnnnnnnnnnnnnnnnnnnnnnngagtatagggataggaagaaaggggggggccgggggtgaaaaatttaaagggaatgggtttaatgggttttctagagaaaatctccaaagccccagaagatagaagtaaaaataatggggattgggagnnnnnnnnnnnnnnnnnnnnnnnnnntttctgggcccatctttttataaaaaacattggggggnnnnnnnnnnnnnnnnnnnnggcactttctttttaaccttgggaaattttcttctgggggggcctannnnnnnnnnnnnnnnnnnnnnnnnncaaacccaaacactttcnnnnnnnnnnnnnnnnnnnnnnnnnnnnnnnnnnnnnnnnnnnnnnnnnnnnnnnnnnnnnnnnnnnnnnnnnnngaggggagaggtgtgggaaaaatcccctc

SEQ ID NO: 15567 - DNA, 838 bp, Diabrotica virgifera
  misc_feature (8)..(699): n is a, c, g, or t
gttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatccaaacccgcagaaaaaaaaaagcttggaactgtttgtttttaaagtccacccaaaattggtaccgtgaaaaaatcccatccaagggccacaatcttggacaaggccaacgggtggggggcaccaggggttttcc

SEQ ID NO: 15568 - DNA, 457 bp, Diabrotica virgifera
gcatttctcaatacaaatcgtagtcacgtagccctttataattttgtcctaaaatcgaaaacagagtaattaaataataaaatgggatcgttggaagatgtaacttcagcatatgaaattttaattttacatggacttgatgaaacggatgaattcaagagtctaaagaatagttttaagaagtcacgagtttgttcaaaggaagaaatttccaacttaaaggaagaatcagttcattctatatgttgcaactccgatgatgaattaattagttcagtcttcaaattgttggttccaggtgggcatgtcataattacacaaatttcaaacaaagaagagacaaaattgaatctaattatgaaggggttatgaatgtcaaagaccatgacaattgtttagtagcaaacaaaccaagtttaaagtctcgttcgtcagcccaaataaacttccccccaaa

SEQ ID NO: 15569 - DNA, 807 bp, Diabrotica virgifera
  misc_feature (61)..(79): n is a, c, g, or t
  misc_feature (639)..(639): n is a, c, g, or t
  misc_feature (710)..(724): n is a, c, g, or t
gtaatgtgattttttttaatgttttgtatctattttaatattgctagaagatggttgcaannnnnnnnnnnnnnnnnnngattttaatgggactcatcaatacagaggcggtagtcacaaatgaagatatcagaggagcaattttacaacttctcagtgtagctcgggtgacgagagacaaattagaaaaacacgagtacgccgatagggtgttcggcgagcaattaaagaaagccttggtaactatcgacaagaggataaaaatattagatccgatcaaaggaaccgctgcaagattggaagatagattggcggcagtcgaaacgattttaatgcaaacgaacgaaaaagagaaattgcaattgcagatgacgttcgaggccgttactgacattcagaaaaatctgcctctacttatggaggagatgaaaaacgaaattatttcaaagattttggaaaacgaagtttctggggttgctgtgatgaacaaatcgaaaagctatcgatactataggaacaatcgaaaacgaggtttctgaagttaagttagacacccaacaagttaaaaagttacataacaaatcatcagaacatttggaaagataaaaaacatttcatgacagcaacagttattattangtatgataaaaactatctgactatggggttctggagttgctgaggctatgaaaaaatcgacaaagtacaannnnnnnnnnnnnnngaaaacgaagttctaagtttagaagacagccacaagtagagattacatacaaatatcagacatttgaaaattaaaaaacactc

SEQ ID NO: 15570 - DNA, 242 bp, Diabrotica virgifera
cctctcctttttccctcacgctaaaatgataattgttaaagtcccgtcccttttagatagtatggagtctgttattggtaacggctatagaattcagagggatccatagattcttgcaccagctgatacgactgcgataatgacggatgggcgtcttagacatggatacagagccgctgagatagctgacactccgcccacggagcgcgatcgaaatctccccccctcttcgactacggcac

SEQ ID NO: 15571 - DNA, 557 bp, Diabrotica virgifera
  misc_feature (119)..(137): n is a, c, g, or t
tctttcgtccgagaaactattggttcaaaaactgctctcgaagacttaatatttgaatataaatatcgttatagtttacgagaatggtaaaaaaccatattcatatttctcactattgnnnnnnnnnnnnnnnnnnnggatggtcatagtctttaatttagtcaatgaatcctagaaaacacaggcaacaatgtcaggaaatgcccctcctgtagcacaaccaaacccagaaaatcatgttggagctttaattaatactaatagaataagaaataacaacaatcaaaatcctttatttaatgtaagagaccgactatttcataccctcttttatagagctgctctagcatatgcaaggacctttcctagacccttacgacggtttttagaatttctcaccttagtgaaggcaatagcagcattctttgtgttagtgtacatacacattacgttttctagaacaccttcgacatgtttgatgcatgttaaagacaactggccacgggacgggattcttagggtaaaaatagtgcgaaatgtaggaaaagattacaata

SEQ ID NO: 15572 - DNA, 441 bp, Diabrotica virgifera
ctctgatccggttagtgtcgaggatgccatgtctagaccagatagtaacttatggttaggggctatgacagaagaactgcagtctttcgaggataactcagcatgggaagtggttgatgttcctgaagatggttgtgtagtgaagtgtaagtgggtatacaagaaaaaggttgataactcaggtaaagtgaaatatcgtgcaagactggtagcaaaaggttacactcaaaaatttggtgttgattataatgaaaccttttctccagtcataaggcattctacattaagacttttatttgctttgtcagcaaatttgaatttggatatttttcatctgggatgttgcgacggcttttttatttggcgacctatactaaaggctccttattacctccctcttgattgccggcaatcaggcacatctgaacaccccccccctcc

SEQ ID NO: 15573 - DNA, 329 bp, Diabrotica virgifera
atcgcgagcggattaggatatggcagtttgataggttccagtggaagctacagcaggaggtgaagttcctgcttaatagatcttggtgtatccagcgtccgcttatgaggtcatgaaagtactgatcatgtactttatggacatggatcacattcctacggattcgctgactgatgaccacatgacaggcatagatactgtgacctccaaaccttcggtcctggagagaactccagcggtgtttgaatatcatatgtattttatacgaaattacaaattaatagcttatgatgaaactgataatatgaacagactatactaattgttag

SEQ ID NO: 15574 - DNA, 182 bp, Diabrotica virgifera
ttccaagactttcactatttcaatagcagggtccttatcgtggtgataattgtcagggtgatggtgaggaacttctttaaccacattgtaatcttctttgtgatgatggtcttccttgtcatgtatataaaatgttgatattcgacacgatttgtacatgaacatttcctccttctgttaat

SEQ ID NO: 15575 - DNA, 491 bp, Diabrotica virgifera
  misc_feature (25)..(62): n is a, c, g, or t
gtcaaagaagatggaactgttactnnnnnnnnnnnnnnnnnnnnnnnnnnnnnnnnnnnnnngagtgttgccgatcccagtcaagtcgaagttgttctcagaagtccaaacacaagaacccagatgttctaagtggttccccaacttggaacatctgggttcttgtgtttgggaaccacttagaactggagaagctatcgaccgtaccctcgttggtgtttcacggtaccaaaacaacaaccaaggtgatattcttactgatattttccgtcagtatgaaggtactcttgacgacaccaaatactacagccttcttaacagaatccaaatgttagttgaagctggactcattaatgagaccatatacgatattatcagagactgggatcttaacaccgtgtacaggaattagtgacattgtccccaccaaggagtaagtactcttcgtcaatacgctggacaagttggagatgttatgccccttgggtgaa

SEQ ID NO: 15576 - DNA, 747 bp, Diabrotica virgifera
  misc_feature (5)..(22): n is a, c, g, or t
ttcgnnnnnnnnnnnnnnnnnntgcttatcatttattcataaatattttaatggcatttgtagttgttacatatttgagaataaccagtcttcttcttcatctatctccgtttactgtttctttttcggaacatactggagaaccaacacagatttcggtgatataggtatatctgtcgaatctttcttggcattaatgtccttatgagtagtctcattatagttcttactataatattgtattgtcacctcgtctaaatcggacaaggcggcgatgttttgtttgacatttagagtaaccttctgatcacctgtgtttagaagaacgagaactcctggatttcctgatatctccctgacaaaagcgaatacggtatcattgctgactgcatacatgtcacaattacccctcatgatcgaaggcgattccctaatttgaagaagctggtgatctatagtatcatttaatttcaccaaacttgctcctggaagaagacttgtcacgatactgacgacgtctggaggaagagaagaacttgtttcccttccataggggccattttgaccattatcaattttaaatgtatgatttaaccggatcacgatggttgtaacgttgggtttggaaaacctttcttcataagaggtatatcccccctacgcctgccgtgccttggtaagaatgcatttttgcctatcttttagcacacatttaaaggcccctccactggcattattccttacccc

SEQ ID NO: 15577 - DNA, 702 bp, Diabrotica virgifera
tgttgaaataatttttatttcgtttctataaaacatacaaaaatacatctttttacaaaaatatctagtaggagtgtatattacataaaacgtgagacttactatgcttcgagcatctgtttaacagtctaattcttagtttttattataacaacaaatagatcacgcataccagtcattgctaaaaaataaatacgaaatattgtaacgtttgatcactagctgcccataatattttgggcagctctgctttcaaatactaccctacaaattcaactagagctgacttagaagacaccgtcaccggttgggtcatttaaccatgggtagttatttggacaccttacgcaagtttggagattgatggtttctccgggtacttcggaagaagtaagcttacagctatgaggtacccaacaggctgggattccttctactacacactttttccctccatgggtcgaagttcttgggcttcggagacgggtctaaggattttggatccattgggataacctggggcattggttaacaaattatacaatcattaatgggttggaaaaaatttccatcctatcccagtaaggaaacccattccaataaattccgggttaattttttagcccaacgggcatgggaaaaaagaacccaaaaggaaccctggttttattgtaaaggcctttccgaaaattataaaacaaa

SEQ ID NO: 15578 - DNA, 670 bp, Diabrotica virgifera
  misc_feature (23)..(23): n is a, c, g, or t
  misc_feature (25)..(26): n is a, c, g, or t
  misc_feature (31)..(31): n is a, c, g, or t
  misc_feature (33)..(33): n is a, c, g, or t
  misc_feature (38)..(39): n is a, c, g, or t
  misc_feature (42)..(42): n is a, c, g, or t
  misc_feature (44)..(44): n is a, c, g, or t
  misc_feature (61)..(61): n is a, c, g, or t
  misc_feature (63)..(64): n is a, c, g, or t
  misc_feature (66)..(68): n is a, c, g, or t
  misc_feature (71)..(71): n is a, c, g, or t
  misc_feature (73)..(73): n is a, c, g, or t
  misc_feature (76)..(76): n is a, c, g, or t
  misc_feature (79)..(79): n is a, c, g, or t
  misc_feature (83)..(83): n is a, c, g, or t
  misc_feature (88)..(89): n is a, c, g, or t
  misc_feature (98)..(98): n is a, c, g, or t
  misc_feature (100)..(100): n is a, c, g, or t
  misc_feature (103)..(103): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (113)..(113): n is a, c, g, or t
  misc_feature (115)..(118): n is a, c, g, or t
  misc_feature (135)..(135): n is a, c, g, or t
  misc_feature (145)..(145): n is a, c, g, or t
  misc_feature (157)..(157): n is a, c, g, or t
  misc_feature (160)..(160): n is a, c, g, or t
  misc_feature (172)..(172): n is a, c, g, or t
  misc_feature (181)..(181): n is a, c, g, or t
  misc_feature (187)..(187): n is a, c, g, or t
  misc_feature (196)..(196): n is a, c, g, or t
  misc_feature (239)..(239): n is a, c, g, or t
  misc_feature (242)..(242): n is a, c, g, or t
  misc_feature (247)..(247): n is a, c, g, or t
  misc_feature (262)..(263): n is a, c, g, or t
  misc_feature (268)..(269): n is a, c, g, or t
  misc_feature (293)..(293): n is a, c, g, or t
  misc_feature (299)..(299): n is a, c, g, or t
  misc_feature (333)..(333): n is a, c, g, or t
  misc_feature (336)..(336): n is a, c, g, or t
  misc_feature (349)..(350): n is a, c, g, or t
  misc_feature (354)..(354): n is a, c, g, or t
  misc_feature (357)..(357): n is a, c, g, or t
  misc_feature (370)..(370): n is a, c, g, or t
tcatttcaagcgcgaagaaagantnnagaangngagannggnangcttttgagacaagaangnnannnagngnggnagngaanaaaannaagaaagananganggnangnaangnnnnaaactctcaagagacgngaagaagaangcaagaagaganaanaacagacaaagnacaaaaagnagaaanagagaaaancgaggacaacaagaaagcgaggaggaccacaaaccggaagggngangaccngaaaggacaaacganncaaanncaacaaaaaaacacacgaggaccncgaaanagccaaagagaaacagagaagcccaaacggcgcnaancgccacgcgcccnncaancgngactttcaaccgntacatcgtcaacttttctcataaattacattataaatctgtttcttatattactttatttctcctaattattcgcatctaccaatattgttctatttctttcttttctcttcttattcacccacctccacatgttcactcaattttccatattcatctaaatcctttctttcaaaaaattttcttctccccaacaaagcaatttaactatatccacacatccttttggcacaatttgtcaacaataatacaaattcaatatatatcccaatccccccacatcatctttccaaaccgtttt

SEQ ID NO: 15579 - DNA, 507 bp, Diabrotica virgifera
  misc_feature (9)..(275): n is a, c, g, or t
  misc_feature (282)..(319): n is a, c, g, or t
  misc_feature (339)..(352): n is a, c, g, or t
  misc_feature (355)..(377): n is a, c, g, or t
  misc_feature (385)..(407): n is a, c, g, or t
  misc_feature (480)..(503): n is a, c, g, or t
ttttgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggcgtgagccaggctggcctctatctttaggttattaatatattttagcacgaacggaccggnnnnnnnnnnnnnnnnnnnnnnnncgat

SEQ ID NO: 15580 - DNA, 597 bp, Diabrotica virgifera
ggatctaaaaccagcgttaaacaaaaacaaagaatcatacaaacgttgacaggagagatagctcatcaatggtttggcaactatattaccccagagcggtggtctgatgtttggctcaatgagggttttaccacttttttaaagtatcacctcccggatttaactttacaggaattagagactacaaatcaattttcaatcgaaattcttcaggatactttgtaccaagattctattcaaggtgaagaagaactttcaactattgaaaacactgccatgaatcctaaaactcaggagagaatgaacaagtttaaagctattaaaggtgccagcattatacgaatgatgcaatctacactgggtgaaaaaatatttgaagaacatattaattcatacttaaataagtataaatttaattacactaatcccactaatttactggaagctatggagttggtaaataaaatggaaaaatggttatatatgcctggatatccattggttactgcacgtttgtctaataacggaaaatcagttagtttgtcccaggagccccttcttttattaaaagatgatcaagaatctgctacagtttgg

SEQ ID NO: 15581 - DNA, 909 bp, Diabrotica virgifera
  misc_feature (17)..(17): n is a, c, g, or t
  misc_feature (33)..(35): n is a, c, g, or t
  misc_feature (51)..(51): n is a, c, g, or t
  misc_feature (55)..(56): n is a, c, g, or t
  misc_feature (67)..(67): n is a, c, g, or t
  misc_feature (72)..(72): n is a, c, g, or t
  misc_feature (77)..(77): n is a, c, g, or t
  misc_feature (79)..(79): n is a, c, g, or t
  misc_feature (89)..(90): n is a, c, g, or t
  misc_feature (93)..(94): n is a, c, g, or t
  misc_feature (104)..(106): n is a, c, g, or t
  misc_feature (108)..(109): n is a, c, g, or t
  misc_feature (112)..(113): n is a, c, g, or t
  misc_feature (117)..(117): n is a, c, g, or t
  misc_feature (132)..(133): n is a, c, g, or t
  misc_feature (139)..(140): n is a, c, g, or t
  misc_feature (142)..(142): n is a, c, g, or t
  misc_feature (166)..(166): n is a, c, g, or t
  misc_feature (175)..(176): n is a, c, g, or t
  misc_feature (199)..(199): n is a, c, g, or t
  misc_feature (211)..(211): n is a, c, g, or t
  misc_feature (215)..(215): n is a, c, g, or t
  misc_feature (227)..(227): n is a, c, g, or t
  misc_feature (231)..(233): n is a, c, g, or t
  misc_feature (255)..(255): n is a, c, g, or t
  misc_feature (263)..(263): n is a, c, g, or t
  misc_feature (266)..(267): n is a, c, g, or t
  misc_feature (269)..(269): n is a, c, g, or t
  misc_feature (272)..(272): n is a, c, g, or t
  misc_feature (283)..(283): n is a, c, g, or t
  misc_feature (286)..(287): n is a, c, g, or t
  misc_feature (294)..(296): n is a, c, g, or t
  misc_feature (304)..(304): n is a, c, g, or t
  misc_feature (307)..(307): n is a, c, g, or t
  misc_feature (317)..(317): n is a, c, g, or t
  misc_feature (319)..(319): n is a, c, g, or t
  misc_feature (328)..(328): n is a, c, g, or t
  misc_feature (330)..(330): n is a, c, g, or t
  misc_feature (337)..(337): n is a, c, g, or t
  misc_feature (343)..(343): n is a, c, g, or t
  misc_feature (346)..(347): n is a, c, g, or t
  misc_feature (362)..(364): n is a, c, g, or t
  misc_feature (369)..(371): n is a, c, g, or t
  misc_feature (374)..(374): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (390)..(392): n is a, c, g, or t
  misc_feature (397)..(397): n is a, c, g, or t
  misc_feature (399)..(399): n is a, c, g, or t
  misc_feature (405)..(405): n is a, c, g, or t
  misc_feature (407)..(407): n is a, c, g, or t
  misc_feature (411)..(411): n is a, c, g, or t
  misc_feature (413)..(414): n is a, c, g, or t
  misc_feature (416)..(416): n is a, c, g, or t
  misc_feature (419)..(419): n is a, c, g, or t
  misc_feature (422)..(424): n is a, c, g, or t
  misc_feature (426)..(426): n is a, c, g, or t
  misc_feature (431)..(431): n is a, c, g, or t
  misc_feature (436)..(436): n is a, c, g, or t
  misc_feature (438)..(438): n is a, c, g, or t
  misc_feature (440)..(440): n is a, c, g, or t
  misc_feature (449)..(449): n is a, c, g, or t
  misc_feature (451)..(452): n is a, c, g, or t
  misc_feature (464)..(464): n is a, c, g, or t
  misc_feature (469)..(469): n is a, c, g, or t
  misc_feature (474)..(474): n is a, c, g, or t
  misc_feature (476)..(476): n is a, c, g, or t
  misc_feature (482)..(482): n is a, c, g, or t
  misc_feature (502)..(502): n is a, c, g, or t
  misc_feature (505)..(505): n is a, c, g, or t
  misc_feature (514)..(514): n is a, c, g, or t
  misc_feature (798)..(823): n is a, c, g, or t
tctcgagcgccacgcgnccgcggacgcgggggnnnaaacccattttcacanggcnncgaaaaagggngaagnaaaananacaaaacaanncannaacaaccaannngnngannccgncagtctagaaaacanncgaagnncnaaacccaagcaccggaaaacccanaaccaaggnngcggaaggggacaaagaagacancgacaaagcggnacgngccgcaaaagcngcannngcaagaggcgcgccagggaganccagggangcnncnagnaggggagccancannaacaagnnngcagaacnggnagaacaacancnagaagaaanancagaacnggaggngcnngaaaagggaaaaacnnnggaannngcnaaaaggngnanccaannngccgnancaggcnancggnannangcnggnnncngcganaaagnananggacaaacnannccagcagaaggnccaanaatgngnatgacncgcaaagaaccaataggagncgnaggacaaancatcccatggaacttccctgctctgatgcttacttggaagtggggcccctgctctggccgctggttgtacgttgggccttgaaccagcagagcaaacccctctcactgcattgtatatggctgctctaactaaaaaagcccgttttccagaagggagtattaacgtagttaatgggttcggccccactgccggagcctcgttggctttaacccaaggatggtaagaaaaatgcatttaactgggctaacccgaatttggacaccctcataaggaaaaaggctgnnnnnnnnnnnnnnnnnnnnnnnnnnattggagctttggggggaaaaagccctttaaaaattttttatggaataatgaaggttgaagaaacctggtcaaaattgttgggcaa

SEQ ID NO: 15582 - DNA, 419 bp, Diabrotica virgifera
aaactacagccactttcaaactaaatatatcttagtttagaacatatattgctgttaattttccagaaaatactgaatgtatagaaaattatgaagtcgagattaaaccatgtatatgttaaagtaatcgtatttaccatggttttgtattatttgtaatattttcagttttatatctgtttttgtatattgttttgtatcttatgtatatttggacacagctctctccttgtctctttgaatggtctctacgcagttgatacgttcatccatccttgttccaacattttcttcagcactatcatcccgtctgatccaaagactttctctttctctcttgtgttcccatgagtttccaatttatctgtctattgcatctcctaacagattgtcgaagttttttctagtataagaaagat

SEQ ID NO: 15583 - DNA, 131 bp, Diabrotica virgifera
  misc_feature (6)..(27): n is a, c, g, or t
  misc_feature (50)..(71): n is a, c, g, or t
aggagnnnnnnnnnnnnnnnnnnnnnngctggcagggaaagagaaagcgnnnnnnnnnnnnnnnnnnnnnncaaaccacggacttttttttttaatgcggctttattgagaaactcctaggagaaggaaat

SEQ ID NO: 15584 - DNA, 408 bp, Diabrotica virgifera
  misc_feature (30)..(31): n is a, c, g, or t
  misc_feature (35)..(35): n is a, c, g, or t
  misc_feature (37)..(42): n is a, c, g, or t
  misc_feature (66)..(66): n is a, c, g, or t
  misc_feature (68)..(68): n is a, c, g, or t
  misc_feature (71)..(71): n is a, c, g, or t
  misc_feature (74)..(74): n is a, c, g, or t
  misc_feature (78)..(108): n is a, c, g, or t
  misc_feature (118)..(118): n is a, c, g, or t
  misc_feature (142)..(143): n is a, c, g, or t
  misc_feature (154)..(154): n is a, c, g, or t
  misc_feature (244)..(244): n is a, c, g, or t
  misc_feature (347)..(366): n is a, c, g, or t
ttaacaataagagggacccgttttttgttnncccntnnnnnntcttaccttttagggaagacaaantnggnaangttnnnnnnnnnnnnnnnnnnnnnnnnnnnnnnnaagaaaaggnaaaagaccccagaggagaagaaanntagtaattggntgttaataaatttggggattggataagagatgaattaaaagttatgttggagagtaagatggataaaaagttaaaagaattgtttattgnaaaatatgtatgtgattttaatgtataagttgtagaataagttgattggagagatagtgaagttttgggagtaaaagataaaggagagtgtggataatgatgnnnnnnnnnnnnnnnnnnnnccttgaaggcaatattgtattaacaagaatcaatgttgtact

SEQ ID NO: 15585 - DNA, 120 bp, Diabrotica virgifera
  misc_feature (20)..(20): n is a, c, g, or t
  misc_feature (23)..(23): n is a, c, g, or t
  misc_feature (27)..(27): n is a, c, g, or t
  misc_feature (30)..(32): n is a, c, g, or t
  misc_feature (36)..(41): n is a, c, g, or t
  misc_feature (46)..(46): n is a, c, g, or t
  misc_feature (65)..(65): n is a, c, g, or t
  misc_feature (80)..(80): n is a, c, g, or t
ccctaccgtaaaggggcaanatnaganttnnngaannnnnnggagntaccctaagaggagccganggaggacaccgcggnggaaaaaacaccaccgcccagaaagcaggcgacgccggcg

SEQ ID NO: 15586 - DNA, 689 bp, Diabrotica virgifera
  misc_feature (12)..(12): n is a, c, g, or t
  misc_feature (14)..(16): n is a, c, g, or t
  misc_feature (28)..(28): n is a, c, g, or t
  misc_feature (35)..(36): n is a, c, g, or t
  misc_feature (49)..(49): n is a, c, g, or t
  misc_feature (55)..(59): n is a, c, g, or t
  misc_feature (61)..(61): n is a, c, g, or t
  misc_feature (65)..(65): n is a, c, g, or t
  misc_feature (67)..(68): n is a, c, g, or t
  misc_feature (71)..(71): n is a, c, g, or t
  misc_feature (73)..(74): n is a, c, g, or t
  misc_feature (79)..(83): n is a, c, g, or t
  misc_feature (85)..(85): n is a, c, g, or t
  misc_feature (88)..(90): n is a, c, g, or t
  misc_feature (92)..(93): n is a, c, g, or t
  misc_feature (97)..(97): n is a, c, g, or t
  misc_feature (102)..(102): n is a, c, g, or t
  misc_feature (108)..(108): n is a, c, g, or t
  misc_feature (110)..(110): n is a, c, g, or t
  misc_feature (112)..(112): n is a, c, g, or t
  misc_feature (116)..(116): n is a, c, g, or t
  misc_feature (125)..(126): n is a, c, g, or t
  misc_feature (128)..(128): n is a, c, g, or t
  misc_feature (141)..(143): n is a, c, g, or t
  misc_feature (150)..(153): n is a, c, g, or t
  misc_feature (163)..(163): n is a, c, g, or t
  misc_feature (169)..(169): n is a, c, g, or t
  misc_feature (175)..(175): n is a, c, g, or t
  misc_feature (199)..(199): n is a, c, g, or t
  misc_feature (202)..(202): n is a, c, g, or t
  misc_feature (204)..(205): n is a, c, g, or t
  misc_feature (213)..(214): n is a, c, g, or t
  misc_feature (217)..(218): n is a, c, g, or t
  misc_feature (232)..(232): n is a, c, g, or t
  misc_feature (242)..(242): n is a, c, g, or t
  misc_feature (252)..(252): n is a, c, g, or t
  misc_feature (256)..(256): n is a, c, g, or t
  misc_feature (259)..(259): n is a, c, g, or t
  misc_feature (267)..(267): n is a, c, g, or t
  misc_feature (280)..(281): n is a, c, g, or t
  misc_feature (287)..(288): n is a, c, g, or t
  misc_feature (290)..(291): n is a, c, g, or t
  misc_feature (299)..(301): n is a, c, g, or t
  misc_feature (307)..(308): n is a, c, g, or t
  misc_feature (311)..(311): n is a, c, g, or t
  misc_feature (317)..(317): n is a, c, g, or t
  misc_feature (320)..(320): n is a, c, g, or t
  misc_feature (323)..(324): n is a, c, g, or t
  misc_feature (326)..(326): n is a, c, g, or t
  misc_feature (329)..(329): n is a, c, g, or t
  misc_feature (331)..(331): n is a, c, g, or t
  misc_feature (333)..(334): n is a, c, g, or t
  misc_feature (336)..(337): n is a, c, g, or t
  misc_feature (339)..(339): n is a, c, g, or t
  misc_feature (342)..(346): n is a, c, g, or t
  misc_feature (350)..(351): n is a, c, g, or t
  misc_feature (362)..(362): n is a, c, g, or t
  misc_feature (368)..(369): n is a, c, g, or t
  misc_feature (374)..(374): n is a, c, g, or t
  misc_feature (379)..(379): n is a, c, g, or t
  misc_feature (382)..(383): n is a, c, g, or t
  misc_feature (385)..(385): n is a, c, g, or t
  misc_feature (387)..(387): n is a, c, g, or t
  misc_feature (391)..(391): n is a, c, g, or t
  misc_feature (408)..(408): n is a, c, g, or t
  misc_feature (410)..(410): n is a, c, g, or t
  misc_feature (414)..(414): n is a, c, g, or t
  misc_feature (420)..(422): n is a, c, g, or t
  misc_feature (427)..(431): n is a, c, g, or t
  misc_feature (446)..(446): n is a, c, g, or t
  misc_feature (448)..(449): n is a, c, g, or t
  misc_feature (453)..(454): n is a, c, g, or t
  misc_feature (464)..(464): n is a, c, g, or t
  misc_feature (469)..(469): n is a, c, g, or t
  misc_feature (473)..(473): n is a, c, g, or t
  misc_feature (475)..(476): n is a, c, g, or t
  misc_feature (486)..(486): n is a, c, g, or t
  misc_feature (488)..(488): n is a, c, g, or t
  misc_feature (500)..(500): n is a, c, g, or t
  misc_feature (504)..(504): n is a, c, g, or t
  misc_feature (508)..(509): n is a, c, g, or t
  misc_feature (513)..(513): n is a, c, g, or t
  misc_feature (522)..(546): n is a, c, g, or t
  misc_feature (639)..(659): n is a, c, g, or t
tcctcgagcgancnnnaagcagagacancgagggnnaggctcctttttngaaggnnnnncnaagnannagnannggacnnnnngnacnnngnncaanagaancaaggncncnaaanagcattctnncnaaaaagccaaaannnaaagacnnnnacggaaagcnaaacanagaagnaagaggaaacccgggagagccacnganannaacggacnngannaaagcagggaagcnagaagaagcncagaaccaancacncgngcaaggangggacacagaggnnaaaagnnannccggcaannncacggnnganaaaaancanganncnaanancnncnncnggnnnnncccnncacaaagggancccagnncgganccggnggnncnanggcnccaaggaggaccaggancnacanccaggnnnggacnnnnncaagaaaagggaccncnnacannaaaagaaggngagcngggnannagaccaacgncngggaaaaggaancacncagnnatcnacatcgatnnnnnnnnnnnnnnnnnnnnnnnnnatactaacggaggatacgccaaggatcaacataaagtagccactgatttgtaccaaagcttgcagcaatttttcaccctcttctatcaatacnnnnnnnnnnnnnnnnnnnnnaacagggagtcttatgggggaaaagattgt

SEQ ID NO: 15587 - DNA, 454 bp, Diabrotica virgifera
  misc_feature (12)..(12): n is a, c, g, or t
  misc_feature (14)..(14): n is a, c, g, or t
  misc_feature (17)..(17): n is a, c, g, or t
  misc_feature (25)..(25): n is a, c, g, or t
  misc_feature (29)..(32): n is a, c, g, or t
  misc_feature (59)..(59): n is a, c, g, or t
  misc_feature (65)..(65): n is a, c, g, or t
  misc_feature (71)..(71): n is a, c, g, or t
  misc_feature (88)..(89): n is a, c, g, or t
  misc_feature (101)..(101): n is a, c, g, or t
  misc_feature (105)..(105): n is a, c, g, or t
  misc_feature (113)..(113): n is a, c, g, or t
  misc_feature (133)..(133): n is a, c, g, or t
  misc_feature (136)..(136): n is a, c, g, or t
  misc_feature (152)..(152): n is a, c, g, or t
  misc_feature (182)..(182): n is a, c, g, or t
  misc_feature (187)..(187): n is a, c, g, or t
  misc_feature (208)..(208): n is a, c, g, or t
  misc_feature (212)..(212): n is a, c, g, or t
  misc_feature (220)..(220): n is a, c, g, or t
  misc_feature (252)..(252): n is a, c, g, or t
  misc_feature (286)..(286): n is a, c, g, or t
  misc_feature (332)..(344): n is a, c, g, or t
  misc_feature (347)..(363): n is a, c, g, or t
  misc_feature (369)..(369): n is a, c, g, or t
ttacaaggggcncngangaggaganggannnngaggaaaggacctttataaagggaaanattaanagaganatatggaaaaatatggnnattaaattttgnaaanaggagtanttaagtccccatgaaagagnagnaatagttatattttgnggttatttaaggttgattttgagtgtttgnaaatngtgggaagattgtttgtgggnatanatgaaaangatggttgatataagagttgaattagaaattngagagtgtgtttaaagaaataatgattattttanattaatagaggaatattggaataaaaagttatggtttaatgaaatnnnnnnnnnnnnngannnnnnnnnnnnnnnnngagttngagaagaaggttgaaaagttgagtatataatttagaagtatattattttagatgaaataaaaatagttttgttgaaattttgaat

SEQ ID NO: 15588 - DNA, 498 bp, Diabrotica virgifera
catcgtccgacaagttgttatcgtttcaagatgatgttcaaattttttatcttctctcttatggtaactagctctttagcttttataccagaaataattggctttggtcttggcgtccacttattacataaagtggcagagaagttgggagttcctgacactgtgttcaaagttgaacacaacgtcccagatcaagtattcgccgagcccgacggtcgtcaatatgttctgaagaaacagtggattggtagtacacctgttttagccaaggtctacagtgacaatggacaggtcgcttttgttgacagcagttcaagtgttggaactcctgtcaacaacaacgctgtcaaccaaggagaaagtggaagcggaaatgccgccattgaatacagtaacgaagaagaatggaacaacagacataactgatttgatgcttgcacagcgactatttgcacttaatatgttataaaaagcacaaatgctactaatattgaatat

SEQ ID NO: 15589 - DNA, 374 bp, Diabrotica virgifera
  misc_feature (30)..(30): n is a, c, g, or t
  misc_feature (65)..(65): n is a, c, g, or t
aggcacaaggcagaagggaggagccacganccagacgaaaaggaaccgggaaaggaccgccacgnaaccgcagagcaccacagcggaaaaggaccaaacccgccggagcagcaaggccaacacccgcaacagggaaccgcaaagacaccgcccaagcgcaggacgacgacgagagcgagcaacaacgcggagcaatgtgcccaagagcgagcgacgacaaccgaacgggggaaggacaacacacaagaagaggcgaaccaggacaagcgagcactgaaaacgatgccgccaaaatattataggactttaccgtgcagactaccaatgaccgggcgatttgaataaaaaatcacagtagagcaccaccacacatg

SEQ ID NO: 15590 - DNA, 1258 bp, Diabrotica virgifera
  misc_feature (170)..(192): n is a, c, g, or t
  misc_feature (434)..(462): n is a, c, g, or t
  misc_feature (603)..(626): n is a, c, g, or t
  misc_feature (980)..(994): n is a, c, g, or t
  misc_feature (996)..(1008): n is a, c, g, or t
  misc_feature (1011)..(1026): n is a, c, g, or t
  misc_feature (1052)..(1083): n is a, c, g, or t
  misc_feature (1188)..(1207): n is a, c, g, or t
tgatccttggaccgcccactgcttgttctcaagttttcaagcgggtcgatccattctgcaaaaattgcggggtgaaaagcttcggttcctggactaaaaacagtgacaaaaaatgcatttattctcttctcacttcctccaacacaagatgcagcccgtttccacagacnnnnnnnnnnnnnnnnnnnnnnntcatggctcggtaaacattttgatccataaaattggggctggaaaaagcatggaaaattttggataccaatccaaacttcctagcctccagtaccctcgaccttatgaaatttatctttagcagatgcagtggaaactggaattgcatgtggttgccgaaaagcagacctcaaatgttgagcggtgtgcttctattgtggtggtgaaagttgcagcaacatcgtggacatatcaacaataannnnnnnnnnnnnnnnnnnnnnnnnnnnntaaattaccgacaaatgacgccaactctaactctcattataccacaaaaattcacctggatactgatttatatcttcactcgcagcctggaccatcgaaaaaaatgaaaaaataatacctatcatagatctttttcaacgnnnnnnnnnnnnnnnnnnnnnnnngtctagaagttgtccgtggattaggcctattggggataccacacaaaaaacgcgcctccagactctacctcataggtgacctaaaaaagggtcaaaaatggcttaatgaaagcataggaatgttaaaatcataataaatatatagatagaaaagtgagcttaaggttttgtttttgttgtattccctgtgagaattcgacaatctggtcaagtttgggaacgctgtgaaaacctaaataaatgaataagaattaaacaacttttatagtgggaaattgttcgttgagggatcctccataaaatccttattgatggtatttttgttggagggaaaacgggaaaaaattataaccnnnnnnnnnnnnnnncnnnnnnnnnnnnnggnnnnnnnnnnnnnnnnctttttttgtgggccccttgacaatnnnnnnnnnnnnnnnnnnnnnnnnnnnnnnnngtttaattttgctaacaatttttatgggaaattgggaatttttctgtatgtgggttatcaaatttgtggcaaaaaaaagcccgccaaaaggccccctttgcattnnnnnnnnnnnnnnnnnnnnggggggcaccccccgcggggtgaaaaaaggggggggcggatcccccccacc

SEQ ID NO: 15591 - DNA, 210 bp, Diabrotica virgifera
  misc_feature (5)..(5): n is a, c, g, or t
  misc_feature (8)..(9): n is a, c, g, or t
  misc_feature (11)..(11): n is a, c, g, or t
  misc_feature (16)..(16): n is a, c, g, or t
ccccnccnnanccccncccccctttctgcgtccgcttcatctccggacgtcatcaggcacccctttcttgtcacttgaccaagccagcaacgaaaaaacggcgccacaatggacgcgatcaacaagaaaatgcttgctttttaacctcgaataagacggtgcaggtgatggtgccgacgcgatggatggccgtgacaaacacgccacacg

SEQ ID NO: 15592 - DNA, 787 bp, Diabrotica virgifera
  misc_feature (12)..(13): n is a, c, g, or t
  misc_feature (15)..(15): n is a, c, g, or t
  misc_feature (17)..(17): n is a, c, g, or t
  misc_feature (22)..(23): n is a, c, g, or t
  misc_feature (31)..(32): n is a, c, g, or t
  misc_feature (38)..(38): n is a, c, g, or t
  misc_feature (58)..(58): n is a, c, g, or t
  misc_feature (64)..(64): n is a, c, g, or t
  misc_feature (71)..(71): n is a, c, g, or t
  misc_feature (73)..(73): n is a, c, g, or t
  misc_feature (109)..(109): n is a, c, g, or t
  misc_feature (132)..(132): n is a, c, g, or t
  misc_feature (136)..(137): n is a, c, g, or t
  misc_feature (148)..(150): n is a, c, g, or t
  misc_feature (155)..(155): n is a, c, g, or t
  misc_feature (167)..(169): n is a, c, g, or t
  misc_feature (177)..(179): n is a, c, g, or t
  misc_feature (183)..(183): n is a, c, g, or t
  misc_feature (185)..(187): n is a, c, g, or t
  misc_feature (189)..(189): n is a, c, g, or t
  misc_feature (194)..(194): n is a, c, g, or t
  misc_feature (196)..(197): n is a, c, g, or t
  misc_feature (208)..(242): n is a, c, g, or t
  misc_feature (254)..(254): n is a, c, g, or t
  misc_feature (257)..(257): n is a, c, g, or t
  misc_feature (260)..(260): n is a, c, g, or t
  misc_feature (268)..(268): n is a, c, g, or t
  misc_feature (275)..(275): n is a, c, g, or t
  misc_feature (278)..(278): n is a, c, g, or t
  misc_feature (281)..(284): n is a, c, g, or t
  misc_feature (288)..(288): n is a, c, g, or t
  misc_feature (291)..(291): n is a, c, g, or t
  misc_feature (297)..(297): n is a, c, g, or t
  misc_feature (306)..(306): n is a, c, g, or t
  misc_feature (309)..(309): n is a, c, g, or t
  misc_feature (315)..(315): n is a, c, g, or t
  misc_feature (320)..(320): n is a, c, g, or t
  misc_feature (329)..(329): n is a, c, g, or t
  misc_feature (335)..(335): n is a, c, g, or t
  misc_feature (338)..(339): n is a, c, g, or t
  misc_feature (342)..(342): n is a, c, g, or t
  misc_feature (344)..(348): n is a, c, g, or t
  misc_feature (351)..(351): n is a, c, g, or t
  misc_feature (356)..(357): n is a, c, g, or t
  misc_feature (360)..(360): n is a, c, g, or t
  misc_feature (363)..(363): n is a, c, g, or t
  misc_feature (365)..(366): n is a, c, g, or t
  misc_feature (369)..(372): n is a, c, g, or t
  misc_feature (375)..(375): n is a, c, g, or t
  misc_feature (396)..(396): n is a, c, g, or t
  misc_feature (408)..(410): n is a, c, g, or t
  misc_feature (414)..(414): n is a, c, g, or t
  misc_feature (423)..(423): n is a, c, g, or t
  misc_feature (426)..(426): n is a, c, g, or t
  misc_feature (432)..(432): n is a, c, g, or t
  misc_feature (442)..(444): n is a, c, g, or t
  misc_feature (448)..(450): n is a, c, g, or t
  misc_feature (453)..(453): n is a, c, g, or t
  misc_feature (456)..(456): n is a, c, g, or t
  misc_feature (466)..(467): n is a, c, g, or t
  misc_feature (472)..(472): n is a, c, g, or t
  misc_feature (480)..(480): n is a, c, g, or t
  misc_feature (489)..(489): n is a, c, g, or t
  misc_feature (503)..(503): n is a, c, g, or t
  misc_feature (510)..(510): n is a, c, g, or t
  misc_feature (519)..(519): n is a, c, g, or t
  misc_feature (534)..(534): n is a, c, g, or t
  misc_feature (542)..(542): n is a, c, g, or t
actaaggggggnncngnaggannaaaaaaanncgaggncatcccttaaagagcaagancgggancagcagnancgaaaaagagccacaaagcaagagcgagagcagggncagcaggaccccaaaaagaaganaaannaagaaagagannnagagnaaaaggaaaagnnngaaggggnnnaaanannngnaaaanannaagggaggaannnnnnnnnnnnnnnnnnnnnnnnnnnnnnnnnnnagaagagagagnagnaangaaaaaanggaaagnggnggnnnnaganagngaagangagggaggnggnaagggngaaanagaaaaagnggaggnggnnganannnnnggngatgnnganganannagnnnnagnagggaggaggaaaagagagangaaagaagggannnaganagggaaganganagaganggaaggagannnagannnganganggaagaaganncagancaggagangaagcggancaaagaccaacaanggcggangacgaaganaaggaaaaggagccngaaccaanaccagagaccagaaccgacggcgaaggcccaaaaaaaaccggggaacgagggagagacagacaccgagggaaacagaccaacgcgggatcagcagaaacacggccgcaaggatcccgaaaacccagaagaagaaaccgaaggagaaagaaaccgccggaggaagaaggaaaaagcagggggaaaattaaaagtaaaaaaaccattagatggaaagaatcaagggcgagggaagaaattggaaaaa

SEQ ID NO: 15593 - DNA, 434 bp, Diabrotica virgifera
  misc_feature (82)..(82): n is a, c, g, or t
  misc_feature (87)..(102): n is a, c, g, or t
  misc_feature (105)..(118): n is a, c, g, or t
caaagagacctgcaactttaagagcaggaagcacggagcgccaaacaggagaggaaggaagaggaacacgcgaaagagaganacggnnnnnnnnnnnnnnnngcnnnnnnnnnnnnnnaaaagctagaaaggtatatggaactggaaaaacaaaatgagcaatcaattgaggagaccgatagactcaaagaacaagtgaaaaacacgttaatactcgaacaagaagctcacgacccgaaagaccgactcgtgaaacccaaggattgagagaaaaaactgactgacggacagataccagaaaccccaaaaggctctgcgttcgaacgcaaggcacaccagcggccaagagggaaaaggcgaacccaacggaaaccgaatccaccctctgccccatccttcccgaaaggggaaccgggacaagcctcccaccaccc

SEQ ID NO: 15594 - DNA, 660 bp, Diabrotica virgifera
ttcgtccgaaatcatctagtgtggttcgactacgcgtttatactaagtaatctgaagtggctggacattcacggtaactttattgaacatctcgctaattattacaagattcaagacgtaatcagagtcaaaactttagatgctagtcataatcgtattaccgaaatttctcctatgtctattcctaatagtatagaacttttatttattaataacaattttatcaaatcggtgcaaccaaatactttcctcgataaatcaaacttagctcgtgtcgatatgtatgctaacgacatgacaaatttagatttaaattctctgagaatcgctccagttcattcgaaccgttccttaccagaaatatatcttggtggcaatacctttcattgtgactgtactatggagtggctacagcttatcaacaacatgtcagcatccaggcagtatcctcgtgtaatggacatggacaacattgtatgcaaaatgacacattctagaggtatgacacatatgccattaaatcaggcaaaacaaagtgactttctttgtaactacgaaacacattggtttgctctttgccattgctgggattttgatgcatgtgattgtgaaatgacttgtcctaataattggacttgttaccacgatcagacgtggaat

SEQ ID NO: 15595 - DNA, 669 bp, Diabrotica virgifera
  misc_feature (258)..(278): n is a, c, g, or t
gttgcggaacagtttttgcgaagtgacaaggaaagtgtcccaggatcgctgtgagtggcgaactttgaaaagtcatattttggaaactctaaatcataggtacttctacgaaacgtcattttaaatagaaaggatggaacttttttttctgtgaagcaatgcctatggctatatctccgtggaggggggttgtggggcaataaacaaaattgctgtctttcgtgttttttcttgcttttcttttgaatgtatatttgnnnnnnnnnnnnnnnnnnnnnttaaatgtgatctgtgtgacctggaacagtttccctgtagacgtgtttgcgcggagggtgcatagttagaactcaccttaattcgccctgtgcctagggactaattcgcccctttctcaaagaaagcacccctttaaatggtagtactcagcggttttttcatatttagaggtccattgactatatgaagtagtaaagccccgttaacgttgtagttcctttctaaaacacataatcaatagcctatagttttataaacaaaaatatcatccacctcctacctaggacctacctaattagatcatcacatagggttgccgccttcctacctagatgctcagcaatgcgcatgcctctattccccattgtgctctaacccaactcaggtgga

SEQ ID NO: 15596 - DNA, 1014 bp, Diabrotica virgifera
ccctcgggcgttggcaaagatggagtagaagcactattaccaaaaaataaacgacctagaaaagcgaaaaaaaagcgagaacagaaaccagatcctgaatacaaagtcacataaccgaagcagaaacgagaacgaaaaccacaacctgaatacaatctggaccaagttgtcaacttgaatgaaataaccaaaccgctgatctgcacaatttgttataaggcctttttgactcacatagaatttggttaccactccaaaacgcatcaagaagatggactgtaccattgccacttatgtgaatactctgttgaagctaaagatacgtttaaaaagcacgttagaactcacgatgtattcaagtgcgagaagtgtggaaagattctcaaaactaagttttctgctgataagcatgtgaagtctcatcaagctcccacgacagtccaatgtgagctgtgtggaaaacatctaaagaagcaatgtctctatttgcacaaaaggacagtccatgctactgataaggtgctggcgaagtgtcctatttgtggtaaagagtaccagaattctggtagtcttcgtcagcattactcagctttccatagagaactgggcattgacatgtctgtggtctgcgatatctgtggtatgcgtctatcttgtaaagccacccttgctcaacacaccagaacccatacaggcgataaaccattcgcctgccacctctgccccaaaaggttcttgctaaagacatcatggtggctcacatgagggttcacaccggggaaaaaaccatacatctggaaatttttgcgggaaaaagatttggcccaggggggttcccctataaggaaccccgttaagaaccccaccctggtggaaaaaaaccaaattggccccatttgggggcaaggggctttatttttggaaaggcttcctagggggaaaacttatgaaagacttggaaaatttaacttaaaaggaaggggtggatatttccgaaaaagggccaaaacccag

SEQ ID NO: 15597 - DNA, 170 bp, Diabrotica virgifera
aaactgaataaggacgatgggttccccccaatggggccccatcaacccttagaaaaaacggtttttctccccttataaaattggaagtccaaaattcttaaaaagagacctccttggtatcaaacagggaaaaaacaaaatcaaacccaaacttacggaacattattttt

SEQ ID NO: 15598 - DNA, 526 bp, Diabrotica virgifera
  misc_feature (232)..(251): n is a, c, g, or t
  misc_feature (482)..(482): n is a, c, g, or t
gttattacatttgagtaaagttttcctaaaaattttccattcctcgtaaaatgtatgaatgtgggtctgaccgcacaggtgaccaatgaataatgaaggtcatattttggcacgttttttaattcagcttagtttataagaagaatatagtcggccagtatataatattgtattctacttaaagaaaacgaagaatttagttttatttaccactatgagcagtgcaatgttnnnnnnnnnnnnnnnnnnnngatgcagagaaaattttttgtttgggtttaccttgcctttaaatataacatctctaaagttgactctaataatcttggcatatctagggttgaatccacaaccctcaaaataaactaaaaactagtattgcaacagcattgagtattttcaaatatacttctaacctcagattacattaatctgaataaaataagtacgtgaaagaaatcaatgctgatctaaaaaattanatacataaatacgtatttatcaaatctatctagcattattgact

SEQ ID NO: 15599 - DNA, 60 bp, Diabrotica virgifera
  misc_feature (2)..(22): n is a, c, g, or t
  misc_feature (25)..(46): n is a, c, g, or t
gnnnnnnnnnnnnnnnnnnnnnggnnnnnnnnnnnnnnnnnnnnnnattttttcacctgg

SEQ ID NO: 15600 - DNA, 385 bp, Diabrotica virgifera
  misc_feature (6)..(33): n is a, c, g, or t
  misc_feature (36)..(206): n is a, c, g, or t
  misc_feature (209)..(223): n is a, c, g, or t
  misc_feature (225)..(243): n is a, c, g, or t
  misc_feature (245)..(276): n is a, c, g, or t
  misc_feature (287)..(331): n is a, c, g, or t
  misc_feature (333)..(379): n is a, c, g, or t
aaatannnnnnnnnnnnnnnnnnnnnnnnnnnnatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnncnnnnnnnnnnnnnnnnnnngnnnnnnnnnnnnnnnnnnnnnnnnnnnnnnnntaagtctcggnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnntggatg

SEQ ID NO: 15601 - DNA, 1162 bp, Diabrotica virgifera
  misc_feature (3)..(710): n is a, c, g, or t
  misc_feature (712)..(965): n is a, c, g, or t
  misc_feature (1083)..(1102): n is a, c, g, or t
cannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttacctttagggaaaataagcgtaattttatttggaaagtttcaaatccgaaaaataaagaattgggaacccccaagggtgggattaaaggtttttaaattgggggggaacannnnnnnnnnnnnnnnnnnncggtttccaactttttaaaatttttacagtgttctggggatttaaaacccggggggggag

SEQ ID NO: 15602 - DNA, 393 bp, Diabrotica virgifera
ggaatagcaagggtatgcttgactcccgagaccttcaccagcctagacgaagcattacgtcccgacgtgtagctgaacctcaattgactgatccagaaccaaatgactggagagaaaaggggggagcagctcccataaggtaccaagggcaacggggagcatgttgaggcatttagagcagctggtgatcttgaacgacaaagatatttacagaagaacgaactacaagtactgaccacccaacaggaaaaagaaagatccggagaataggacaaagaaggctgcaaaggtggttggccccattggacatataactacatttgaagaccatggccccgggctacagtctgaccacaaaaataaaggaggagacggagactgcaaacagggaaa

SEQ ID NO: 15603 - DNA, 861 bp, Diabrotica virgifera
  misc_feature (774)..(793): n is a, c, g, or t
gacttccccaacagaaaaatcttataaaataagagacgcaactaaagccgatagggatgctattgtggagtttttgaggattagttttttcagagacgaacctttaaatgcttttttagaattagtcacggaagaaaatccaacttgtgaaaccttagaagagttcacagtgggacatattccgaatgggataaatttggtagcaattcataatgatcaaatcgtaggtttaatattgagtacacctttagaaaaagtccaagaggaacaatatgactgcaaaaacgaaaagtacaataaattggttaggttactggactatgctgcaaaacatgctgatccatttgttatatatccatcaagtaccaaaggtatatcagtacaagtaatatcagttagaaaagattttaccggaagaggattagctgttgaattattacaaaagacatgtgatttggctcaacaacaaggatatgatttcgttgaaattgcatgcacgagtttatattcagcaaaactatcagaaaaattaaactttgatctaaaatattccttgaaatatacggactacaaagaaaatggagaaatagttttcaaacctgagtccccgcacaccaccttgaacgtatacttgaagaaattataagtaataggtttgcgtcaaatggaccgtgatagtgtgatgtcaaaacgtcaaaaaggtttccaaatattgatataaaagtaccaaacaaagcaactgtcaattgattatacacgtgatttgtgtaatcnnnnnnnnnnnnnnnnnnnnttaacaatcatctgcacattttttctaaagaaacaatcttttgttagtcttatcaatcatatttcttt

SEQ ID NO: 15604 - DNA, 708 bp, Diabrotica virgifera
  misc_feature (629)..(693): n is a, c, g, or t
catattaaacgtaacactaatatttcgtttaaaattagacttgagcaggtgcagcaacaatagagtcctcgaagcctgattcattatttccgcgacgtattttaaacaatcccttgtctccccaatcttcattccatgaattagcaaccaaccaataagggactccactctcttctccccaacctaaaattctgacggcatgtcctcctaaatattctccagcaacatgttgatagacaccacttttataattcacgaagtagtttctggccatttccgcaaatacgattttggcaaaattaagaacaagaaattgtacaacggatctgaagtaccacccgattataatctatttaacgttaaggcccctgttcatcttatctacagctctaatgattggctcgcgcatgaaacggatgttgaaaacttgtaccaacatttgaagagtggtagggaaaagttttggggttctatcccggcatggaaccacatggactatctatttggaaaggatgctccaaagcttatttatgagaaaattatgagcattcttaataaataagaaaattaaaatatggaatatataatatgctttattatgatatatattaaaatatatggttagcaannnnnnnnnnnnnnnnnnnnnnnnnnnnnnnnnnnnnnnnnnnnnnnnnnnnnnnnnnnnnnnnnggtctaaaaggaacc

SEQ ID NO: 15605 - DNA, 616 bp, Diabrotica virgifera
  misc_feature (56)..(56): n is a, c, g, or t
  misc_feature (64)..(64): n is a, c, g, or t
  misc_feature (67)..(67): n is a, c, g, or t
  misc_feature (73)..(73): n is a, c, g, or t
  misc_feature (117)..(361): n is a, c, g, or t
  misc_feature (368)..(405): n is a, c, g, or t
  misc_feature (425)..(438): n is a, c, g, or t
  misc_feature (441)..(463): n is a, c, g, or t
  misc_feature (523)..(551): n is a, c, g, or t
  misc_feature (577)..(595): n is a, c, g, or t
ctcgtgcggcccactgattaatcagaatggccgcgggattccttccgagcgaaggnagcaaaancanaagganacggaaggaaagccggaaggaaggcgcggaggaaaaaaacggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttacgtgatctgagtttaaaccggtgtgagccaagttggttnnnnnnnnnnnnnnnnnnnnnnnnnnnnngtacgaaagggcccaaataatataannnnnnnnnnnnnnnnnnnagataaatatttccccaaacc

SEQ ID NO: 15606 - DNA, 437 bp, Diabrotica virgifera
attatatctcttttcttattttgacctcgttttttgtttctaccagcgcatccttggtattatcgtgtgaaattccatcaataaaatggtatctctctccgactctggaatctatttactcaccaccctttccagcgtgacctgattcgccgacatggaaaagttgatctcatacacccacgacccaaggaccccatatcgaccccacatgtatgaatcgcattgcacaaatgcagaacgtctcttgcgacatgctcgtcactaatgttgcggctatcaatcccaccaccacagctgttgttcgtcactgatactctttggtagaaatgttggtgatcctgacatccaccaatactaccaactctgtacctttattcttgtgatcgactgtactgagcccaacattcaagccgtctgcaatggtgttcgaaactgat

SEQ ID NO: 15607 - DNA, 602 bp, Diabrotica virgifera
  misc_feature (467)..(484): n is a, c, g, or t
tttaaagccgcccaagattactctagctctagcttcactagtgctttaggagattctggcaattctgataaaacagaaaccgtgcaaaaggaatcgaatggacctgtcgaggcaccagcttctgcgaaaatattgcttgaaatgccaagagtgaaatacataaaaccgaagtttgctatgaactttgaagaggctcggaagataatgaaaattaggaagcaacttgctatgttggagagacaaaatcaactgagtttggccagattaataccagttcaaaatagtatcgtaaacggagaaaccaataaggatgacaataccagccaaactgcagcttccgttaataaggaacaaacaaagactgttgatattagcgaagagaaagaaaacattaatacttccagagctgtcgatgacacaattatacaagcaccagttgataacaagtctgttaacaaagtagaaannnnnnnnnnnnnnnnnngtattaacttgataactgaaatagaaagtagagacataagcaagggaaactgggaggctctggaaacccaaactggcacaagttatgtctgaagtccattaccactggtatgacttcc

SEQ ID NO: 15608 - DNA, 73 bp, Diabrotica virgifera
tagagagcatggacgagtagcgagagaagcccgcaccgatcgcacgttcacaacacggagcgcagcgcagaga

SEQ ID NO: 15609 - DNA, 374 bp, Diabrotica virgifera
tcaaatgatgatagtgacattattgtagaagaatcagaaggtgaaatggcataatagtgaagatcaggataaaccgtaccagtcagtgcagttaaataaatgtgttatttgtaatttgatttgtactccatttggaatccaattttattatttgacttctaaaagcccacttacaatgtctactcaagtgcctgtgattaataaaatcgaaagaattttaggtaaaattcctactactaaacattatgtatgtaatgattgtttaggcttaattaataccattgatcacttacaacttaaaattttaacattcaataatgaacttgtgtcgaagtataagaaaacatgtattgaaaataaaaccttttttagag

SEQ ID NO: 15610 - DNA, 548 bp, Diabrotica virgifera
tagtgcgccggtgtgagccaggttggttgttttgtctaatttttagaagtaagtttgttatagactggcacaactatgcacattccataatggccttaaatctttccaaggataatgtcctagtaactattacgaaaaaagtagaatcatttgctggaaaaagagccgatcacaatttttgtgttacaaatgcgatgaaaaaagatctctgtgataattggaatataagtgctacaactttatatgataaaccaccaacagtttttaaatcaataagtttggaagaaaaacacaagtttttgagcaagttaggagaaacctacagacagttattgtgtgatgatggttctacagtttttacaaaagataccagtactggtgtaaatattaaaaatgatagaccaggattattagtatctagtaccagttggactgaagatgaagatttttctgtcctttttggtgcattgcaagaatatgaaaaccacattgtagaaggaaatgtaagaaaattccctgccctattctgtttgatcactggtaaaggg

SEQ ID NO: 15611 - DNA, 884 bp, Diabrotica virgifera
gtcagtttaattttctaggcatttttgaggctatctgtcttcttaagccatagtaacacttattggcgagcactattcttttaatttcttcactgacattgttatctttagttagcagcgagcctaagtatatgaaggtgtcgacaccttccagttctaggtcatcaattattatgcttgtagatgtcgggttgcttgacctagtgcaacacatatatttggtcctttgaacatttatatttagtcccattctctgtgcagatgctattaacgaccgaaatgcttcagtcggagattctgtggacctacctatgatgtctatctcatctgcgtacccaacaatttgtactgatttgttaaagatagtaccattcgtaataatctgggactctcgaattattttttctaatgccaggttaaataagagacaagatagtccatcaccctgtcttagtccatttttgcaatggaaggaatatttagatgtttagcaatgataaattatttaaatacatgtgataaattaaaagcaaagagattttccatatgtttattttaagtctaaaagaatatacctttatttagttacgaattcatcggtagttgattggttacccgaaaaattacctgaggggcagagttgccaattggcctgtaattaagatggggtataaaatagttacgaatcaccgggaccccatttcatcactattatgatgtttcgggaacactggggaggtctgatgcctaaaacttgaatcgggtaaccttaaagttggattaaaaaaagcctattaacaaaatttgaattggccaaatttttatttatgatttattggttaaaaaaacaataaagtggatgaaatggactcagttgagggaaa

SEQ ID NO: 15612 - DNA, 1265 bp, Diabrotica virgifera
  misc_feature (10)..(821): n is a, c, g, or t
  misc_feature (825)..(908): n is a, c, g, or t
  misc_feature (913)..(1005): n is a, c, g, or t
  misc_feature (1022)..(1039): n is a, c, g, or t
  misc_feature (1044)..(1067): n is a, c, g, or t
  misc_feature (1133)..(1150): n is a, c, g, or t
  misc_feature (1197)..(1247): n is a, c, g, or t
ttttatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaannnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagggaaacaaggnnnnnnnnnnnnnnnnnngtttnnnnnnnnnnnnnnnnnnnnnnnnaccccccatgtgtggattaaagttttaaattggggggaacaccttaattttttaaagctttgttcnnnnnnnnnnnnnnnnnnaatggattttgggttttaaaccgggggggggggacccagggggtggnnnnnnnnnnnnnnnnnnnnnnnnnnnnnnnnnnnnnnnnnnnnnnnnnnncaccaaaaagaggggccc

SEQ ID NO: 15613 - DNA, 472 bp, Diabrotica virgifera
  misc_feature (307)..(324): n is a, c, g, or t
agtttcgataggaggagaaatatcatacagttcactagaaccttggctgttccaatcatcagtacgaaaaaatattctctttggaaagccatacgaaaaaacctggtacgataaggtcgtcaaagtttgtgcactcgaaagagatttcgaacaatttccccataaagatagaaccatcgttggagagaagggtgtatctcttagtggaggccaaagagcaaggataaatttggcaagagcgatctacaggaatgctgatgtttatctattggatgatcctttgtcggctgtggacactcatgtcggnnnnnnnnnnnnnnnnnnctgtattgtaaatcacttaagaggaaagacgaggatcctagtaacccatcaaattcagtactttaagaaagaaattttatttgttgttgttaatgatggtaaaattgaaagcccaggtacctttgatgaactgatggaaatataatct

SEQ ID NO: 15614 - DNA, 684 bp, Diabrotica virgifera
  misc_feature (343)..(361): n is a, c, g, or t
  misc_feature (477)..(497): n is a, c, g, or t
atttcttctgtggtattgctgaaaatgtaataaatacacttaatcatactgaccaatcattcaatacataccttagttttataccacatgctccttcattcgcctctaatcattgctccttcagatttgagccaacaaatttggaggaagttgtaaaagcaatttaagaattaaaaaatagccagagcaaggacccggatggaatgaacacaaaaataatcaaggcaattaaacacaacattagcttacctttaactaaactaataaactactcaatttcatcctgcatttttccttcagtgtttaaaactgcgaaagtcatacctctctttaaacgtaaagnnnnnnnnnnnnnnnnnnntaactttcgtccaatttctcttttgccaattcttttccaagtgtttgagagaatctaaagaagcagatcaatgactattttgaatctaattcgctttttgcagtgcagcaatttgnnnnnnnnnnnnnnnnnnnnnccacacttgctatccatcattttacaggcagtaatttggaaggatttgaaaactttcttgataaccttggctccgtccttgatcttactaaagcttttgattgtgtcactcatagtattctttctaaaaaattacatgcctataattttcatcctatgtctattcaattgattgaatcttatctatc

SEQ ID NO: 15615 - DNA, 178 bp, Diabrotica virgifera
gcccccccccgccccttttttgttgtagattaggagaggctgctctagatgcacctaaccttacggacacgtgggtgcgacgtgaaatctactgttatacggcatgctaagttcaatccactccagcgatgttcaattgagtagagagaagtggctaattcggtggatttcctacttg

SEQ ID NO: 15616 - DNA, 497 bp, Diabrotica virgifera
  misc_feature (477)..(496): n is a, c, g, or t
cctttatacgacattataaagatctaaatattggaggaataacccctaaatgtcttgctagagcgatattctaaaagatgagtaaatatgcaaaatatacagatttaataaaacaaactacttagtatgctcgacggatgaacaggctaagtaatagaatatttggagaagttgttcgccccacaaatcccaagtctatgaaagtcgttaagttatttgctgcagagccagttcatttacaaagagaagtatatgcttactacccaagacatatagaaaccgggaagctaatgatgaagttacgacattatggtttatacagagacgaacatgcagattttcaagatgaaatggatagaatgagggctctaagaggtaaaccaaaacacatcaggaaatcaaagggcgaaagagaaaaagaggcagcagacaagaaagaatgaaagctctaatttagttgtaaatgtatagagtggnnnnnnnnnnnnnnnnnnnng

SEQ ID NO: 15617 - DNA, 722 bp, Diabrotica virgifera
  misc_feature (41)..(63): n is a, c, g, or t
  misc_feature (521)..(546): n is a, c, g, or t
ccatattgtataggccatgtgaatagttttcagcatagtannnnnnnnnnnnnnnnnnnnnnncatttgattctgaatgtcagctttctgtccattttcaataaaaatatcaactttcatacattttccttggctattacccatcccttcaggaaaaccttcccttcccttcaggtgtttgcaacagtaaaaatcctatatttataccctgtatagaaacgttgacttctcgaagacttcaaataatagttatttcgtaaaagacgtgtttgtagcacagtattatgggagcaagatgaaaaatgtccggtaatacctgttttaaaaaaaacctaaacaggtagtagtcactgggtgttaaatcgggagtgtaggtaggggattgagtcatccacataaaatatcccatacccaaatgatccgatggaaactttatattaattagctctatctttgagaaacattttcatacagagtattctgtctacccgctgaaaccggggcgagcagcacatgagtgnnnnnnnnnnnnnnnnnnnnnnnnnngcaatggtcaatcagcaaatcctccaataccaaaacggataccatattgcgaagggaaagttttaggactctaatactcacacggggttgggcttcagctcaatcattggatgaatcaaaatatttttaaaacttggcttttatgggtctttttcaataaatttcccaaaaccctt

SEQ ID NO: 15618 - DNA, 768 bp, Diabrotica virgifera
agtcgagacagtgagagtgcattgtctactctgccttaagaatgtactaccatcgacggcctgtttgaacatgtcaacaggataacgattaaactcaaccggaagtcatttcccgagccgaaggcgcccatcacatacgagtgattagactgcaacaagaccttgatcattgaagaaatcttgcgaatacatgtggacagaatttctcccaaaatgcaggaagtaatatatttacccaaaaacgaagaatataacgctcctcctcgtaccgtatggtctgggacatgctcgctccattacatgccactgattgactctcctctgcccccttccaaacgttgtcctggataccggtacattaaatgaagctgaagaacacccatctgcataatacacatatccccttccccctgtcgacttgatgatctacaacttgcaaatacgaatattccttggagcctactatgacataaggatgcgctcgacccaaatagacggatttcactatatccctgaaccttccagactgtaccacgtttggagacataagaccagatgaaacttattattcgatcatcttcgtgacttctgctatgagatgtcctcctatatccaagacagcacatactatcgacaattctcctgatgctctgatatgtctgtcaaatgagtatactattgatactcaacacagaaattattcatcgacaaccatattgatattgactacatgtgatagaagctcgacatatccagatctactagaaa

SEQ ID NO: 15619 - DNA, 614 bp, Diabrotica virgifera
  misc_feature (512)..(531): n is a, c, g, or t
attgtatgaagatatggaggttacagatacccatatttgggatattcactcgagagcctctgcacctcctgaattcagaaccaattctgaagattataaactctactacgatacgtgtaatacaagcaactatagcttagacttatttccttcaacaggaatctaagatctgtattaattatctagccacaaccacggaggagaatagagtcctataataaaatgcccactcgtgataccctctaaacacatccacctgaaactgatcaaacttttaaaaaactgtgaaaaatcttctaatcccattccaggctaccctcccttaaagacgaaccatgataacgaatatctacttgatattccttgggagaatttctcagaacctgtgataatttattgtacccggattaatgttgataccttgactatcctaactatctctaatgtctccactgcccaatattatacaaacaacaagaatatagcccgatcagtgcatcctaagatgaacnnnnnnnnnnnnnnnnnnnnaagcgcatatagtgattgcgctgcttgaagacactcattattaatattgtcttaccctcactcgcgagtagctgaaaccgtgc

SEQ ID NO: 15620 - DNA, 726 bp, Diabrotica virgifera
  misc_feature (2)..(85): n is a, c, g, or t
  misc_feature (87)..(205): n is a, c, g, or t
  misc_feature (255)..(274): n is a, c, g, or t
  misc_feature (359)..(377): n is a, c, g, or t
  misc_feature (397)..(412): n is a, c, g, or t
  misc_feature (414)..(487): n is a, c, g, or t
  misc_feature (498)..(580): n is a, c, g, or t
  misc_feature (587)..(653): n is a, c, g, or t
  misc_feature (657)..(692): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatatatatggtttataaaggaaatcccccacattttttttcccctnnnnnnnnnnnnnnnnnnnntttgaattaaaataaaagctcgcctgccccctgattaatttgaatgggcgcggggattttgacccgggctaagggaacataaacnnnnnnnnnnnnnnnnnnnggtgggaagaaaggggtggnnnnnnnnnnnnnnnncnnnnnnnnnnnnnnnnnnnnnnnnnnnnnnnnnnnnnnnnnnnnnnnnnnnnnnnnnnnnnnnnnnnnnnnnnngaccccctaannnnnnnnnnnnnnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnnnnnnnnnccctaaggggaaaaacaccgcgcaaatttttttt

SEQ ID NO: 15621 - DNA, 500 bp, Diabrotica virgifera
ccttcaacggtatctgtcttattgttatgatgatgttttctccccttattggaacattttatggcaaaaaatactataagctcatactaatattgacatactacaaccgttattatttaaagctggactcgagtgctccatttccgtctcgtaatgatttgattatagccattttatgacaaggaattccacctgaagattgcgtaaacattgatttgttgatgtggacttcacctgtttcaaactcgatcatttcgtgtaccaccagtttatcgaaaaaaactccgttgctttgatcaggagcaccgcaaattgtcgtctaatacattttgtctaatcctggactccacgtggtttcactataaaagatattagtactctttgataattgaaactggacgaacgttctttgcatagaccacccttatctgaattccttctatcaacattgacctatatacagcaaaagtcatccttggtctcaactggtggtactctga

SEQ ID NO: 15622 - DNA, 303 bp, Diabrotica virgifera
  misc_feature (186)..(202): n is a, c, g, or t
ctttgggcgccacagctagccaaggacggtacgtaatttgcccttatgcaatcctcgtgcctaaggtaccccatggctcgttcgacaactgaagaaggctttcccacctatgccctatttttttggaagtccaagcctggtgagtgtaaacacgatgtgaacgatgccctcgacatcggctaccgnnnnnnnnnnnnnnnnncaaggctacggaaacgaacgagaagcaagtgctggctggccgggccaacttgccgagggaaaagtcaaaggtgatgacatctacatgaccagaaaactcta

SEQ ID NO: 15623 - DNA, 710 bp, Diabrotica virgifera
  misc_feature (410)..(428): n is a, c, g, or t
atcacaagtatttgaagatagatatgtttatagtatagtattatgatttttaatgtatatgaaatgtttctttctaagatgaattttaagtagtgggagatgttgattaattgaaaaatgttatgaaaggttttggtttagagaagaaagaaattataaatgtgatggtatgaagaggatttgaaaaaagttttgagataggtgaaatttttgagatttaataaggtaaagattttgaataagagttttagattgatttgtggggtatgtatgaggatgtgatgatagttatattgtttatattgtgtattttgtatggaagagatttgaattatgttgtattaggattgggtatttatgtggaagttatgattaagattttgtgtatattgttatatgatagaattcgnnnnnnnnnnnnnnnnnnngtattaatgaaaggtatatgtattaaaaaatgatttgaaaggatataattttggaaattgttgatagtatttgtgattatttattgtttgatataagagaagatatagagggtgtaaaggattaaaagtatatttttgacgcctgatctattgatagaatgtgtttatggaaaatgtataacctcacgattgatcattgattacgttgattgtcccgggagttttgatcgagttatagcagcattatcttaatattttttgttgaagggtggatagatcgaa

SEQ ID NO: 15624 - DNA, 655 bp, Diabrotica virgifera
ttcaaagcgagttgctgactggaatacaaccatctacttctaccttttctacaacaccctcacaagcacctcttataaaaccagatttatgccttatgacagcatgaatgcctgttatcagtcttaaagggaaccacacacagaacatacactgattacagaattgagctatctactgcagattcttcaagctaatcttgacttgtaaacaatcactgcgagaactagaaattcggaatgtaatccatccagggttcatgaagctattatgagataaaaataaccaagaaccactgcccttattttcgatcaggaaaaattgtctgtacaggaaacaaaaatgagcatgatgaataggtagaagcagagaaatttgacacaatcaaacgaagactaggatataatatcaaattttgtaattaccaaagacaaagtttattatgtatctgagacctgacgattgctattaaactggaaaatttatatatgatgcatggacaatttagaagctacaaagcggagcatgtctctgtactagcataacaaatgattaaagcccaaggtgatgattttagtttttgttaatggtaaagtagtgttcactgacgccaaaccaaagagagacatcaaagaatctttaaataatatatatcca

SEQ ID NO: 15625 - DNA, 415 bp, Diabrotica virgifera
  misc_feature (225)..(243): n is a, c, g, or t
aaaccgagccgccgccccaagaagcggccacaagaagccaacgacgagcccaagcaggagggaccactttttttccagcccataaccaagcgtaaagagtaaatgaagaagaaccacgaagcaaagaaacccaagaaaacaggcaaaacaaacgaggaaagcagagttaggaaacaaaggggaagacaaaccaaccggtagcctcggaaaaaacgcccccacagnnnnnnnnnnnnnnnnnnnagcaggcaaccccgccaggtgcacaacaagcacaaagaaggaagggaagcaggacagacgacagacagcggagcgcggaaccgcaaaacaggaacatagtaggcacccagccgggccgccaccggaagaacagagacagagagaacaagaccgggttacaccacaaccggac

SEQ ID NO: 15626 - DNA, 410 bp, Diabrotica virgifera
  misc_feature (284)..(302): n is a, c, g, or t
gggattattaatgaataattatgtagttatgattttggaatttaaaggaggtaaaaagggaaaaggtgtattggaaaataaagggggtaaataatttttttgtagagtagtggtattggatttagaagatatggaagggggtaagagggaaatgagatttagttatgaggaggatatgtataattagatatgtttatgtgattagtattaagtatttgtagggatgagtgtaaaaataggagtttattaagattgagtttttttagtaggaggaggagtagaannnnnnnnnnnnnnnnnnnatgttaggatttattgtgatatagtattatttttatggtgttatagatagggtatgagagtatagattgaaattatttgaaatgtaggaatggtgataatgttagtat

SEQ ID NO: 15627 - DNA, 551 bp, Diabrotica virgifera
  misc_feature (535)..(550): n is a, c, g, or t
gctacatgatcgacgggaggaatatgcaggttcggatttaatggtcaggaccggaagaatgcctacgaagagattcgcctatcctactccgaccttcaaaaaggaaaacccacttgcaccattagtgtgccctagatatcagttcatgacacgctgctattcccctttctggacatacaaggcacctgtgcagccgattgctgagacccacatacatctggcaccagatgtagtgatcgatgatcaattgagaccgaactgagcttctctctctggacccaccaatatcgcactaacatcactatgccaacatcacagaggatcgacttagaatgtacaggatgatattgcgcatcgtctacacatctggtcattggccgagacgcccaaagttactgaacactctgagctgccacttcttacaaggtcagtggggtcagactgaaacgctaactcaacttaagtatgacatgctcactgacatcatacaaggattatgaatatgaaggcacaaacaactgcatatacggcgacnnnnnnnnnnnnnnnnt

SEQ ID NO: 15628 - DNA, 927 bp, Diabrotica virgifera
  misc_feature (850)..(850): n is a, c, g, or t
  misc_feature (877)..(877): n is a, c, g, or t
agaaatataatttaaaaaactatagtgtgataatatttaaaaatagcaatgtccaataaggcacaaaatttacgtgtacaacttcagaacattatagcttcgggaggatctcacaaagatcaagctgaaaaatataggtctacccttgaaggtatactacaagagagtggtactgatttaattgaatgcttacaaacttttattgaagcaattcttaatgaaaatgtaagtttagtaatttctcgacaaattctaaccgaaattagtgcacatctaatgaaacttaaggatgatgtttcaaaagctgtgtcacactatatgttagataaagttcagccaagggtgatatcttttgaagaacaagtagctagcataagacaacatttagctcttatttatgaaaggaatcaaatgtggagggaagcagcagttgtgttagtcggaattccactagaaacgggccaaaaacagtacactgttgattacaaactagagacatatttaaagattgccagattatatttagaaaatgatgatcctgttcaagctgaggctttcatcaacagagcatccttactacaagctgaatcccgaaatgaacaacttcaaatttactacaaagtttgttatgccagagttttagattatagaagaaaattcattgaagctgcccagaggtataatgagctctcttatagaaacatagtgcatgaagatgaaagaatgacagctttgagaaatgctttagtatgtactgttttggcgtcagcaggacagcaaaggtcgaggatgttagctactttgtttaaagatgaaaggtgtcagcagttgcctgctgttggaattttgnagaaatgtatcttgaaaagattattangagatctgaacttcggggacttccgaagcttactttcacctcatcaaaaa

SEQ ID NO: 15629 - DNA, 919 bp, Diabrotica virgifera
  misc_feature (591)..(613): n is a, c, g, or t
  misc_feature (894)..(911): n is a, c, g, or t
gttttcagcttgctattggtcagcttttttttcctacgcgggatacctattaataacctataagtaccaaagattaaccactacacctataagtaacaaaattcaaatgtttgtttctttttgtagagctgatttcagattacaacatcaacacaaagtaaataattgacctgaaagtaaataactatatacaattaccatttcaaaggaagtaggtaatagtacaaagtttagtttcaaagtacctacaaagtaccttagtttttgtaagtacctagaaatgttattgaaaaagtgttggaagtcaaagatgtttgtcaaagcaattaaatcctattaatgcaggtaaaattatttaaagttattgtggaacattacaaaacgtaccaaatgattacaaaggtaaagtttcagaaggtttataaccagatgcagattaataagatgaccttaatgttattgaaaatagaccatttgaccaaaattagtgttgaaggggagaagaaaaaataagatatgcattttttcagcaatattttaatgtataactttataaataaaaatgtttaattggaaaatatgagttttacnnnnnnnnnnnnnnnnnnnnnnngtattattttctgggaaactgtcattttctttatcttcttaaggtttttggcctctaacagtcagttttcggtcaatttctaggttaaaagtaattcaaaacgatcaacgtgcgacgttgccgtatttgttccaaaccttttagaggattcctctaaaaaatattattttagcgggcctctataaaatgggtttaaagaatggcaatctaacccgaaaagttttaaagggaccggtaaaaagttaaaatttaaaagggctctttaaatttagggggaaagnnnnnnnnnnnnnnnnnnccaatggg

SEQ ID NO: 15630 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (164)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaaccggtgtgagccaggttgggttnnnnnnnnnnnnnnnnnnnnnnnnnnnnnnnngaaagg

SEQ ID NO: 15631 - DNA, 424 bp, Diabrotica virgifera
gccggtccccccgcgccccccccaggccggccgctgaggcaagcgaatgaatgaactatgcacctttgtagacacatttttccaaaaaaatggacttagagcgttccacctgaaaccaaactggccgtacacagatcagatagaatcaccgcaatatgacgggatcgtggaacaggctgcaccgtatcatgatgtgaacacttcaaagaagacttctcttgatccagatgcgcaacgcatcaaccaatccctgaagctccaaatcggcgcattatacagaacagagttaccggccagaagagtggttgattctcctactgcaccaatcaatacggactaggatgatgtgagagtttacaacaactgtgctgcggagattgcgaacaagtcccctacacggctggtgttaacctgtggtgggggc

SEQ ID NO: 15632 - DNA, 1194 bp, Diabrotica virgifera
  misc_feature (14)..(44): n is a, c, g, or t
  misc_feature (46)..(120): n is a, c, g, or t
  misc_feature (123)..(147): n is a, c, g, or t
  misc_feature (149)..(264): n is a, c, g, or t
  misc_feature (579)..(597): n is a, c, g, or t
  misc_feature (829)..(857): n is a, c, g, or t
  misc_feature (864)..(883): n is a, c, g, or t
  misc_feature (944)..(969): n is a, c, g, or t
  misc_feature (972)..(994): n is a, c, g, or t
  misc_feature (1016)..(1040): n is a, c, g, or t
cccccttcacgtcnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttattcgtttttaaatacatctaatttttccacaaatacacttaaatttatttatcaaccatatacttataattcaatatttttatcttcttactatcgcatactcttcccccccagcttaccaccgcactgcgactaacacctccttcttcacccaaccaccaggacctatatctctacatatctcaccccatcgccctcactcaccccctccatcccgccgcgcaccactctgccctccttcccaccctctccttcccctctcctccccccccccaccgcccctcccactccccccccccctcctccccnnnnnnnnnnnnnnnnnnntcgctctgctcctccaccccctccctcctctcctcgctcccctccccctccctcctccccccccttttcccccctcctcgcccccccctcgcttcccacctcccccctcctcttcctctatctacctttactctcccactttgctctatcatcctttacccccccccttccccctcttcccctcctccccccgtcctctcttccccttgccccccgcctcctccccctctannnnnnnnnnnnnnnnnnnnnnnnnnnnnccccctnnnnnnnnnnnnnnnnnnnnttctctctcacctccttctcctctcctcctccactctccactcctcatcactgcccccctnnnnnnnnnnnnnnnnnnnnnnnnnnctnnnnnnnnnnnnnnnnnnnnnnngccctcccctccaccccctccnnnnnnnnnnnnnnnnnnnnnnnnntcctcccactcacctcctcctcccccttctccccacgccttcctcaccccccccccatgtctccccctcctcccctcctcctctgccgcccccgccctccctctcctcccccccccgctcccgcccctccccctctcctctcctgtcttccccc

SEQ ID NO: 15633 - DNA, 717 bp, Diabrotica virgifera
  misc_feature (13)..(186): n is a, c, g, or t
  misc_feature (188)..(518): n is a, c, g, or t
  misc_feature (525)..(562): n is a, c, g, or t
  misc_feature (582)..(595): n is a, c, g, or t
  misc_feature (598)..(620): n is a, c, g, or t
  misc_feature (628)..(650): n is a, c, g, or t
  misc_feature (680)..(711): n is a, c, g, or t
cccttcgcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15634 - DNA, 570 bp, Diabrotica virgifera
gtggtttatttgagtggtaacaataaaaatagaaggcaatttaagttaccggaccattactagaattacaaagaaaagacttactgttcattcatctgctgttattctttatatgttatatttgtactgctaattgcgattttgagctaattccacttccaacaattctgactatcccaaactccctaacacaggagctacccgacttaattcgaggatctgtgattgaatcttgaaacagatacggaggaccgactccaaaagcgttatgcgactattcaaatggacaatattatggtcctattatccttggctatcccaccacagacttttcgagacaatttccatactggatcttctagtttgctgtagtgccatcttgtagatgaggatttactaacatagcatgcttgctacacacacacatatgactcatcgaaatcgtctatatattaacaaaacggaactaagtatgaaatccactatgtatctggaagtcttagtggattattgtatacggaagtagatccttatggaaacgatgcctatagagagcacccctttgtcgaa

SEQ ID NO: 15635 - DNA, 546 bp, Diabrotica virgifera
  misc_feature (290)..(308): n is a, c, g, or t
aatatcgatagtacatatatttgataaataattgatttaagacatgaaattaataaaaagttatctattgtttattatttatggaagatcccaagcagagaatacactaggatatattctgtgatccaagtattttgttgtttaggttcaaattttatctaagcgttccataataacaatatatgtatattaaaaaatacactttattacttttccttttttctcgattaagtattagtttttattgcatagtatgcctataaattattttaatcactggatacatagtnnnnnnnnnnnnnnnnnnnctgaattaataatttatgcaacggttatccgagaacattcaaaagtcatctctaagataatggtgacaaagtcactgtcaaataatctttatgtacagggttattcactatattttgaccacccagtaaactgctttattcacagagttcgaaaaaaatataaaaaaaccaaagttattcgatttttaaattatgactttttgccatatgtgtcctactgctgacggcgtcccatctg

SEQ ID NO: 15636 - DNA, 1011 bp, Diabrotica virgifera
  misc_feature (356)..(377): n is a, c, g, or t
  misc_feature (379)..(391): n is a, c, g, or t
  misc_feature (484)..(501): n is a, c, g, or t
  misc_feature (946)..(963): n is a, c, g, or t
ctaaaagtgttctgtatgttttggattttttattgcagctggaacttcataaacacttaaggtgtattgtttaatttgaaatctacatattgtgtcaactgtgctaatattgataatatatccgtatcttccaacagcatgacattttaaatggacagtaatggagaataacgaatatccaacagatcaaaataaagagagacgaaattcaaatacggagtatatgtctacaaaatgtcgaataacgaagccagaaccaccaaaacctgccacgaatccattgcaatttataaaagtagcgccttgtcctcttttccaaaaagcccacgaacaaataaaaaaagtagaggaaatannnnnnnnnnnnnnnnnnnnnngnnnnnnnnnnnnngattggcaaacgaatcttgacaactggaagagtagtagaagaaaaagacaagaacacatcatagaacgggtagtagaagtaaaaaaacttacnnnnnnnnnnnnnnnnnngaaaagcagaagaaaaagtaaaacctttaatgaaatgatggaagaaaggagtaggggcagacataaatttaatattcctttatacgaagacgattcaaatgatttaagcgattatggaattggtagcagcagctcgaaaacgaatagcattaaagatgttgatacagacgatagtagcagtatactggacgaaaaagacaatcacacattcgatttatctagtactaaaggcaattccagtacctcaaaccaaagtcaaagtgaagatgaaaccaacaccaccaaaaatgaacccatatctggaaaataaaaacaataccgtttacaaaaacatacacgagtacctttctccactaacccaagttcccaataaaaagaaaacctggggtcccttaaataaaacccctccataatttgaaaaactaaatttcaaatcacaaaaacnnnnnnnnnnnnnnnnnntaaacccttacaaaaaggggcttattccaaaaactaccccgttccgag

SEQ ID NO: 15637 - DNA, 171 bp, Diabrotica virgifera
  misc_feature (2)..(42): n is a, c, g, or t
cnnnnnnnnnnnnnnnnnnnnnnnnnnnnnnnnnnnnnnnnncaaatatataggcctcaccaaaggacctcccgcacattttttccaccttgcctattacaaacatgcctttttgtattgactttaaaagctccgcctgcccccctgattacctccaatgcccgccgcatt

SEQ ID NO: 15638 - DNA, 392 bp, Diabrotica virgifera
ggcgtatttatgtgagaatgcaagtaaaccctttacactatatgtcatcatactagaaaaacgccgacaagtatgatgctacaggctagttgaaatacgaatgaggagtcatcaagatgcgtgactacaacaagaaatccctcttaaacaaagacctggcccaaggtatcttccaaagaactctagagccaagaacaaccccattctcgaaagagcacttgtatatgtcatccaaactggcctatgagatcacgactccggagaaagtatctaaacgtgataggtggcctcgtacatccgagctccctgagatcttccgatccctgatacattactacctggctgggatgcactcagacgccgcaactgctcctgatgaattgtaagtgaat

SEQ ID NO: 15639 - DNA, 214 bp, Diabrotica virgifera
  misc_feature (2)..(58): n is a, c, g, or t
  misc_feature (72)..(105): n is a, c, g, or t
  misc_feature (144)..(156): n is a, c, g, or t
  misc_feature (159)..(176): n is a, c, g, or t
  misc_feature (178)..(193): n is a, c, g, or t
  misc_feature (195)..(211): n is a, c, g, or t
cnnnnnnnnnnnnnnnnnnnnnnnnnnnnnnnnnnnnnnnnnnnnnnnnnnnnnnnnncctcgcctgccccnnnnnnnnnnnnnnnnnnnnnnnnnnnnnnnnnncgctaaggtaccataatccttaatttttttattgcaaannnnnnnnnnnnnctnnnnnnnnnnnnnnnnnntnnnnnnnnnnnnnnnncnnnnnnnnnnnnnnnnnctt

SEQ ID NO: 15640 - DNA, 472 bp, Diabrotica virgifera
acagagagaccttttgataatgttctacaacaaatgaattttcgctttcaaaattttaacgaattaaaatttgtagaattatatataatcttaacatttctaattataattcccacagaggaatttatttcactacgattaaataatgaaaatattttgatatgccagatttgcattataaattaagtgttatttatgaaacaactgacattagtgataaagatatactcagaaatctgggtatttctttataactactggtttaaaccagtccctgtgtgaagtgtccaagttgtgtgaattactactaactatcccagtcacaagtgcatcagttgaacgtagtttttcagtatttaaaaatgcattaaaagttttacaagaaattctacaatcgaagacagactttacaagtccattgaaaacgactgcattcaaccattatcagaattttgataggacaatagagctc

SEQ ID NO: 15641 - DNA, 1205 bp, Diabrotica virgifera
  misc_feature (11)..(39): n is a, c, g, or t
  misc_feature (265)..(287): n is a, c, g, or t
  misc_feature (294)..(307): n is a, c, g, or t
  misc_feature (309)..(333): n is a, c, g, or t
  misc_feature (381)..(420): n is a, c, g, or t
  misc_feature (433)..(463): n is a, c, g, or t
  misc_feature (526)..(555): n is a, c, g, or t
  misc_feature (563)..(637): n is a, c, g, or t
  misc_feature (658)..(683): n is a, c, g, or t
  misc_feature (722)..(752): n is a, c, g, or t
  misc_feature (754)..(804): n is a, c, g, or t
  misc_feature (811)..(870): n is a, c, g, or t
  misc_feature (892)..(938): n is a, c, g, or t
  misc_feature (946)..(998): n is a, c, g, or t
  misc_feature (1047)..(1077): n is a, c, g, or t
  misc_feature (1169)..(1203): n is a, c, g, or t
ctccccccccnnnnnnnnnnnnnnnnnnnnnnnnnnnnnttgccccaacccccccccaaaatcttcccccaaaaaacccccaaaaaaacccccccccaatgccccccaaacccccacgggcccccccctttaacaaaacaccccaaggcccaaacatttttgggggcccgcccaaaaaaccccaacttttttccccaaaccccccccccggcccccctaaaaagccccccccaaaacaccccccccaaaaaattccccccccgcnnnnnnnnnnnnnnnnnnnnnnncttttcnnnnnnnnnnnnnnannnnnnnnnnnnnnnnnnnnnnnnnctaaacaacaccccctacccccccccccccaaccccctcccctctcannnnnnnnnnnnnnnnnnnnnnnnnnnnnnnnnnnnnnnnaccctcccccgannnnnnnnnnnnnnnnnnnnnnnnnnnnnnngcccccctctcccgcgccccggccccccctcccacacccctcccccgcaccccacacacccannnnnnnnnnnnnnnnnnnnnnnnnnnnnnacccccannnnnnnnnnnnnnnnnnnnnnnnnnnnnnnnnnnnnnnnnnnnnnnnnnnnnnnnnnnnnnnnnnnnnnnnnnntgtccctccccccccacccannnnnnnnnnnnnnnnnnnnnnnnnntcaccccgcgacaccccgataccctcacccactccatannnnnnnnnnnnnnnnnnnnnnnnnnnnnnngnnnnnnnnnnnnnnnnnnnnnnnnnnnnnnnnnnnnnnnnnnnnnnnnnnntcactannnnnnnnnnnnnnnnnnnnnnnnnnnnnnnnnnnnnnnnnnnnnnnnnnnnnnnnnnnnacaccccccctcacaccctcannnnnnnnnnnnnnnnnnnnnnnnnnnnnnnnnnnnnnnnnnnnnnnattccatnnnnnnnnnnnnnnnnnnnnnnnnnnnnnnnnnnnnnnnnnnnnnnnnnnnnnaccccaccctccctgcccccgccctctcctcccccccacccccaccctnnnnnnnnnnnnnnnnnnnnnnnnnnnnnnncccacacccccccctccctccccccctaccccacaccccccccctaccccacttcccacccccaccccctcccctacccctctgccttcctnnnnnnnnnnnnnnnnnnnnnnnnnnnnnnnnnnnac

SEQ ID NO: 15642 - DNA, 921 bp, Diabrotica virgifera
  misc_feature (564)..(587): n is a, c, g, or t
  misc_feature (674)..(699): n is a, c, g, or t
  misc_feature (708)..(738): n is a, c, g, or t
  misc_feature (771)..(795): n is a, c, g, or t
ccccttgcgtccgagatctttcaaaaccattccgcggtgtaaccccaaccagcataatggaagatatacaaaaatgcacaaagaaacttagtgacgccttctggaaaaattccaggtcaaaggcaagcagaaacttattacaatcttcgcctcgatctgcaaaaatactcttatagctctgaagaccgaaataaaagtacctattcactgaatattgcttacgtagatatcattcctctagagtgaatggaaagcggaacagaggaacatgtagaaatgcgaaaatgcagaggaaacagccaagcatgttgtctctaactgcaaggcaatttctttcccaacgccataagtacatggaacatgtcttttatttgactcattattgtgttaatctttggcgtattacataatattctccctccctgtaaccaaatctttaagaaataaagtccgcaatttctaagtgaagagatctttgaaggttgtagttgatttatcatctcttagccgaaactcatacattcataatagttcatttgaatgtggtagattgctactcttaannnnnnnnnnnnnnnnnnnnnnnnctaacacattcgtcaaagaacagcgtggcgtgtcttcatcgaataaacggttttcgccccacgcttttctttaacgaatgtgtcagnnnnnnnnnnnnnnnnnnnnnnnnnnctttttggnnnnnnnnnnnnnnnnnnnnnnnnnnnnnnngccactttagtacctaaagaaaagcgtttcttnnnnnnnnnnnnnnnnnnnnnnnnnctttttaggcttacactttttcaacttaaaatatatcgtcatggttattaaaatatggataaaaccaatggatgcactaccctgaaaagtacccgcatcccccacaaatttgaaactttaattgtt

SEQ ID NO: 15643 - DNA, 522 bp, Diabrotica virgifera
  misc_feature (49)..(85): n is a, c, g, or t
cacgtttacggcaacttcaggagcaaaaaaagaatttactttataaccnnnnnnnnnnnnnnnnnnnnnnnnnnnnnnnnnnnnnctggaaattttcgatttatttaacaacctgtatatttgttttttactaggtggtttctccattgtccattgttttatcagtagatttgataagcttaaatctttgtatcagctttgctagacagggttgccaggccagttcttactctttcagtactatatccgttgcaagatggtttggctgaagctccgacaaagtatgtactttttgtacatattttgtctgagttccatccgaattatcttgcagcggatagtagctttgctttcaaaaaatcaatagaaatcagtagattctttttaggacctgtaaatacagtaaaatctgtgttaacggttacctgtcaaaatcgtccggtttcataatccaacttaaagtaaacattaagtaaagctcactttaaagctgacatttaaccatatacctatgaattgtga

SEQ ID NO: 15644 - DNA, 439 bp, Diabrotica virgifera
ttcaaccttcgctgaattgatcatgacctgagcaacctcggcaaccgctttggcccgttcgatttccattggtctttctgggtccaggaggctctcgatcgcgacgaacaggtgattacgtagatcttcaatcttgttcttcatgttcaacctcccggatggtgcgtttgagtttgccgatagcgcgtattgcggatttcagctcttccggataccgatgaatggtgttccgacgcatacgttctgctctcgtcagcaactccaggttattcagggctatatgggccttgttgccgtccttgaagcacacgcacatgtttatagggactggtccgtgatgctcctcccaaagcagtacatgcacggctttccagtcaacgggtgggtaaccggtatcggtgattttcttctgctgataaccgtcaggagttgtgcgcag

SEQ ID NO: 15645 - DNA, 292 bp, Diabrotica virgifera
  misc_feature (8)..(36): n is a, c, g, or t
  misc_feature (90)..(109): n is a, c, g, or t
  misc_feature (185)..(208): n is a, c, g, or t
caataacnnnnnnnnnnnnnnnnnnnnnnnnnnnnncggaaaaaaattcaaaaaaaggagtccactaatggaataattttacaaaagggnnnnnnnnnnnnnnnnnnnnttcaaagggaaaaatattttttgggtgggggaaaaagaaacaaaatttattagcaaaaaaccagaacgggcttccnnnnnnnnnnnnnnnnnnnnnnnncccgcaaaaaagttgggcccggagggcgcgtcccaacacctcaaaaatattgtggggggggatccctaaaacacccacggtctc

SEQ ID NO: 15646 - DNA, 608 bp, Diabrotica virgifera
ctccattacgcgtccgagaacttatagaccggtactgtactacccacgtattcttgaaatatgtgtgacaacatgtatattcaccgtctatttgagtccgtatatgagacagcctttgctacatcacgtgacattctctttagaaaataagagcctgcaagtaatattctgacaacgatcccttccttgatgtccactacatgatatacttgatctgatttgactctacccccgtacgctacaacgtatgtgcctaccatgatggcatatactcatttgttgatgtcatagtcatttccgtacaccgagaaagacacccatctgctattccatggagcacatctgatgcatattatgcaataaaatctaccggagagtacacctactcatcgcaaacgtcaacaaacatcttgaccgcgttgctaataaagccatcatctcagcatccatctgaatgatgctccaatgtatgaatgtggcgataacttggatgcctactatccagctgatccagtgatgtctaccgcctcttacactaccaactgcctagctccactcgccagagccatccacgacgacttcgaaatctatgaaagcctcatgaccac

SEQ ID NO: 15647 - DNA, 499 bp, Diabrotica virgifera
  misc_feature (21)..(39): n is a, c, g, or t
  misc_feature (61)..(120): n is a, c, g, or t
  misc_feature (124)..(312): n is a, c, g, or t
  misc_feature (314)..(373): n is a, c, g, or t
  misc_feature (375)..(441): n is a, c, g, or t
  misc_feature (443)..(492): n is a, c, g, or t
tccttaaagggccggccattnnnnnnnnnnnnnnnnnnncacttctttaaaaagagtatannnnnnnnnnnnnnnnnnnnnnnnnnnnnnnnnnnnnnnnnnnnnnnnnnnnnnnnnnnncccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnntatatat

SEQ ID NO: 15648 - DNA, 671 bp, Diabrotica virgifera
  misc_feature (458)..(474): n is a, c, g, or t
gaaataagaccaaattttgcagctgcttggatgaacttaggaatagtattaaccaacttaaaccaatcggaagaagctgagcattgttataggatggcaataactcatagaaagaaatatcctgattgctactacaatcttggaaatttgtatttggatctaagacgaaatgaagatgctctaaaatcctgggagatggcagtgttgtaccgaccgactcacgtagccgcttggagtaatacgttggtgttgctagacagtatgacaaagtacgatgaagtgttagaactaggccgcacggcgctcatccataatcccaaagccccggctttgcacttcagttttgcgaatacattgggaaagatacaacagtttgaaaaggcggaaggacattttttggaagccatcaatctcaatccagacaatgggctttattattcaaacttaggagttctctnnnnnnnnnnnnnnnnnaaggagaaagcacgtcagatgtatcaaaaagcccttcaaataaacccgaccctaaaatcggccgaactgaacctcaaaagactaaccactgatgctcaacaagacaaacattaagaaattgtgttactctacaaaaaaaattcacctgaaacactcatgttttgatcttttatgaatatgtaattttattttctgtg

SEQ ID NO: 15649 - DNA, 529 bp, Diabrotica virgifera
ccttctctttatttctccattatataatctatgaatatattaatatgctttaatactcttttaatattatgttttcaataccaagaataatattaatgatttgcattcagacaaggacaaaatctatgattaaattgatatacaaagactcatgatatccattaatgtaatgaccaacccggatgtttacaacacccactggaatattgatactaagtattatactgctcaagtaaaccttttaggaatagaaacaacggaaatcgagaaagatgaagacttccttagtcgcattgaggctctaatcatccacatggattctaacagcaaaactggcctggatgatctaaaaaagtgggagttccttggagatgtatggaatgtagatgttaagttactcttagctaattattgtacagatagtacgaatatgacaaagagtcaagctttagaatgctgcttaaagatggggtcttgagcttatcgagatggcctcccacgaccctacacgccagaccaccgagctcac

SEQ ID NO: 15650 - DNA, 901 bp, Diabrotica virgifera
cattgttggtctctgtattaactccctgccctggcttaaattttagcaccttctttctcttctatggaagaaatatcacttccgaactattatatagtttaatctcggccccaataatgagtatcaacaggtttatcgattctgtagatttcttcgccaacgttgaaatatcccaagtattctacagtgtctggtgttgtatcatagtggtaatgaccagcctcgttgtgatgactaaaactgtggaaatgttgtacacgcaagtcaaggtccccaccatcgctattcaccaaagtaccaacggcaataaggggggctgacatattatagaatttgagccattggtttagcatctcttcgttttctatgggggtctttgagaagtcgcgcattacgtgctgtttcgctttgccttctttaagcaggaacactccaccaagacccactaattccttatattcttccactatggctttccttatcgatgtaatgaagttatcttcacctgtgcgctttttcacgtgcactttaagaacctttccaggttttccttccgatacaaagaaatttgcaagtaaagctactcgagtctcttcttttgggatggatttttgttcgggacttattcgtcatttgccgtcaacttttggataattttagtctccttgccctaattacagtttccactttttaatcaaaaatgtcatagataaccccccccagttgcccccccaatgaagggaatgaaggtccacgttccacggtcccaatggaaaaaatgtgaggaatccgccttttaaccaagctttggcaaataattctttttaattcataataattctttatttcttctttccccctatagcgaaaaaggggaacgggatttgcccaccccaaattt

SEQ ID NO: 15651 - DNA, 551 bp, Diabrotica virgifera
  misc_feature (6)..(90): n is a, c, g, or t
  misc_feature (100)..(149): n is a, c, g, or t
  misc_feature (164)..(216): n is a, c, g, or t
  misc_feature (238)..(252): n is a, c, g, or t
  misc_feature (254)..(266): n is a, c, g, or t
  misc_feature (271)..(308): n is a, c, g, or t
  misc_feature (314)..(336): n is a, c, g, or t
ccgccnnnnnnnnnnnnnnnnnnnnnnnnnnnnnnnnnnnnnnnnnnnnnnnnnnnnnnnnnnnnnnnnnnnnnnnnnnnnnnnnnnnnnatgtaattgnnnnnnnnnnnnnnnnnnnnnnnnnnnnnnnnnnnnnnnnnnnnnnnnnnctagattgaatatcnnnnnnnnnnnnnnnnnnnnnnnnnnnnnnnnnnnnnnnnnnnnnnnnnnnnngtgaagaatatataagaggtgnnnnnnnnnnnnnnngnnnnnnnnnnnnngttgnnnnnnnnnnnnnnnnnnnnnnnnnnnnnnnnnnnnnncctaannnnnnnnnnnnnnnnnnnnnnngagatgggttaggtttagtgtctgattgtagagtaatttactatcaagatatataaaagatttagtgctggtatattaacggatttgatctatccggattggcgatgtactgttattgatagctatagctagaagatcaactcttggtaggagagatcttactatgcaactatccacgtacttcacaagtgattgtatttatctcgttaacttcc

SEQ ID NO: 15652 - DNA, 98 bp, Diabrotica virgifera
  misc_feature (9)..(61): n is a, c, g, or t
  misc_feature (63)..(76): n is a, c, g, or t
  misc_feature (78)..(92): n is a, c, g, or t
cttattaannnnnnnnnnnnnnnnnnnnnnnnnnnnnnnnnnnnnnnnnnnnnnnnnnnnncnnnnnnnnnnnnnncnnnnnnnnnnnnnnngtttaa

SEQ ID NO: 15653 - DNA, 65 bp, Diabrotica virgifera
ttttctgcgtcggaaggtggaataactatctcaactgtaaatccctctactgaagaagtcatctg

SEQ ID NO: 15654 - DNA, 980 bp, Diabrotica virgifera
  misc_feature (7)..(24): n is a, c, g, or t
  misc_feature (638)..(662): n is a, c, g, or t
  misc_feature (744)..(762): n is a, c, g, or t
gttaggnnnnnnnnnnnnnnnnnnctattttgaacaatggagggttaggttactccgaatgtgtacattatttgccaattcgattaaaaatcaatggttaaaaactcaatacattacgattttcgaacaaatagttcaaaatttgttttgtataattgcataaacaaaatacaaacaacgatgcagtcaacgtgttaaaattgtaagaacttgaagctctatgtagtgaatattgggaaacgttgttaacgagaaagttatttgattttcgcttaccaggagtaatctgataaactgttgctttagtatggggtgtttcatttgttaaaatattagcaacaaatgaagctagtttcgttattttcccgtaaggaaattatcctaattagacgtcttataatagaagaatagtgttttattgttacaccctatacaagtatttctctagaattaaatattggatgttttatccctaattgtataatctttataaaacggcataatggtttatggcttatattagttgttatccctttataacatccaccagttcctttttaatttttgggaaggttttttaataatatggtaacttgtaaaaaaatactaataacaccttggtcttgtacagggactgnnnnnnnnnnnnnnnnnnnnnnnnncaaacatatagttgttttttgaaaaacaatggaaaaaccctttaatttttttttgcttgggtctttttctcatatccccccnnnnnnnnnnnnnnnnnnngggccgctctccaaaaggatccccagcttcacgtcccccgcatgccacaccaaaacttcttttaaaatgtgcaccttaaaatcaatttccctggccgcgatttaccacccccgcgatgggaaaaacccggggttcccccacttaatcccctttacaacatttcccccttttctccccctgtggggaaacacaaaaagcccccccacatcccccctccc

SEQ ID NO: 15655 - DNA, 447 bp, Diabrotica virgifera
  misc_feature (104)..(129): n is a, c, g, or t
  misc_feature (137)..(198): n is a, c, g, or t
  misc_feature (200)..(212): n is a, c, g, or t
ttttcccccccagcgggttcagacccccaccgccgtccccgcgccgcctaggagttacatccccagtagtgttccttttattctaagtttattttcgaacagtnnnnnnnnnnnnnnnnnnnnnnnnnnaaaatggnnnnnnnnnnnnnnnnnnnnnnnnnnnnnnnnnnnnnnnnnnnnnnnnnnnnnnnnnnnnnnannnnnnnnnnnnnaatttacaaattgtggtgctatcgacaaacgaaccatcgaaaagctcgaaaacaaaacccaagaaatgggtaaaggttcattcaaatatgcctgggtactcgataaacttaagggcgagagaaaacgtgaaattaccatttgatatttgctttgcggaaattcccaaacagctcattactatgttatccttctttgatggccctggacatcaaaattttcattaaaaatattcac

SEQ ID NO: 15656 - DNA, 526 bp, Diabrotica virgifera
  misc_feature (10)..(28): n is a, c, g, or t
taatgcttgnnnnnnnnnnnnnnnnnnncatattttgtgtagtattaatttaacacattggaaccattatttaaaaatacgtttaaattcgaaatggagtcaagtgaagattttatgaaaaggaaacaaaatgttttaatatctgaccaccatggtgattctctagagaaacctgacaatgtacaaattaaatcagaaccggaagaatgcatgtttgagagtaattacgcagaggattctttaccagactcgtattgttcggacgttattaaaatagaagaacaacatttacaatgtgaaacagatagcccattccccatcattagcaagcaagaaattaagacagaaatcaaaaaagaactggatgacgataatttaggagtaaatcatggctgtgaatctcgatttaaaagtacaaacacgaaagaattggactcagaaaaagatgtaaaattacagataggagcttcaactgagatacatcatgaacaacattgtagaagtacgaaaagatcaaaattattgt

SEQ ID NO: 15657 - DNA, 686 bp, Diabrotica virgifera
  misc_feature (36)..(64): n is a, c, g, or t
  misc_feature (184)..(201): n is a, c, g, or t
  misc_feature (515)..(532): n is a, c, g, or t
  misc_feature (626)..(643): n is a, c, g, or t
aatttcccccccgaggtccgaaccctccgcgtcccnnnnnnnnnnnnnnnnnnnnnnnnnnnnngcgatctagaaactaatattagtgaagcaatggatgttttttaaaaacttatctgccgcgttagcagcagtgtttgttatttataattcgtttacaaattttttaaaaaataccgtagtnnnnnnnnnnnnnnnnnncaagttgccaggtcctccgaaacttccgatttttggggaacttccattgaatttattcttactcctgattctatgcaactaattttaaaaattttcgagaatggaatcgcaaaatattccccacttttatttcagtcgttgtaacttgacttacccgtatcaattgtcccttgacactgatgactttgaaaaatatccgcttttggaatcaaaaccttattacccaaaggaattgattttcccgctctttgctacaacccggggctttgcaaaaaggtcttcctgaccaaattcacggatcccttgtgccaccnnnnnnnnnnnnnnnnnngaccccctgcttttcatttccctatttcaccaggattttcccccaagggtttcaaataaaaaaactgctaagagttgtcccaaaacttccaatnnnnnnnnnnnnnnnnnnccggaacaaaaaccttaattctccataatttttccaaccccct

SEQ ID NO: 15658 - DNA, 164 bp, Diabrotica virgifera
atttatccttatcttcgaatcccatttggcggtccatttgcattaaatcctttaccattcagggtacaagttcctgagggcaaaaccacccaagttttcaccccggggaactctgatgtaaccttgtttccccccccctagttcccccatgcctcccccccccc

SEQ ID NO: 15659 - DNA, 245 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattaacaat

SEQ ID NO: 15660 - DNA, 433 bp, Diabrotica virgifera
cagatatttacattagtttatggatcttttgccattaaatgacatggtcgaaaataacgaagaaagtagaaatataaacgaacttactattccagttgcatggggacatatagcagttaaagcctggggagaaccacatcacaaacatgtccttatgttccacggaataggagataatgcaggtagtttcgacaacttgctagcactcttaccaaaaaacttctactatatctgtacagatttcccaagccatggcaagtcatctcatcttccgctgaccatacccgataaatgctaatggttatattttaatttgtaagatgataatgggttattttaatcaacacaaatactttttcatcggccataatctggggagtctgcgtggggtactggtctggcaaaacataaccctgaaacgctccaacaaatt

SEQ ID NO: 15661 - DNA, 515 bp, Diabrotica virgifera
  misc_feature (203)..(256): n is a, c, g, or t
  misc_feature (390)..(409): n is a, c, g, or t
  misc_feature (413)..(413): n is a, c, g, or t
gatgagcggacataaatacgcattacttcaaaatataatgcaaggaaaaatagaaggaaaacggaatccaggccgtagaagaatgtcatggttgcggaatttgagagagtggtttggctgcaccactaatgaactttttaggtcagctgtaaacaaggtcaggatagccttgatgatttccaatctccgataggagtggcacnnnnnnnnnnnnnnnnnnnnnnnnnnnnnnnnnnnnnnnnnnnnnnnnnnnnnntttagcacatatctatttaaattttgaaatgtatacataaatgagcattgagatttagtagagaggttgaggattaaacttctgaaagaagtataaaaaattgtaattggagtccctatttgttttaatatcgnnnnnnnnnnnnnnnnnnnnaatntcttaagaatgagttttgcttaaaacgagaaagatttgaaacgacacatttaaaatcttgtttgatatttttactatagaaattttttacagcaatgcccat

SEQ ID NO: 15662 - DNA, 191 bp, Diabrotica virgifera
  misc_feature (2)..(29): n is a, c, g, or t
  misc_feature (31)..(122): n is a, c, g, or t
  misc_feature (138)..(157): n is a, c, g, or t
cnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaataaaactctatcnnnnnnnnnnnnnnnnnnnngaattcaggaccaaacttcctccactttcaaaat

SEQ ID NO: 15663 - DNA, 266 bp, Diabrotica virgifera
  misc_feature (67)..(84): n is a, c, g, or t
catttcttgatgagccgcggcctcatgaccgacatcgaccttcacacccgatattgatagtgcccgnnnnnnnnnnnnnnnnnngggactgtttttgatatttatcccgatatcccctgactcccaataaaggcccatatactatattgaaagacatctgccatacctataattcttctaacatatatttactaggttcaaaactatgtggagtgcccacatgacactacaaaactagctaccccactgacttaaaattatttaca

SEQ ID NO: 15664 - DNA, 164 bp, Diabrotica virgifera
  misc_feature (2)..(35): n is a, c, g, or t
annnnnnnnnnnnnnnnnnnnnnnnnnnnnnnnnnattttttattcgaaagctggcattgaaggggtgggatgacaaaaaaactggcccttatttcattttaataagaaaatctgttttttaagacaaaaagccttaattttttttcaaagcacaagaagaccc

SEQ ID NO: 15665 - DNA, 679 bp, Diabrotica virgifera
  misc_feature (188)..(212): n is a, c, g, or t
  misc_feature (224)..(286): n is a, c, g, or t
ccctaagggataacagcggaatttttatttgaagagttcaaaccaatataaagaattgcgacctcgatggtgggattaaaagtttaaaatgggtggaacaagctataattattaaagtctgttccactttttaaaattttacttggatctgagtttaaacccggggtgaagccaggtgggtttctatnnnnnnnnnnnnnnnnnnnnnnnnngacaaaaggccnnnnnnnnnnnnnnnnnnnnnnnnnnnnnnnnnnnnnnnnnnnnnnnnnnnnnnnnnnnnnnnccttctaaaaggtccaagctttactaccgcgggcttgcgacgtctaagctttttttatagtgggccccaaaattcaatttcctggccccgcgtttttaacactccggggactggaaaaaccccgggggttaccccaccttttatcgccttgacaacacctcccccctttttcccacctttggggaaaaaagcaaaaaagggcccccccccaactcccccttccccccacaatttgtcgccccccttcaatggggacaatggggcaccccccccctgcacaccgccccccattttaactcgcggccggcggttggggggggttgaaagtgcgcaaacggcgacccccccatcaaattttctcccaggtgcccccaataaccgcccccttctccc

SEQ ID NO: 15666 - DNA, 939 bp, Diabrotica virgifera
  misc_feature (179)..(212): n is a, c, g, or t
  misc_feature (378)..(406): n is a, c, g, or t
  misc_feature (762)..(787): n is a, c, g, or t
  misc_feature (824)..(841): n is a, c, g, or t
tttgtgaatcgcggagtaatttacaaaagagaaggcgaacagttgttgaacgtttctcactacgctcaagcgtgctggcgcgaaaccgcagcggtagggatattcaacacgctgtatctttggtaattttactctgatcaatctgaaattttcggagagtattcttgaagttatgcacnnnnnnnnnnnnnnnnnnnnnnnnnnnnnnnnnncaaaccatacccccgctttattcactaggttcaaaatcaaaaatccggacacctgatagtcgtgatacaagggtcttagattcagtatttttcaatgcaattcaatatacagtagagcgtcgataacccgaaccctagtaatccgaactatcgctaatccgaacgnnnnnnnnnnnnnnnnnnnnnnnnnnnnnatcgcggaccgaatttttggatttaatatgacaatatgggcaaaatatgaccgcggattttgttttgtttatgcagaaatacatacaatatatttgtttattatgcaggtgttttattccttgtaactaaaacgtatgtacatgtactatatttatgagctttgtatgtattttgaacatatgttcgataatccgaacaatttgataatctgaactacccctgtaccaattagttcggattatcgacgctctactgtagtaagattttaatatttttttcaatgattgccgttatattatcatgtgatacacaatcattaagagccagataaattgtttatggtgagtttatgagnnnnnnnnnnnnnnnnnnnnnnnnnnacattgtaaacactcaacttgtactttgatttacttnnnnnnnnnnnnnnnnnngctaatcttaaaaaaatatcactacacttgtgtaataggcctacatgattgtagaccaagactggtaatttgtaatatacgaaatttatacgcctttg

SEQ ID NO: 15667 - DNA, 680 bp, Diabrotica virgifera
  misc_feature (188)..(205): n is a, c, g, or t
  misc_feature (268)..(285): n is a, c, g, or t
aataaagggtataataccttaatattataggactataccttcgtcaatggactggcttatcaacagatcaattgttacatgccgcacgagatcgacaacgatatcgagcaaattgttatggaagctacccacgcctaaaaatttgggcacggtacttaaagaaccaagaagaagatacctatattggnnnnnnnnnnnnnnnnnnccatgtcagaaattttatttagaaaattagttcatattaaatggtaaatacttttatttaggnnnnnnnnnnnnnnnnnngatggccataaataaaaaaccagaaataaatttaattatgtgctaaaaaggaacttacctgtcaggattttggcctgccgggattctggcgtgacggtattttggccatcgagattttggctgtcgtgattttggggtagacccatttaaagaatgattttcatgtttacttcatccaaacatttttttgttagctattgatgtatcaaaagttgtttttatatatttctatatgaatccgtcttgtagttgtgaataaattgcgaaataaatcattataaatgctctgagtgggtttgtgatatttttttcacaataatgttccagcgtgcatatgtaaaatttgttataatgctacaaaataaatgtttatactgaaaaaacaaaaataagga

SEQ ID NO: 15668 - DNA, 735 bp, Diabrotica virgifera
aaaactattcctttattctgaatgtcaaacacacataactgaatgagttacacaataatatttgcaccaaggcacctcaaaactaaacataatttaaaataatagtaaaaaaagatcttaatgttctaatttagaagtacaatctggcgtcgatcatccttccatcaattctagctttatcaagatttttgatagctttttcagcttgccaatctgatgcgtaagtcaatagcactgagccttgtccttttgtttcaaatccttgaacatcgccaaattcttgacatttttcattcagcaggttgtaactcaatgtagagggcagatttgagattaaaacttttttttggagaaagttttgtttgtattatcaacaaatgatagcctgtcgctggtgtatgtggaaatgttgccggaattttggaaacctcttcccgatagactatttgaactgttatatccatcgttatttccataatttccgcctccaccaaagctatttcctcctccactttggtaatcatcacctccaccgccacctctgtgataggaatttccagatcccaagttcgacgactgcgagttatagttggaagtctgtgagttgagatcgttagatcccaagttgtttcccaatagactgccaaggttggcagactgcagagcattaagagcgctcaaacctgtacaactactcaattgttgcaaagtattattcggaaatgctcccaaagt

SEQ ID NO: 15669 - DNA, 873 bp, Diabrotica virgifera
  misc_feature (158)..(188): n is a, c, g, or t
cagcagaggacgaagaagtaccagcagaagcaacaggagtaccagccgaggccgtagaagtacgagtcgaagtcgccgaagtactagccgtagtcgtagaagtaccagcaggtctaaaagaagtaggtcgaaagagagacgacgatcgaaagagcgcnnnnnnnnnnnnnnnnnnnnnnnnnnnnnnngagatagaaagcgtagatcctcgtctaaagacagaaaaagtcggtcgagggatcgcagggaccgtagtaaatctaaggacagaagaagtagatctagagatagacgtagcagatcgagagatagaaagaagcgcgagcgtcgtgaaagaagtcgcactcctaaagaaagaaaaccgagcccaaaaagacgtacaccttcacctacaccattcggcaaaccaccattcctgaagagacctcgttctcccctcggcatccgaggaacatcacctttagaagaactaagcgctgaagagagagatgccaggacagtattcattatgcagttatctcagaggatacgtgccagggacctggaggatttcttcagttcagtaggaaaagtacgagatgttagaatgattgtttgcaataagacgcgaaggttcaaaggaattgcttatatagaatttaaggatccagaaagtgtagcattagctctgggcttgtctggtcagaaacttcttggtattcctataatagttcaacacacccaagcagaaaagaaccgaatgggcaattcgatgcccaatatgctgcccaaagggatgattgggtccatgagactgtatgtaggatctttacatttttacattaccgaagaaatgttgagagggaatcttcgaaccgtttgggcaaatcgaca

SEQ ID NO: 15670 - DNA, 799 bp, Diabrotica virgifera
  misc_feature (2)..(745): n is a, c, g, or t
  misc_feature (749)..(798): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttnnnnnnnnnnnnnnnnnnnnnnnnnnnnnnnnnnnnnnnnnnnnnnnnnng

SEQ ID NO: 15671 - DNA, 784 bp, Diabrotica virgifera
  misc_feature (3)..(16): n is a, c, g, or t
  misc_feature (21)..(585): n is a, c, g, or t
  misc_feature (592)..(629): n is a, c, g, or t
  misc_feature (649)..(662): n is a, c, g, or t
  misc_feature (665)..(687): n is a, c, g, or t
  misc_feature (695)..(717): n is a, c, g, or t
  misc_feature (747)..(778): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaacggtgtgagccaggttggttnnnnnnnnnnnnnnnnnnnnnnnnnnnnnnnngaaagg

SEQ ID NO: 15672 - DNA, 133 bp, Diabrotica virgifera
  misc_feature (3)..(100): n is a, c, g, or t
  misc_feature (102)..(122): n is a, c, g, or t
  misc_feature (130)..(130): n is a, c, g, or t
ctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnncaatgaanggg

SEQ ID NO: 15673 - DNA, 921 bp, Diabrotica virgifera
  misc_feature (172)..(189): n is a, c, g, or t
  misc_feature (503)..(520): n is a, c, g, or t
  misc_feature (827)..(827): n is a, c, g, or t
  misc_feature (846)..(846): n is a, c, g, or t
  misc_feature (873)..(873): n is a, c, g, or t
tccaagccaccatctagcatcctgcagtgcggcatcggctttacatctatgataaataagagtttcctgtttgctctatcttgtgttatttgagtcatcttatatcattatatgagtgtcttattcaaatattttaagtaactgggatctccaatgtattcaaaatgtaccnnnnnnnnnnnnnnnnnncctagttcatctggtggtgccaaaaattccagacttttgtcagaaattgaaacattgaatgtaacgtattttcaattaagttgtggtttatattcctattaaatgcattactgaattcttctgtagctatattttccgtcactaacatatcatctgcatacctcaatgacaaagcttttctccatttacattgatacttttgttcgtaagataaaagctaccatatctggtattccagacatactgcatgctacgctgataattcttgttgtcgctctcttactccaaaactaggtgtggtgttttgatgtggnnnnnnnnnnnnnnnnnnactgatcatcaattcagcattctgtcaaactttctaatattttttgttggtttattgtgtcgaagatcttttcataatccacaaataaattacatgcctatttttctacatacatgcaatacacaaccaaccacagaaatggcactggagtaccaatggagttgaaaaaaggaggtatcaattattctaaggaggtgtcctgagaccaggaagggtcttgataccatcacaatagttatacccatatctgcttcgtatcaaggaggtatcacaataatacatcatacaaatttatgttttgaggtanaaccagcttagtatcattncaatgatactgatttgaactatacttntgtccccgtggtgttgtgcggaaacaatttaaatgaattaaaataaat

SEQ ID NO: 15674 - DNA, 916 bp, Diabrotica virgifera
  misc_feature (101)..(144): n is a, c, g, or t
  misc_feature (870)..(870): n is a, c, g, or t
ctgtcgggatgtaagagctatgattgaaaggcaggcgtctagacattgcgatcggcaggcagaatagcaggaaagcaagacaaatcctaaagatcaagcgnnnnnnnnnnnnnnnnnnnnnnnnnnnnnnnnnnnnnnnnnnnnaaggagatcgcagtgatcgcacccgtatcggctaatagacacagacacagacacggtgtgttcggtatttttagttagtctgttcgcgaccggcgaagaagtagcgcgtgtgtttaaatagagagttatggtgataacgtcaacgtgtgttgtgacggtgtttaagatcaacggtcggcaccggagtcgacaacgccagtgagcaagcagtgcgacactatgtcccagtcatggtgaaaacgtttctgggactgttagctgcttcaatttgtggtctcgtatacgctgctccattagctgactcttgcaataatctgaccccttttcgaacagatagcacaacccctacttcttcagaagagtcattgctagaggatccagcagcacgcaacgaaagaagcacaaatctctctcacgtcactggtaccgccagaaaaatacaaatgttcatcaagaatcgacatttacaaattcttcctgacgggacagtcaacggaaccactgacgacactagtgcttattcgatattacaaaggacgacggtgggaattggtcaaatgaaaattcaaggtgtggttacctgtcagtatttgtgcatggccaggtgtggattgctctatggatcgagagaatttggacaagaatgcgtattcaatgagaccatcgagcaatccaactacaacacgtattcctcccagtaatactcaaacgagaaaagaacccttnatctagcactgaatcaaagaggccaatcgagaaaggtcgtcctacg

SEQ ID NO: 15675 - DNA, 93 bp, Diabrotica virgifera
  misc_feature (4)..(81): n is a, c, g, or t
  misc_feature (83)..(84): n is a, c, g, or t
  misc_feature (92)..(92): n is a, c, g, or t
attnnnnnnnnnnnnnnnnnnnnnnnnnnnnnnnnnnnnnnnnnnnnnnnnnnnnnnnnnnnnnnnnnnnnnnnnnnnnnntnnaattattna

SEQ ID NO: 15676 - DNA, 156 bp, Diabrotica virgifera
  misc_feature (2)..(2): n is a, c, g, or t
  misc_feature (114)..(114): n is a, c, g, or t
  misc_feature (136)..(136): n is a, c, g, or t
  misc_feature (144)..(144): n is a, c, g, or t
cntggatgacaaaaaaactgtctttacttactcactaagaatttattttttcagtaaaagctcacattttttaaagacgagaagacctatagagtttataaaatattatacgtnttttagtataaattcattatantataattnatttatttgcgt

SEQ ID NO: 15677 - DNA, 955 bp, Diabrotica virgifera
  misc_feature (777)..(803): n is a, c, g, or t
  misc_feature (916)..(916): n is a, c, g, or t
agaatgggaaggttgtgtgctgtaccacattgttacacaggatataaaagaaaatcaacggagaaaatatctttatataaagtgccagatgatgattttttcttgacaaaatggcaggaagctatagccagagaagacagaccaataacacctaaagattatgtctgtgagaagcactttacagaagatgatattattcgcaaaagaataagaaaagacgttgtagaagaatatcaaagaccaaaacttcgacaagatgccatcccttctatttttccagaacttcctgaatttatattaaagatgacgaaaaaacgtagaaaaatagtggaaggtgcaactactacaaacaacacaaatgccacttccatgaataaaataaatgaagaaaacgaagacataaaacctgatattaaaattgaacctgaggctgtaaatgaatttgaaagaacaaatacatttgaagcagagattaatactgatgaaattgagataaaagaagaaattgattgtgaacctacgaacgaatccgaagaaatagaggagatggattctagtggaattaagttgtatcaatgtgacacgtgcaactataggacaaaattttcacacaatttgaggacccataagataaaacatctatcaggggaagacgcctatatgacatgtgaatattgttcttttaaatcaaaatgggaaactacttatataaatcatatgaaaactaagcatggagtcattttaaaagaactgtttaaatgtcctttttgtaagttnnnnnnnnnnnnnnnnnnnnnnnnnnntaagcattgcgagaaacagcatgaggatcaagacaaacttatagtaacttgatatacgattcgcagcaaaccaaatcacagccttcaatgaaacgtcatgtcttcacacatgntatttctgaatcccaacaagaatctgatgtaaatgatgc

SEQ ID NO: 15678 - DNA, 859 bp, Diabrotica virgifera
  misc_feature (831)..(831): n is a, c, g, or t
ttttgatttctggaaggattagaaggtgctgattgctgctatttattcgcatctagcgtgttatctcctgctgataagttttactatcgtcggtttttctctagctaggtagcaacgcagcacagtccaatcgctcctcataagttttactatcgtcggtttttctctagctaggtagcaacgcagcacagtccaatcgctcctcataaattcaattattaagtgcaatggaaaacggaaaactacaatcaaaaagcgccgaattatgtctctcactatacagagactccttgaaatcaaaagatatggaccatgatgggactcactttgatggtcaataccctcacgttttcgtaatactaggggcttccggagatttagcaaaaaagaaaatctatcctacattatggtggttgtatagagacaatgtcctaccagtcaatacaatattttatggttatgccagaagtaaaattactctgagtgaagtcagacagaaatgttcaccatggatggatgtgaaacccgaggaaaaagaaaagtatgaagatttctggaaacttaatcattatatgtctggacagtatacatccaggactgattttgaactattgaacaaggaggtagaaaaatttgaaaagggaccagttgcaaacagattgttttatttggcattgccaccctcagtatacgaagatgtcacagtgcatataaaaaacaactgtatgggacaaaaaggatggacacgtattatcattgagaaaccattcgggcgtgatctggaaacatctaaacagctctcctcacatttgagtcaattattcacagaancacaattatacagaatagaccactattt

SEQ ID NO: 15679 - DNA, 734 bp, Diabrotica virgifera
  misc_feature (25)..(162): n is a, c, g, or t
  misc_feature (215)..(234): n is a, c, g, or t
  misc_feature (237)..(269): n is a, c, g, or t
  misc_feature (282)..(294): n is a, c, g, or t
  misc_feature (296)..(331): n is a, c, g, or t
  misc_feature (363)..(381): n is a, c, g, or t
  misc_feature (429)..(451): n is a, c, g, or t
  misc_feature (465)..(482): n is a, c, g, or t
  misc_feature (514)..(553): n is a, c, g, or t
  misc_feature (670)..(690): n is a, c, g, or t
ttttgagaataaaatgtggataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaaaggggccgggggcccaaaaaagttttggagggtttaaaccccccccnnnnnnnnnnnnnnnnnnnnttnnnnnnnnnnnnnnnnnnnnnnnnnnnnnnnnngcccccaaaggtnnnnnnnnnnnnncnnnnnnnnnnnnnnnnnnnnnnnnnnnnnnnnnnnncccccccccaaagggaaagcccaaaaatttgnnnnnnnnnnnnnnnnnnnggcgggggaaaaggcaaaaaaaaaaggaattttcccggggggtttttnnnnnnnnnnnnnnnnnnnnnnnggggggaatttttnnnnnnnnnnnnnnnnnnaaaagggaaatttgcccttcccccgtttaccnnnnnnnnnnnnnnnnnnnnnnnnnnnnnnnnnnnnnnnncccaaacggggcccaaaggaattccttttttgggggcccctggggggcggacccttaaaaaccccggccccaaatttaaaggcaatggccccctccaattggaaattggcccctttnnnnnnnnnnnnnnnnnnnnnttcaaattgggaaattttttgtttttcccgggggggaaaaattt

SEQ ID NO: 15680 - DNA, 77 bp, Diabrotica virgifera
  misc_feature (2)..(16): n is a, c, g, or t
  misc_feature (18)..(31): n is a, c, g, or t
cnnnnnnnnnnnnnnnannnnnnnnnnnnnncctttaaggaataacacagcgtaattttaatttggaaaagtttcaa

SEQ ID NO: 15681 - DNA, 786 bp, Diabrotica virgifera
  misc_feature (2)..(549): n is a, c, g, or t
  misc_feature (556)..(593): n is a, c, g, or t
  misc_feature (613)..(626): n is a, c, g, or t
  misc_feature (629)..(651): n is a, c, g, or t
  misc_feature (659)..(681): n is a, c, g, or t
  misc_feature (713)..(739): n is a, c, g, or t
  misc_feature (752)..(784): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttgggttcnnnnnnnnnnnnnnnnnnnnnnnnnnngacgaaaggcccnnnnnnnnnnnnnnnnnnnnnnnnnnnnnnnnntc

SEQ ID NO: 15682 - DNA, 83 bp, Diabrotica virgifera
aatttgtccttcaactgacactttttccttatctgcctctgaggtacttttaaccggtagtgtacaaaaaacatattcttgca

SEQ ID NO: 15683 - DNA, 762 bp, Diabrotica virgifera
  misc_feature (2)..(63): n is a, c, g, or t
  misc_feature (65)..(89): n is a, c, g, or t
  misc_feature (91)..(103): n is a, c, g, or t
  misc_feature (118)..(167): n is a, c, g, or t
  misc_feature (170)..(191): n is a, c, g, or t
  misc_feature (200)..(225): n is a, c, g, or t
  misc_feature (272)..(292): n is a, c, g, or t
  misc_feature (304)..(321): n is a, c, g, or t
  misc_feature (328)..(348): n is a, c, g, or t
  misc_feature (350)..(379): n is a, c, g, or t
  misc_feature (424)..(444): n is a, c, g, or t
  misc_feature (447)..(489): n is a, c, g, or t
  misc_feature (530)..(554): n is a, c, g, or t
  misc_feature (569)..(615): n is a, c, g, or t
  misc_feature (617)..(666): n is a, c, g, or t
  misc_feature (668)..(724): n is a, c, g, or t
  misc_feature (741)..(758): n is a, c, g, or t
cnnnnnnnnnnnnnnnnnnnnnnnnnnnnnnnnnnnnnnnnnnnnnnnnnnnnnnnnnnnnnncnnnnnnnnnnnnnnnnnnnnnnnnncnnnnnnnnnnnnncaccttgtgtatccnnnnnnnnnnnnnnnnnnnnnnnnnnnnnnnnnnnnnnnnnnnnnnnnnnctnnnnnnnnnnnnnnnnnnnnnnaaaataacnnnnnnnnnnnnnnnnnnnnnnnnnncatgctattcgtttctaaatatatctaacttctcaacaaacaaattnnnnnnnnnnnnnnnnnnnnncttcataattcnnnnnnnnnnnnnnnnnnctattcnnnnnnnnnnnnnnnnnnnnncnnnnnnnnnnnnnnnnnnnnnnnnnnnnnnccatagaaaattaggattcaaaattttcactattctacaatatgnnnnnnnnnnnnnnnnnnnnncannnnnnnnnnnnnnnnnnnnnnnnnnnnnnnnnnnnnnnnnnncattatttaaatctacccctgctgataatatcactattagnnnnnnnnnnnnnnnnnnnnnnnnnctcgcatcaatatcnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnncgacggttggatgaacnnnnnnnnnnnnnnnnnncatg

SEQ ID NO: 15684 - DNA, 861 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(783): n is a, c, g, or t
  misc_feature (786)..(786): n is a, c, g, or t
  misc_feature (801)..(851): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnganaaatttttaatcccnnnnnnnnnnnnnnnnnnnnnnnnnnnnnnnnnnnnnnnnnnnnnnnnnnncctcatcccc

SEQ ID NO: 15685 - DNA, 826 bp, Diabrotica virgifera
  misc_feature (112)..(138): n is a, c, g, or t
  misc_feature (663)..(684): n is a, c, g, or t
atttcactcaagagtaaagtagctttatttttcgcaatattgaaaattgctattacgaaaagttgtttggtattacaaaatatattctagtatgcaattatatccttctaannnnnnnnnnnnnnnnnnnnnnnnnnnaaggataactaacattattttaaggcatttcaattcagataacccttttattgttaattttacgaaaaggggtggttcttgataaaaagttctgcatggtctagaacctagagtacagccatattatgtcaaattttatcaattttgtacgaggtgtgtcaaaaaatgtgaatttcgctcgagagtaaagtacgtttatttttcacaatatcaaaaactgttattacgaaaagttatttagaattaaaaactatgtttcagtatgtaattacatccttttatttgaaatattctgaactgtaaaggtactttgcttttgatctaaatttattttttttgacatacctcgtataaagaatttcatataagatggttgtattttatattttggactatccacaactttttattgaaaatagctttttttcttaaaattagtgataaaagagttatcagagttatccatatggatgcaacttacagggacatactgtataatctaaatgttaaattctgttagttttnnnnnnnnnnnnnnnnnnnnnntaagattatcattataggcctggattccgcgtgccaaaaagaaggtttgttaatggcacgctgaaagtttgttggtggtttgacgatgtctggtcggacaaactttgatgtgtgggagcactggaacggggaagttttaatt

SEQ ID NO: 15686 - DNA, 908 bp, Diabrotica virgifera
gaaaaagtgtttatgaataaaagtattaagtaattgaaataagaaattaattaagtaataaataatgaaattggtttaggattatggaatctaatgcagagtttgtaaacgttgctattaggattaaacctaacaaatcgaatagcgaaagtcaatgtttatgtattataagccaagagccaccagttttgttattggtagatcgctcccaaacatttacatttgataatatattttctgaggatgtctcccaagagacagtttacaacaaaacagtgaaacccttagttcattatgttaagaaaggctataatagcactgctttgcctatgggcaaactggaaccgggaaaacttataccatgggaacagaacctaatgtaacagaccaaaaaaatgtcggtcttattttaagaacattaaaccagttttttgaatataacgatgacgacgattctgaagttgaaatccttttatcttttatcgaaatatacaaggaaaaagcttttgatctgttacaaaatgacactaatcctcttaaagtcaaaggggtaaaagtagaaggatttaacaaagagaaagtttatagccttaatgaagcaatacattttttaaaaatgggcaacaagaatagacatactcgggggaccaaccaaaattcacaaagttcaagatctcacgcaatatttacgatttattgcaatacaaaacataagaaggatagtcctcacacgtcacacaccaaaggcgttttacatactataaattatggaagtagtagagaaatttggaaagtacaatctgtaggaccaaaaacagcacaacatatttcccttttcagggatatcaaagggtaaattaagcacgctttccgatctaaagcaaaattcctgggatggggaccgaaaa

SEQ ID NO: 15687 - DNA, 91 bp, Diabrotica virgifera
  misc_feature (9)..(90): n is a, c, g, or t
cgagagacnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 15688 - DNA, 678 bp, Diabrotica virgifera
  misc_feature (2)..(578): n is a, c, g, or t
  misc_feature (593)..(647): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatttttttaacnnnnnnnnnnnnnnnnnnnnnnnnnnnnnnnnnnnnnnnnnnnnnnnnnnnnnnncaattcattatatcataaactccatttactc

SEQ ID NO: 15689 - DNA, 924 bp, Diabrotica virgifera
  misc_feature (12)..(51): n is a, c, g, or t
  misc_feature (152)..(175): n is a, c, g, or t
  misc_feature (389)..(412): n is a, c, g, or t
  misc_feature (425)..(442): n is a, c, g, or t
  misc_feature (476)..(498): n is a, c, g, or t
  misc_feature (724)..(744): n is a, c, g, or t
  misc_feature (823)..(842): n is a, c, g, or t
  misc_feature (881)..(881): n is a, c, g, or t
gattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctatttatgtgttgcannnnnnnnnnnnnnnnnnnntataggagctgtatttgctattatagcgggatttatccnaatgatttctttatttacaggtataactttaataatttttatt

SEQ ID NO: 15690 - DNA, 896 bp, Diabrotica virgifera
  misc_feature (113)..(136): n is a, c, g, or t
  misc_feature (352)..(375): n is a, c, g, or t
  misc_feature (388)..(405): n is a, c, g, or t
  misc_feature (439)..(461): n is a, c, g, or t
  misc_feature (687)..(707): n is a, c, g, or t
  misc_feature (786)..(805): n is a, c, g, or t
  misc_feature (834)..(834): n is a, c, g, or t
  misc_feature (872)..(895): n is a, c, g, or t
tacagaagaggtcagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgngatttatccaatgatttcctttatttacaggtataaannnnnnnnnnnnnnnnnnnnnnnnc

SEQ ID NO: 15691 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15692 - DNA, 232 bp, Diabrotica virgifera
  misc_feature (4)..(55): n is a, c, g, or t
  misc_feature (61)..(61): n is a, c, g, or t
  misc_feature (69)..(70): n is a, c, g, or t
  misc_feature (81)..(121): n is a, c, g, or t
  misc_feature (123)..(154): n is a, c, g, or t
  misc_feature (168)..(210): n is a, c, g, or t
gggnnnnnnnnnnnnnnnnnnnnnnnnnnnnnnnnnnnnnnnnnnnnnnnnnnnngttaanaagcttannatttttttacnnnnnnnnnnnnnnnnnnnnnnnnnnnnnnnnnnnnnnnnngnnnnnnnnnnnnnnnnnnnnnnnnnnnnnnnncatttattgcggtnnnnnnnnnnnnnnnnnnnnnnnnnnnnnnnnnnnnnnnnnnnctttttgatccatttttttgat

SEQ ID NO: 15693 - DNA, 459 bp, Diabrotica virgifera
attgtacctcgacgtgtaagcacgacaatcgctgctctgtttattaatagcggtgaaatacgagtttaccagtgtgagtgatagcaataattataacttagttggattgttgctgatatcaattggatataccattaaggctatctacaccgattttgacgctttccttagcagccatagctacaaagcatccgacttagctatagctgttgggttcatcattctagtggttgctttgtttggttgtgcaggagcaattaaagaaagtgttctactggttaatctatacgctttactacttcttgtaatagttatcctggaattgaccgtaagtatcattgcttacaaatccaggagtcacttggaagaaacactttctcaggatatgcgtacaaagatctagctatttatagaattgattgagctggtatttcttcatatttaggggaatgtgatttt

SEQ ID NO: 15694 - DNA, 95 bp, Diabrotica virgifera
  misc_feature (6)..(28): n is a, c, g, or t
  misc_feature (36)..(36): n is a, c, g, or t
  misc_feature (39)..(93): n is a, c, g, or t
ttttannnnnnnnnnnnnnnnnnnnnnngtttatanaannnnnnnnnnnnnnnnnnnnnnnnnnnnnnnnnnnnnnnnnnnnnnnnnnnnnnngg

SEQ ID NO: 15695 - DNA, 902 bp, Diabrotica virgifera
  misc_feature (2)..(31): n is a, c, g, or t
  misc_feature (39)..(687): n is a, c, g, or t
  misc_feature (694)..(731): n is a, c, g, or t
  misc_feature (751)..(764): n is a, c, g, or t
  misc_feature (767)..(789): n is a, c, g, or t
  misc_feature (797)..(819): n is a, c, g, or t
  misc_feature (849)..(880): n is a, c, g, or t
tnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtggttnnnnnnnnnnnnnnnnnnnnnnnnnnnnnnnngaaaggaccaaatatataaaat

SEQ ID NO: 15696 - DNA, 920 bp, Diabrotica virgifera
  misc_feature (166)..(187): n is a, c, g, or t
  misc_feature (842)..(842): n is a, c, g, or t
gaatagataataacacccattactttacccgtgagtaatggttcattactcacaggttgaagttagattcaagtggtgcatgtcacttttaatatacctattagcaaataaaattacttaaacttgtttatttagtaaaatagtcattgtaatatatatcaacaannnnnnnnnnnnnnnnnnnnnnggatttttaactgtaacaatgggttagtatattttttacgtttaaatttcaatatttgacattttaagattgacgttattcaaaggtaaatataaacaatcgctattaattccgtaaaagggcttacggatatgaaatttatatcaatgaattctgttttacttattgttgattgtacaataaatttttattgagagtacacgttccttttcgtgtaattgccttaaaatatgaattatttttaaaagccactcactgtttcattgtttcgtaagctcaaagagggcaattctaacagtgttgccatagttatataaaatatgttttcttatgaaaaataaagtctttcgattttgaataatgttagtagtttagaattatattttctactaacccaaatataaaaaggtcgtaggaaaagtatagtattctacttgcatgtaaatggctattactcactctgatgaataaccacactcgcctacggctcgtgtcgcaaacttcatcatcgtgagtaatagccatcattacatgctcgttgaatagtatactaattgtaatttaaaaatagtagacattttacaagacagtttgatttcattatcacttatccgtattttctttgctttgatggtcctcgtttatgctataattntgtgccaagctcatttttatcattaaatcatttgtagaaggatttttgattaactgattcctttatatttctccagaa

SEQ ID NO: 15697 - DNA, 839 bp, Diabrotica virgifera
  misc_feature (2)..(275): n is a, c, g, or t
  misc_feature (286)..(347): n is a, c, g, or t
  misc_feature (349)..(495): n is a, c, g, or t
  misc_feature (497)..(556): n is a, c, g, or t
  misc_feature (599)..(616): n is a, c, g, or t
  misc_feature (634)..(657): n is a, c, g, or t
  misc_feature (685)..(719): n is a, c, g, or t
  misc_feature (721)..(748): n is a, c, g, or t
  misc_feature (752)..(816): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtattatcnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnngttattaaaggagttctgcaacatttttttctcctgtgtatannnnnnnnnnnnnnnnnngttatatataaaagtcgnnnnnnnnnnnnnnnnnnnnnnnngtgggcgcggaattttgaccgcgctacnnnnnnnnnnnnnnnnnnnnnnnnnnnnnnnnnnncnnnnnnnnnnnnnnnnnnnnnnnnnnnnccgnnnnnnnnnnnnnnnnnnnnnnnnnnnnnnnnnnnnnnnnnnnnnnnnnnnnnnnnnnnnnnnnnacaagaccccaacaaagttttct

SEQ ID NO: 15698 - DNA, 956 bp, Diabrotica virgifera
  misc_feature (208)..(230): n is a, c, g, or t
  misc_feature (374)..(411): n is a, c, g, or t
  misc_feature (744)..(744): n is a, c, g, or t
  misc_feature (786)..(786): n is a, c, g, or t
  misc_feature (822)..(822): n is a, c, g, or t
  misc_feature (856)..(856): n is a, c, g, or t
  misc_feature (883)..(883): n is a, c, g, or t
  misc_feature (900)..(923): n is a, c, g, or t
gttgtctcagtggttgggtgtaatttgttacaatggggttttttgagtttgggagagatgagagatttcccactcaatatgatgcaaaacgaactgccgttactgtggatttggtagatgctgggcttgctactgcctgcattatcttaggaatctcgtttttcatttctctgctaacaaggaagcttaaaacgaatgtgattgtttnnnnnnnnnnnnnnnnnnnnnnnttgataggaacactactactaataaacaatttcggacaagaatgggaagtaggcgaaataaagtcggtaatggcttataaagcaggaagtaaacatgaaatcaacgggacggtatcattaaaaatagctttgagaggaattaannnnnnnnnnnnnnnnnnnnnnnnnnnnnnnnnnnnnntgaaaaatgaaacaatagattataacgaaagattcgaatggatatgggatcagggaagatttggatttggaccatacgccggtttattgcaacgagagttcagagaggcccaatacagaggagcaccactacctatcatttgggttgtagattattttgtaatagatggagaaggtcaacgttttggacgattttatagaacggcaggatggtatacgcaccaattgatgtggacagcttttccttgttggatcttatccacgattttgttcagatcagtcattcgatatggagcatatttccttggattatgcggtggcttgcagttgttgngaaaccttatttatttagttgtacgtaatcctttcccggttngtataccgtttgaagaagaaaccttaactacacatntttgggtttaattattggtgtacctttgttctangtttaattttgtgtatcttggcctgcngtatagtgtatatggannnnnnnnnnnnnnnnnnnnnnnncagctcctttggcggtaatcttctcaacagtta

SEQ ID NO: 15699 - DNA, 127 bp, Diabrotica virgifera
  misc_feature (6)..(126): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 15700 - DNA, 401 bp, Diabrotica virgifera
  misc_feature (2)..(399): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 15701 - DNA, 746 bp, Diabrotica virgifera
cccacacgaattgcgaaggctgtgatcgctctatccctcttctcgcttcttccggatttcggcactcccagaggactgctgtggataatacatgtacgacaagatcacacgatattggagattccgactctgcctgaaaaagacatgtgtgacattacataataataaggatgattaatccggaatctaacatccaattcttgcaattgttcattgacatcgaatgcactgctccatcctaccctatgaatacctgcgactgactacccgattcatcatccaccacagatatcgcaggagatgtgattatcttttccgggggatgtctgagatacctcgtgatgacgccatgcattcatcggataccttactgcttctccctggtgcagtcgactcctctccgatgtctgcacgtgcattgaacataaaaattcctgacaaatacgctatgatcatgaatgaatagacctcagcctgtatagctctgcattggctatagacaactgaccccgatgcctgctctattccccctgaacctgctaaaaccatctctcaactatatgatcccgaacttacctataatctaaaataccaacatatacactagcgattagatattattacatcaatgattgactacatgactgatatatcggtactcattgaataagcacacccttagtccatcctgatgatgaacgtcgactacttacatctcattatatcttaaatatgtacgaatcaac

SEQ ID NO: 15702 - DNA, 771 bp, Diabrotica virgifera
  misc_feature (451)..(474): n is a, c, g, or t
  misc_feature (715)..(734): n is a, c, g, or t
ctgtccagtacactatggtgtctgtcatttaggccgtttatgtcaattgtcatttatcatctgtcactaagttaaacgtcaaataaaacgtaggttttggtattaaaattcaagactgctgttcctcaactttgtacaattttttgaatttattatctcagtatggttcattttagcccatagacaataacagatggaagaaatggtgactactatccaggtcttattcctttggatcttttaactcaagcccaaacacttaacagaaagatttaacattatgtggtagatagaagatatgaccaaaactttaactggatatcattccgttagatttttttttactgaaattgaagcaaatttaaacaaaaatatggagttttacgacttcaatactagatatgaccaccacactacctagacctcattcttataaaaaaatttggcgaannnnnnnnnnnnnnnnnnnnnnnnggaaatatggcaacaaggtgtaattttggactactagcttatgctgctagaataagtgtcatgccaccacatgaactggatctcattcctttggaatttttgaccggaactgaaacaatgttggtcaacaagatacaactccacatcactacgtcaatatttgttcacgagttcgatacttgacgctggaaaaaagtggtggaagaaagatatggccaactaattgatctggatctcttcnnnnnnnnnnnnnnnnnnnnctgaaaaaacattgaaattctccctactattcagatt

SEQ ID NO: 15703 - DNA, 562 bp, Diabrotica virgifera
  misc_feature (335)..(353): n is a, c, g, or t
caacgcatgagatttgtagaagatgataaagtttctattgattggttaacatgatatttgaatccaatgtattatgattaattgtgattgcatagtttatgaattttctcttcggcacgtatggaatgggaattgctgtccaaataatcgttgatacattatataccaatgatgtatttaatctaataataagataaataataacagctattgaagactatccagtgatttcacaagtgttgatgatagaagcataagtattacagtatcaagggaaactggacaaagtaaattaagcactagcgtgatgattattacaaaatgtcgtattgacnnnnnnnnnnnnnnnnnnncaatgggatgtaacatatgactgcgattaaagatatattacttaaataacgatatgaaagatgacctaacagaagaggtaatacacttttataaccacaatctagattaggccaatgtgttgaacgctgaaaaaatcaactgctaactccgtttcccgatcactacacaaccagtgatggatcatacatattacgttcacaaaaaacaa

SEQ ID NO: 15704 - DNA, 866 bp, Diabrotica virgifera
  misc_feature (2)..(66): n is a, c, g, or t
  misc_feature (68)..(95): n is a, c, g, or t
  misc_feature (97)..(137): n is a, c, g, or t
  misc_feature (142)..(159): n is a, c, g, or t
  misc_feature (162)..(346): n is a, c, g, or t
  misc_feature (348)..(362): n is a, c, g, or t
  misc_feature (364)..(608): n is a, c, g, or t
  misc_feature (610)..(628): n is a, c, g, or t
  misc_feature (630)..(684): n is a, c, g, or t
  misc_feature (686)..(707): n is a, c, g, or t
  misc_feature (766)..(798): n is a, c, g, or t
  misc_feature (820)..(851): n is a, c, g, or t
cnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnngnnnnnnnnnnnnnnnnnnnnnnnnnnnnnnnnnnnnnnnnnctacnnnnnnnnnnnnnnnnnngcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnncnnnnnnnnnnnnnnnnnnnnnnnnnnnnnnnnnnnnnnnnnnnnnnnnnnnnnnnannnnnnnnnnnnnnnnnnnnnncttttctattgaaagctgcaatgaagggctcggatgaaaaaaaaatctgtctttatctnnnnnnnnnnnnnnnnnnnnnnnnnnnnnnnnngcctaaatttttttcaaagacnnnnnnnnnnnnnnnnnnnnnnnnnnnnnnnncatcaagttttttta

SEQ ID NO: 15705 - DNA, 956 bp, Diabrotica virgifera
  misc_feature (826)..(826): n is a, c, g, or t
  misc_feature (858)..(858): n is a, c, g, or t
ggaaccttagaagctccattatgtattcaatctggaatgagagccaacattggtaaaaccatattaggaactattcgggaaagacagaatctgtttgttagtagacacactttggtagaaaaaattgtaataaatccagaaaatatggaagcctctgaagtgcgtgtaagaattggacttcaatcattgttaataaaagcacgcaaagaagtgattctttcagccggtaccatcagctctccacagatactaatgctttctggaattggcccagaagagcatttgaaacagcataatatctcagtaataaagaatcttgctgttggagaaaacctacaagatcatttattctttactggctttagtgttaaactagatttgaacgctcttttaccaagggatcctatagacactgtctacgaatactttaagcaccgtaccggtttgttaagtaccactggtattgcaaatttcctatcgtttatcaacacaaaaatcgattctgacgttccaaacgtttcttatcgtcacacaatatttcccgccagtgatgatatcctccttcctgctgtagtcaaagcttttggtatggaagccgatatggtcgaagctgtggagaaagcaaataaatacgatccagtaatgatgatactacctggtattgtaaatccaaaatcgagaggaaaagttcttctgcgaagtaataagattcaagatatgcctttgatatatccgggatacatgactgataatggtgatgaggatattcaaagcttattagatgctataaagatttgctgaaaacttctcgagaccgcatcactanagaagcatttaccagaattgctccacctaccnattacaaattgtgatgaatacgaatttaactccccgatgatactggaatgtgccttaaggcactttatcacaacattttgtgactttactagtacctg

SEQ ID NO: 15706 - DNA, 772 bp, Diabrotica virgifera
  misc_feature (191)..(216): n is a, c, g, or t
  misc_feature (430)..(458): n is a, c, g, or t
gggccgggccggaatactcccggcggcccccccgcccccggctaattatagtcaaacaattataatttgacttgaaaaaaggtagaacaatagtgaccaccattaaatgattaggtgaggtagaaatgtaatgttcactaaaaaagaaatacactatctactcctaggttgccagacaatgaagactcaannnnnnnnnnnnnnnnnnnnnnnnnntagatgattaaataattaaaatctctgcatatgaagagtaattgacacatgattcatatctggaaaagacatgccacaaggataccacttcttttcgacaatttttgcaagaactctaaatattggttagcggagcacatatcaacaaacttctgtctttggaaaacctaaaatcttaagcagaatagaggcagcccctgacagattgaggacnnnnnnnnnnnnnnnnnnnnnnnnnnnnnccagcctgacgaggatcttgccagatagatgatgccttatcataataggaggaaagggattatagacactggaatgaagacccattgaactgtcaaagactgttcaaagaactggagagtgaccactttcgttcaggatacctgatggattccgattttatacacgaagattcgatagatgacttttgtgtctagttcacaacaaggattgtttgatttatcagggacagaacctatcccattacttgttctttggaaggacgcattttgatcatcttgcaacatattataatatacaattattgttattcctg

SEQ ID NO: 15707 - DNA, 219 bp, Diabrotica virgifera
  misc_feature (3)..(21): n is a, c, g, or t
  misc_feature (85)..(129): n is a, c, g, or t
  misc_feature (132)..(132): n is a, c, g, or t
  misc_feature (139)..(139): n is a, c, g, or t
  misc_feature (145)..(145): n is a, c, g, or t
  misc_feature (162)..(214): n is a, c, g, or t
ccnnnnnnnnnnnnnnnnnnnctttataacgaatcctatttttaaagtcacaagcttacattttttttaccagacgagagacccnnnnnnnnnnnnnnnnnnnnnnnnnnnnnnnnnnnnnnnnnnnnnttnattatantataanttattttaattgcggtnnnnnnnnnnnnnnnnnnnnnnnnnnnnnnnnnnnnnnnnnnnnnnnnnnnnntccca

SEQ ID NO: 15708 - DNA, 268 bp, Diabrotica virgifera
  misc_feature (5)..(46): n is a, c, g, or t
  misc_feature (52)..(74): n is a, c, g, or t
ttagnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 15709 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15710 - DNA, 680 bp, Diabrotica virgifera
cggacgcgtggggtaaattttgcaattattgattgattgatgactgaaaagaacactgctaacatggaaattaggaaagatctgcataaaacacggttttgaagaaatgggcatattatctaagtgtagtctagtggctttcgaattacttaacgaaatgtttgcagcggtaggagcaggtttcttaggggttttgtatctagttaaaaaggggtttaataaatatgactcgatacgaaccttaactatacttgtagtaacgacagccagcgtggcttatatcactcataagaataacaaacaaattaaaccaaacaagaaaaaagttatatgcattactggatgtgattcatataacttttttcttgtttggtttaatttgtttgatatatatgagactgtactaagcttagctgtacgtggagactccacggacagcgagggttatatccctgataaaaataacaaacaaattaaaaccaacataaaaaaagccatatgcattagtgcatgaggttcgggacatggcgtttagctgtctcaacagtctgatgactatacgatatactgatgcacatgtcttcataaccgtagactctgcagatcgttacgaaattcgatggaaacatggatacattcagataccgatccatctagaagtgaccgattcacctaacgcg

SEQ ID NO: 15711 - DNA, 865 bp, Diabrotica virgifera
  misc_feature (798)..(798): n is a, c, g, or t
  misc_feature (816)..(816): n is a, c, g, or t
  misc_feature (847)..(847): n is a, c, g, or t
cgtcgtttgtgagtgcagcgcggaagtttgaaccgccaccttcggaaattgcatccgattgttaataaccgctcccacctaggaatgtgaacctatatccccaaataataacatacattgtgtgattgtgaactgtttgttaaatgaagctcatctttctttaaataattgtttagacgtcgcgtcgatgcgtatagagtgggtacgtaatgacaaaactatttataatactaggcgtgcatcgttaaaaatatacattctaattttgcgtcagctctttacgactaatgtgcggcgttttgcgttgttctgacagcatccgaatccgaattagacacgggagttgaaacggcatgtttgttattcaaaaactgaaaacaacgtctaaaatacacaaagtgcacagtgaaaattatgaaagtgtcactaactgatcacaaagtggcgtagaaccttggcatccttgcctaaattggtgtgcggtgtgctaaacgattattacgtgttcataaacattagttaccgagtgtgttaaagtgttgtagaaatgtctcatgaagcacagcttagaagaagtcaacgcacagacttttctaacccaatgacacctctagtatcccgagaaagaagtttcgtaagaccaaacaaagactcccaaaaacgtagaagccaaacaatgttcgctatgaaaggaaagccaactatggaaatatatagacctccgaatgttagaacggatattccattgacaggcaagcttaatgtacatgcaaaagaatttacaatgaatcacgattngcaggcatctagatcaangtggaatctacatttagccatggcatataangctcgattcgctacaaca

SEQ ID NO: 15712 - DNA, 142 bp, Diabrotica virgifera
  misc_feature (2)..(141): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 15713 - DNA, 913 bp, Diabrotica virgifera
  misc_feature (23)..(48): n is a, c, g, or t
  misc_feature (873)..(873): n is a, c, g, or t
  misc_feature (906)..(906): n is a, c, g, or t
ctggattggcagtcaatgacgtnnnnnnnnnnnnnnnnnnnnnnnnnntaacaatacctgcgtgtcttccaatcaccacggattattttccagataggagggctttaaatctagactatgtggtgtccctttacagtctgttgcctgacagtgttaatgcggacttcgttcaacaacgatcatcgtataaaaggccgttgactacagtagaggtgtttaaagagttaatctctcaacgcttgtcgcaaggattccaactaattctaatggctgacaagaatgtaaacttgaacaaaatgtgcggacctaatcccaaattaagaaccagcgtagtaagtaaaagccctacggaaaatgatgaaagttatttcttgtctataggaaggctgtttcacaaaatttcgctctctggaaatactatttctgtaacaagatatagaccaaggcatccctaccctggttttaactatcagtacagatacagattccatgctccgtggcacgatacgtatgaagagtcgttcgccacatttactacagaaaagttggaacattataattggaattacctggatcattacgtgtgtacaggtggagatactgagtttgtactcgttgatgccttaaaatattggagatttagagtttatctgataccattcaataacccagcgacgaggaaaatagtggaaggatctgaatactgtgatatttaccaaacgcaaacgaattgcgaacatcaacaaatggttgatggtcttaacagatttatagatacggctgtgaataaaataaggagatctactatatcgaagaaaccgaggacgatcggatcgagttcaccgttcagggagcggttgggcagcaacaggntgacggataggcctcgaccaaggtcaggatctnaaagtga

SEQ ID NO: 15714 - DNA, 446 bp, Diabrotica virgifera
  misc_feature (215)..(232): n is a, c, g, or t
  misc_feature (316)..(336): n is a, c, g, or t
  misc_feature (421)..(442): n is a, c, g, or t
cttccccccgccgcgttagttggtataatagagtattctttattaagaaaggaatcatttaatgttatgtacagttgtgtagtatggagacacaacattagtatttatatcatctcgaaagacattgatcgtaccttgcgtaggatgagtaatgaatgattaatgatacatttcttactttcgaatacagactagctaacaaaataaaagatgannnnnnnnnnnnnnnnnngaagtattttttttgtgatcgagatgttactcctttgcaaatatacctacttattttgcaaaaggacatttctatttgtgcacnnnnnnnnnnnnnnnnnnnnntgttatgatattactatttaatatctgtaagggatgagggaagtagatagaattttattaaatgttaatttctactcaaagatcnnnnnnnnnnnnnnnnnnnnnncaaa

SEQ ID NO: 15715 - DNA, 776 bp, Diabrotica virgifera
  misc_feature (280)..(347): n is a, c, g, or t
  misc_feature (765)..(765): n is a, c, g, or t
gtttggagaaattgtagctgtttggttaataaatgagtggcaaaaaatggggtctccaaagccgctacagatagttgaactgggaccaggaagaggaactttggccagtgatatcctgagagtgtttaatcattttaaagtactagagcaaacacgcttacagcttgttgagattagtacaacgttaagtgaaattcaagctaaaaagttgtgtaatcaaaataatgtaatcgatgagaatcagcctatctacagaactggtatcacacatgaaggtatnnnnnnnnnnnnnnnnnnnnnnnnnnnnnnnnnnnnnnnnnnnnnnnnnnnnnnnnnnnnnnnnnnnntttttgatgctttacctattcacaaattcatcagaacaaataagggatacagagaagtcctcatagatattgatcctagttttgttggaaatggcgatattaatgagcccaaattcagatatgtgctttctcgacatgaaactccaatgcaaaagaaactcataagaccaaatgaaaatcgggaacatgttgaaatatctccagacagtatgatggtatacgtagaaatttgtgaacgaattaaagaatcaggtggtttggcattaatttgtgattatggtaatttgagatgcgcaacagattcatttagagcatttaagaaacacaaacaagtggatcccttagtccagcctggatccgctgacttgacagcagacgtagatttcagcgctatttaagatgctgcagacgaagtaanaggcatcctaa

SEQ ID NO: 15716 - DNA, 901 bp, Diabrotica virgifera
  misc_feature (662)..(685): n is a, c, g, or t
ataaagccaaaaatctgtatcgtgggggccggaaccgctggattttacgcggcgcaacatttactaaagaagctaaactcccccgagatagatataatcgaaaagctacccgtaccttttggtttggtttggggttgctccagatcatccggaagttaaaaatgttattaataccttcacgaaggtagcagagagtccaaatgtgaagtttttgggtaatcttagtttggggagcgatgttactctagatcagctgagaaatgcgtatcatgttgtactcctaacatatggagctgacgaaagtagaaaactcaacattcctggcgaaagcttaaaaaatgtaatagaagctagaaaaattgtggggtggtacaacggtacaccctgggataaaaatttagatatagacctcagcggcgaaacagccaccatttttggacagggaaatgttgcaatagacgtggctagaatcctattaagtcctgtggatgatttgaagaaaacagacataaccgaatatgcattggaatctttatcaaggtcaaaaataaaaacagtttacctcgttggtcgcagaggacctctacaagctgcttttaccataaaagaactgagagaaatgctcaaactgcccaactgttcaacaatgtggcgatctaatnnnnnnnnnnnnnnnnnnnnnnnnctatcgaacctatcaagaccaaaaaagcgaattacagagctcatgttgaaatccgttagcgaaaataccatagaaagtgataaaacgtttagacctatattccatagatctccgttagagctgactggaagtggtagggttgataaagttatactaggaaatcacaaactggacggatcagatatactaacacagacagctgtaccaacagaccaa

SEQ ID NO: 15717 - DNA, 55 bp, Diabrotica virgifera
  misc_feature (2)..(31): n is a, c, g, or t
  misc_feature (35)..(36): n is a, c, g, or t
  misc_feature (51)..(51): n is a, c, g, or t
gnnnnnnnnnnnnnnnnnnnnnnnnnnnnnntaannttatttttaattggnggtg

SEQ ID NO: 15718 - DNA, 905 bp, Diabrotica virgifera
  misc_feature (79)..(116): n is a, c, g, or t
cttcgagacctaccgttaacaattcctgggggtacgattcgtcaaggtataatagcacgggtaataaagagacagatannnnnnnnnnnnnnnnnnnnnnnnnnnnnnnnnnnnnncggactttagagcaaagttcaaaaaagaaaacgaaatccaggtccggatccagatcaccatctccttcgggcagtgcgagtagtaggtcaccttcaagatcaagatcaagaagtagcagtagttcctcaagttcctcaatatcgcgagacaccagctcgaccagttccccgaaatccaagaggatagcatcgtaacgcgtctaattcgaaccatcagccagtggtgcatagtgacgaccgaagaccattggcaatatgcgtgaagaacctaccggtgcgatcatcggacacctccttgaaggacggtcttttccacgaatacaaaaagcacgggaaagtgacgtgggtgaaagtggtaggaaaagatgccgaaaggcacgcgatcgtgtgcttcaagaagccggaagacgtggaaaaagcgctggaagtgagctacgataagctgtttttcgggtgcaagatcgaggttgcgccttaccaaggctacgacgttgaggataacgatctgaggccgtacgaggcggaaatcgacgagtaccatccgaaggccacgcggaccctatttatcggtaacttggaaaaagacgtgaccgcgtctgatctcaggaaacacttcgaccagttcggggagattatagaaatcgacattaaaaaacaaggggctgtgagttcttatgcgttttgtcagtactcggatatagtgagtgttgtcaaggccatacggaagatggacggtgaacacttaggtaataatcgaataaagttaggattcggcaagtcgatgcctta

SEQ ID NO: 15719 - DNA, 807 bp, Diabrotica virgifera
  misc_feature (425)..(439): n is a, c, g, or t
  misc_feature (441)..(453): n is a, c, g, or t
  misc_feature (732)..(749): n is a, c, g, or t
atcctctgttacaaaatgaataagttaccagtgttcactttattgtttgctattggtttccaatcatcagccggattccgggcggggttcagatacaatagagatgtgcaagtaatggtgcctgctggaccagtaactctagaagctcaacctgcagttcaaactctagaagctaaactaccagcagttcaaactttagaagcccgaccactatcagttcaaactctagaagccagaccagcaattgcaacacttgaagctagacccgaagtttcaactcttgaattgagaccagaagtttcaacccttgaattaagtccagaagtttcaacacctgaacataaactaaccgtaaatgacaagttggctatgatcaaacaatgggttgaagaacaagctaacaagccaatctcccgtctaagacnnnnnnnnnnnnnnncnnnnnnnnnnnnntggctggatgatagagcaaacaaagtacgtcaaagtgttgttgacttagagaacaaggtcctcccagccatccaaaagttgaaggctgatgcatcccatgctattgacaccatcaaacaaaaagttaaaggtcaagaagcacaggctgaaagaacaaaaagagcgatgaagcagttaaatagacaaacaagagcgatcaaaaaacattgatgatgtcttagccccaaagacaaagattggtgtaatttttgaaacttactattatctataactgattcnnnnnnnnnnnnnnnnnngttaatgcattttacccacattgtctcatattcttaaaataaacacagtttatcacta

SEQ ID NO: 15720 - DNA, 108 bp, Diabrotica virgifera
  misc_feature (6)..(107): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 15721 - DNA, 839 bp, Diabrotica virgifera
  misc_feature (83)..(105): n is a, c, g, or t
  misc_feature (151)..(183): n is a, c, g, or t
  misc_feature (234)..(246): n is a, c, g, or t
  misc_feature (248)..(263): n is a, c, g, or t
  misc_feature (320)..(339): n is a, c, g, or t
  misc_feature (367)..(421): n is a, c, g, or t
  misc_feature (424)..(454): n is a, c, g, or t
  misc_feature (456)..(487): n is a, c, g, or t
  misc_feature (489)..(532): n is a, c, g, or t
  misc_feature (550)..(580): n is a, c, g, or t
  misc_feature (667)..(701): n is a, c, g, or t
tatagaggaagctggtccgcctgcagctaccgcgcccggtccccgccgggtccccccacgcgcccgttttctttattttaaannnnnnnnnnnnnnnnnnnnnnncgtaaagaaacattttctctaatgatagttaattagcatcgcgacnnnnnnnnnnnnnnnnnnnnnnnnnnnnnnnnncttttgtaccttgagtatcagcgaattatcaactaataattatacattccnnnnnnnnnnnnncnnnnnnnnnnnnnnnnccacacttttatcgtaaaataaatatcttaaatactcttgtttgtaatgacaatgtnnnnnnnnnnnnnnnnnnnnccaatcttttaagaaacaaattaaaccnnnnnnnnnnnnnnnnnnnnnnnnnnnnnnnnnnnnnnnnnnnnnnnnnnnnnnnccnnnnnnnnnnnnnnnnnnnnnnnnnnnnnnncnnnnnnnnnnnnnnnnnnnnnnnnnnnnnnnncnnnnnnnnnnnnnnnnnnnnnnnnnnnnnnnnnnnnnnnnnnnncattatttttatctttcnnnnnnnnnnnnnnnnnnnnnnnnnnnnnnncatttaaatttactaatgacgataatattagtatcaaaaaactgtatatttagtaaaaacatataggtccaataaaggacctccccnnnnnnnnnnnnnnnnnnnnnnnnnnnnnnnnnnncctctcgcaccacccatcaagtctcgcctgcccaccgattaacctgactggccccgatatttccgaccgtgctaaggtacatcatcatcagttttttttatcgaaagccgcaacgcaagtttcgtctgtaaacaaaat

SEQ ID NO: 15722 - DNA, 818 bp, Diabrotica virgifera
  misc_feature (9)..(21): n is a, c, g, or t
  misc_feature (23)..(45): n is a, c, g, or t
  misc_feature (391)..(414): n is a, c, g, or t
  misc_feature (675)..(693): n is a, c, g, or t
caaaactgnnnnnnnnnnnnncnnnnnnnnnnnnnnnnnnnnnnncttacatttaaatttacttaacttattataatgtttaaattagaactaaaataaaatgagctattagttatggtaggggagcccaagcgggaatttttgcagtcactcgagcgagtcagattatcatatggggagaaacctggtagcctgcagatgtacctctaccatatatgttgtctcttaacacagggaagttcgaaggggggcccgaaaaaaaatctatccttaaaatactcgaaattgtcaggtaaataaatactcgaagacatggtaacttaactacatgcaaaagagtgtatatttcagaaatctgacgatttgagcggggtaggaaatgggtgaatcnnnnnnnnnnnnnnnnnnnnnnnntttcgcaaaatgaacatcagatcgaaaaactgcaaactacactttcaaaatgtttttgaaaaatctatcgaatggtactaaacacgaccccccacggaggtgggggtgggggggttactttaaaatcttaaatgggacccaaatttttattgcagatttggattctttcgtaaaaataagccacttttattcgagatattttttcgaattatggatagatggcgctataattggaaaaaacgattgttagaaatggaaagnnnnnnnnnnnnnnnnnnngcgccccctaaaattacgaaaattttacttaactttttttgattttaggacctaataatcacaacctaattggttcccataacgtttgagtgactgcaaatttagcgtactttgctcccctacca

SEQ ID NO: 15723 - DNA, 792 bp, Diabrotica virgifera
  misc_feature (2)..(31): n is a, c, g, or t
gnnnnnnnnnnnnnnnnnnnnnnnnnnnnnnttttctctctcctatggcgctacagcccaagtcgggccctggcctcccccagtatctgcctccaagtatctctatccctggctgctctcctccaattattcaccctcaatatccctttagcatctaaaaatactagatttgttgtaaaaggtatgattcacgtttccacgccatatgtggctattggtggtatggttttggttattttatcaatgttataaaccgtatgctaatacctactggtatcaactgataagaattctaatttacttcaatttggtcattggtttgattctgctttcatcttctttactagaggcagccactcatatttttttgaagaaattactcttctttataatctaggaattgtatcatgcagttgttgatgtccaaaaccgtttagtaagcacacaaaatttaacaaaaaatgaatgatttctgcaattcttagacttaatactatgactgccaaatgacatgaaattcaattcaaagcagcaagcgcaaccagaaaaaaagattactaacctcaagttacttataagggcatcaccgatcatcaattagatttcagagaataattagagttatgtggaaagtatttttaaaacagatgtgttgatgtattggaaacagtaccagatatataaaggggtatttttaagtacatagatagatagtagcaaatatttgcagacctctccgattatatagcattatatatttagaattatcgcataaattagtaatttatatat

SEQ ID NO: 15724 - DNA, 894 bp, Diabrotica virgifera
  misc_feature (11)..(797): n is a, c, g, or t
  misc_feature (804)..(871): n is a, c, g, or t
tttagctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatannnnnnnnnnnnnnnnnnnnnnnnnnnnnnnnnnnnnnnnnnnnnnnnnnnnnnnnnnnnnnnnnnnnataattaccttagggataacagc

SEQ ID NO: 15725 - DNA, 971 bp, Diabrotica virgifera
  misc_feature (758)..(758): n is a, c, g, or t
  misc_feature (924)..(925): n is a, c, g, or t
aaaaatacagcaagttgccgctaatattaaaaacacagctgaaaacactacgaacgctttggaaaacttggaaaactctataccagatcctggaatcatacaagagaaatctaaagatattactacattactgaaatctacaattgaagacactaataaagcatttgataatatcaaagagcttttgccagaatttgtaaagatacagaataaaacaagtagtattggggacatgttaaaaaataatgaaagttcatctgacgaacatcctaaaaacactacaaatagatatattgatttggattttcagaggacgtcccaggaaatggtagagaccattacaaatgcaacagaaaactgcaacaaagtattaacagacatacaaaaagtaatgcctgacctgataagagtattggaaaaatctactcaaatggtagataatctatcagaagcaacaaaaaaatctaatgaaataatcgcaaaattggagaacacgtcagctaagtcaacagaaatatcaaataaaattttagccggactagaggagaaaggtagaaatataattaacactgctgtgcctggtgcctcgcacaataagaccgacgcagtaactaaaccagaagagcccaagcctttgttccctgccaatgatccatttaactttaagaaaaatgcagaagaagcccaaaaggcgttcaaagagaagggacttggaggttggattgctacagtgcaaaaaaatgttcaggagaccctanatgctctaataaaaggaggcgaaggaaaaaaattagtcgaagcattatcgagtgggttaagaattaataaaaacgttcaggaaaaggactgcctgcagtcacgaagcaagtagaagccaaaactgaagaaatcctagcccgggcaatcgtagaaaacaacaatggnncatgaaagcacttacgcagaaataaatatataagcattgtttttaa

SEQ ID NO: 15726 - DNA, 751 bp, Diabrotica virgifera
aagaattctccatgatgttcaagcacttcgacaaagaaaaatccggaaaactcaaccatcaagagttcaagagttgtcttcgagctcttggatacgacttacctatggtggaagaaggccaacctgatccagagtttgatgctatactggatgtagtggatccgaatagggatggtcacgtctctctacaggaatacatggcctttatgataagcaaagaaactgagaacgtccagagttccgaggaaatagaaaaggcgttcagggcaataacggcaggagatcgtccatatgtcaccaaagaagaattatatgccaatcttaccaaggaaatggcggactactgcgtggcgaggatgaagccttacgtagagccgaagacagaacggcccatccagggcgctttggactatatcgagttcacacgcacactttttcaaaattagttaggttaggttccgcattagtcgcttactcttgctaaacgttagatagacagtataatattattattgcaataagaaacaaatatttattgaagatatatttcagattatatatatttattgttccgtatattcttttaacgatttttatgagtgaactgttcttacactatttttatgggctttgtggctttaatattgggacaagatatatttaaaagtgttcattttaatattaatatagttttgtatcttttaattattgtacttgaggtgtttctcaaatatataactttgcttcatta

SEQ ID NO: 15727 - DNA, 177 bp, Diabrotica virgifera
  misc_feature (7)..(44): n is a, c, g, or t
  misc_feature (79)..(101): n is a, c, g, or t
  misc_feature (109)..(130): n is a, c, g, or t
  misc_feature (154)..(154): n is a, c, g, or t
taacagnnnnnnnnnnnnnnnnnnnnnnnnnnnnnnnnnnnnnntgcgacctcgatgttggattaagtttataattggnnnnnnnnnnnnnnnnnnnnnnntgttcgannnnnnnnnnnnnnnnnnnnnnagttttaaccggtggaagccaggnttggtttctatctttaatttatt

SEQ ID NO: 15728 - DNA, 98 bp, Diabrotica virgifera
  misc_feature (2)..(58): n is a, c, g, or t
  misc_feature (60)..(88): n is a, c, g, or t
cnnnnnnnnnnnnnnnnnnnnnnnnnnnnnnnnnnnnnnnnnnnnnnnnnnnnnnnnncnnnnnnnnnnnnnnnnnnnnnnnnnnnnnctcgggggtg

SEQ ID NO: 15729 - DNA, 630 bp, Diabrotica virgifera
  misc_feature (440)..(454): n is a, c, g, or t
ctgatttctcattgcctgaattaatatttgtatttgagattaatatatatgctgacttatttggcttaatctctactaaaagacacctacatttgatgaggccaagaatttatagaacctggcacaatgacttgaactcatgaatgctcttaaaagttctaccgacgatgcttatcggatagattctcctccagctacatacaacaaaccttaccctactcacatgattgcgctgcgaatttccttgggaaccggaatgcacgtgagaacctcgcatatacactactattaaatccaaaaataattgaaacacaacaggataatttgaaggaacaacacacaactactcccacacattccattgaccgatgacccctcctgtcccccaagaccctcaaacctcatacatctgcttataaatttggctccagcataaaatnnnnnnnnnnnnnnnaaccgatatgtatctgagataaaacaaactcgcgactgccagaataattcttttatcaacagccctccctgtaactacgtccagaacaatagaaactggacaaaaacatgaagggaagacgatggctttggatctcctatctgatggaacaaattcacttcctactttgatttttg

SEQ ID NO: 15730 - DNA, 983 bp, Diabrotica virgifera
  misc_feature (872)..(892): n is a, c, g, or t
ttgtttttgttctttctaaaactagtttaatatctaaatacaatacaaaaaactgtttagataggtacatatattgatttcgttgaaatcataatatatgaagttagattatattgtaatagaagtataacttcttacgtgcgtacaaagtacacacacattctttttttttgtaaacaaacacatcggacagctaaacagttgtcaagttcagttggatatactgtgcaagacgagtgtagttaactaccctctcagaaaaaggtgtagattcaactacactagtgttagactttttttgctacttttcaatgaaacaacatattgtaccactacaccttcctaaggaacgagttagtgtagcacttctacacttacttaaaactatagtgctacaccaaaaacaaaggaacagacctactatttgctgggcttactccagagcaacttattttgacagatggcaatgtaattgacattgaatataaattgtttaataatcaaattaaacggttcaaaggaatattgcatgtctgtttgcaactgattgaaatagtgctaaatttgccctatagggcttatcaacgcttctcatttgtttcgagcttctgtcatatgtcgtataatccgtgtatattattaatatacgacatatgacagaatacagtattttctccgagaaggaccctagaaggaccaaacctacttactcggatttgcagacgatatcgattccaataggaaacccccgactaaaagggaagaaagagactttcggggggtccaagaagaaaccaaaaaaattgtgggtcccaatccacccaaaacaagaagccttatttgttttggacccgaattacccagccgagcannnnnnnnnnnnnnnnnnnnntttccttgccttaaaattaactttgtgcggggtaaaaaattttggattccgggaaaaaaacaactaaattacaaaaaaccatttccggctc

SEQ ID NO: 15731 - DNA, 140 bp, Diabrotica virgifera
  misc_feature (7)..(44): n is a, c, g, or t
  misc_feature (63)..(76): n is a, c, g, or t
  misc_feature (79)..(101): n is a, c, g, or t
  misc_feature (109)..(131): n is a, c, g, or t
taacagnnnnnnnnnnnnnnnnnnnnnnnnnnnnnnnnnnnnnntgcgacctcgatcgtggannnnnnnnnnnnnnggnnnnnnnnnnnnnnnnnnnnnnntgttcgannnnnnnnnnnnnnnnnnnnnnnagtttaaac

SEQ ID NO: 15732 - DNA, 866 bp, Diabrotica virgifera
  misc_feature (551)..(616): n is a, c, g, or t
  misc_feature (789)..(789): n is a, c, g, or t
tttcaacattggagcgaaattctgtgctgcactcttccttcctcattcaaacctcgtggttgttacgaacgtatagatcacgtaaataattccacttttcggagaaatccattcaatcggtatgaacgattaaaaaccttacggagagtgatattttggtgttttttgtgaattttttacttttattatagtgtagtggttttgtacgacaatatgacttcaggagtcaaacaaacggtcataaaaaatccaacatggtggaagcgacgtacaagtatggagaggtgtctaaccttatcaacgggtattgcccttcttattggaatctccttactcatagcacttgccacagtattatatagcagagatcaacatattagtaataaaccgtacacagcccaaccactacaaggaaaaatagtcacaattacatcccaagatcacgaagatgaaaaagtatgtttaagtccaggatgcattcatactgcatcacgtgtattggaatatatggatgaatcggttgacccttgcgatgatttttatcaatttannnnnnnnnnnnnnnnnnnnnnnnnnnnnnnnnnnnnnnnnnnnnnnnnnnnnnnnnnnnnnnnnntaattggtgatgaacttcaagagcaattgagaactatgatcgaggaaccgatccaagaagatgaaccaaaaccattcaagcttactaagaaattatacaaggcatgtatgaataaaactttgattgaagaggatggaatgaccactattacagaagtgctgaaaggagttggngtgggtggcctggttttagaaggagattctcggaatgaagatgattctgattggaaaaactctgtatataaatttcg

SEQ ID NO: 15733 - DNA, 1113 bp, Diabrotica virgifera
  misc_feature (81)..(127): n is a, c, g, or t
  misc_feature (129)..(172): n is a, c, g, or t
  misc_feature (174)..(677): n is a, c, g, or t
  misc_feature (687)..(712): n is a, c, g, or t
  misc_feature (714)..(781): n is a, c, g, or t
  misc_feature (783)..(795): n is a, c, g, or t
  misc_feature (799)..(827): n is a, c, g, or t
  misc_feature (848)..(863): n is a, c, g, or t
  misc_feature (866)..(911): n is a, c, g, or t
  misc_feature (914)..(930): n is a, c, g, or t
  misc_feature (966)..(988): n is a, c, g, or t
  misc_feature (992)..(1030): n is a, c, g, or t
  misc_feature (1038)..(1075): n is a, c, g, or t
  misc_feature (1079)..(1100): n is a, c, g, or t
ggcgttgcgtttcattttttaaaggtgttgtacctactttaaatgaattaataatttgtttgcaaagacggatgcaaattnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaattcannnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnannnnnnnnnnnnntgannnnnnnnnnnnnnnnnnnnnnnnnnnnncctggaatgaccgggttggannnnnnnnnnnnnnnnacnnnnnnnnnnnnnnnnnnnnnnnnnnnnnnnnnnnnnnnnnnnnnngtnnnnnnnnnnnnnnnnnagacaaaaaaaacccctactagaggtttttaaaacnnnnnnnnnnnnnnnnnnnnnnnggcnnnnnnnnnnnnnnnnnnnnnnnnnnnnnnnnnnnnnnnctgcgggnnnnnnnnnnnnnnnnnnnnnnnnnnnnnnnnnnnnnncccnnnnnnnnnnnnnnnnnnnnnnctctggaccccgc

SEQ ID NO: 15734 - DNA, 900 bp, Diabrotica virgifera
  misc_feature (644)..(660): n is a, c, g, or t
attgtttaccccattaaatcaattctgattaacaataaccttttggtcacttctgttgtaagagcatgttaagctgtagcaactactgtcaattgaatccttaaggtattgttgaattagtacatggagcccttatttggtcaaattataactaagaaaatttacgattgtcagctgaaagaaagatttacatccgtcccttggaagctaactgtttttgtagacgtatatcatattgaaagccctggtcatgtctcttgattttattgccggatgtgttgggggtgtagctggagtttttgtaggccatcccctcgacacagtcaaggtaaatttacaaacacaatgtacagttaatcctcagtatcgaggaactgttcactgcataaaatccttaatggcaaaggaaggaattaaaggaatatatcgaggagtaactagtccagcaatgggagtagcaacgttaaatgcagttgtgttcggtgtatatgccaatgttcaaaaatattcgacaaatcctgagagcctctcatcgcatgcagttgctggagcagcagcgggatttttcactagtgatatttctagtccgatggagctagttaagtcaaggatgcatgttgcaggagcccaagcgggaaaaagtnnnnnnnnnnnnnnnnnaagaatttataaacaacggaaattgcttggagtatttcaaggatatggtataacagtgataagagacgttccagcctttacaacctattttgtatcttacgagtatttagccagaaccgaggaatgacaggtcccttcatcgtcaacaatattattcgctgttggaatgacaggtgtgatatcttgcatcataccctacccactacacgtacttaatgcaaaaattcaagtagacacctc

SEQ ID NO: 15735 - DNA, 436 bp, Diabrotica virgifera
agaatatattagttacatataaccaaataaagcagaggaaaagattgcaatcggcttattcaaaatgattaactgtacatgaaatctacaaggaaacggcaatattcgagactccgaatgtcttaaatatggcctatacttcgcccgggcgagaatgtgtcaactgatttacggaaagcaattaaataactgaaatgaagtactatttacattctcctccgagtcctgatcaagaaagggtgaggtgacagcaaaaccatttcgatgaactctacagggcctaaaactgggccgccgccacccgaaagggattgaagcaagcacagctaaaagaatatatgttcgattgtgaatatatatatactaggaaaaatcgattagatgtgccggtcatgtatgacgcatgttgtaaccgtgcaagactaattacaccaaa

SEQ ID NO: 15736 - DNA, 333 bp, Diabrotica virgifera; identical to SEQ ID NO: 12194
  misc_feature (6)..(28): n is a, c, g, or t
  misc_feature (219)..(292): n is a, c, g, or t
  misc_feature (297)..(331): n is a, c, g, or t

SEQ ID NO: 15737 - DNA, 345 bp, Diabrotica virgifera
  misc_feature (4)..(189): n is a, c, g, or t
  misc_feature (191)..(221): n is a, c, g, or t
  misc_feature (301)..(319): n is a, c, g, or t
aagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnncccttagggaataacggggtaatttttttgggaaaggttcaaatccaataataaaaaattggcgaccctccaatgtgggnnnnnnnnnnnnnnnnnnnggggggacacgcgctttttttttttt

SEQ ID NO: 15738 - DNA, 766 bp, Diabrotica virgifera
  misc_feature (2)..(702): n is a, c, g, or t
  misc_feature (705)..(765): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnnnnnnnnnnnnnnnnnnnnnng

SEQ ID NO: 15739 - DNA, 109 bp, Diabrotica virgifera
  misc_feature (3)..(57): n is a, c, g, or t
  misc_feature (59)..(104): n is a, c, g, or t
gcnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnggggt

SEQ ID NO: 15740 - DNA, 641 bp, Diabrotica virgifera
  misc_feature (213)..(227): n is a, c, g, or t
  misc_feature (514)..(546): n is a, c, g, or t
cggacgcgtgggaaaccgttaaaacagaatattttgaaatgaggtgaggattataaaaaaaataggaggcattgaattgaaatcccgaagccgtaattttttgagcattataaagaatgggtgataataaatcctttaaatgtagtacatgtaacggtgagtattgtactacagaatgtccacggaaggacactatgttggttggtggagagnnnnnnnnnnnnnnngaaataccagctgttggaggtgcagctgttggtgagactgataaacaaggttccaagatgtgcctcaaaatttaagagataaaagggcgaaaaaaactggtgggtctaatgtaactaaacgagctgctaaacaccatgctattaaaattgataatttgagtgaaaaaacaactagaactgatttggaagatctgatcaaacagtttggactaattcaaaaacggtatttagcagaagacaagcaaactggtgaatgtaaaggatttgcttatgtacatttcaaattnnnnnnnnnnnnnnnnnnnnnnnnnnnnnnnnnccatggacatagttataataatcacgttcttaatgttgattggtccattcgataaacatcaccatatttttaagtaataaaaagttttgattttt

SEQ ID NO: 15741 - DNA, 955 bp, Diabrotica virgifera
  misc_feature (864)..(864): n is a, c, g, or t
  misc_feature (904)..(918): n is a, c, g, or t
cttaattatttcatggatggatcgtgagactaatgttgagatcctatgtagaatggacaaggaatgttagattatcaacacaaccaataagcaaattgaaatatcttggtcatgttatgagaaataaacacgagatatggcttgctaaattcatttttcagggtaagctatttagaaagagaggaccatagagaaaataatatcttggcttcaaaacctgagaaagaggttcaataagtcttcaaccggactatttcgaatagctgcaagcaaagttatgatagccataatgattgccaacatccgaaacgggtgaatttgaatcatcagaatttgaaagactagttcttttaccctataatgatttacctgtataaaatgtcatgtatttttgaaattgtgatgagactggatatgacgtgcaaacataagagtcgctgtcaagaaaaagtcgttggaattctgcaagtatttcgcagcattttcattttagtttttctaatattttctagaatatttacgaattaaatttttgattctgtagaaatgtacaaatatactgaatgctttaaaagaatgtactattattaactgccactgcatcatggctaataatattctatggttccaatgtcaccaaagcttttatgtcgaccatatgtcgaccattgttttagaacacgcttttaatatacataatattaagttggtatgatcaggacacacaaatagacgacgaaaacactttaaaaaataccggttataataacactaagagctagaaaaagaaacgaaaatatcccaagaaataatcaaagcaacgaccgatcattaacactaaagaagatttgcagtggacataanagatttaagtttattgaagcaagtgtttagtgaaggtctnnnnnnnnnnnnnnnggtacttacagatgatcattacacactagtttatgtc

SEQ ID NO: 15742 - DNA, 366 bp, Diabrotica virgifera
  misc_feature (3)..(34): n is a, c, g, or t
  misc_feature (36)..(51): n is a, c, g, or t
  misc_feature (79)..(79): n is a, c, g, or t
  misc_feature (85)..(108): n is a, c, g, or t
  misc_feature (115)..(161): n is a, c, g, or t
  misc_feature (179)..(198): n is a, c, g, or t
  misc_feature (208)..(241): n is a, c, g, or t
  misc_feature (269)..(288): n is a, c, g, or t
  misc_feature (327)..(362): n is a, c, g, or t
atnnnnnnnnnnnnnnnnnnnnnnnnnnnnnnnntnnnnnnnnnnnnnnnntagttttttattcgaagctgcaatgaanggctgnnnnnnnnnnnnnnnnnnnnnnnncatttcnnnnnnnnnnnnnnnnnnnnnnnnnnnnnnnnnnnnnnnnnnnnnnnccaaaagaacccatccgnnnnnnnnnnnnnnnnnnnngccttttggnnnnnnnnnnnnnnnnnnnnnnnnnnnnnnnnnncggagggggggggtgcaagaaattaagnnnnnnnnnnnnnnnnnnnnggtgaggggggggagactttttggggccccccttttcgnnnnnnnnnnnnnnnnnnnnnnnnnnnnnnnnnnnngccc

SEQ ID NO: 15743 - DNA, 147 bp, Diabrotica virgifera
gtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 15744 - DNA, 975 bp, Diabrotica virgifera
  misc_feature (864)..(864): n is a, c, g, or t
ggttatatttgactatatggacaaatttcgaaaaccataatgttacaattccaatcccaattaattaaaacagatgttacagctatcacacgacatgaatatgtaactttagtaggaattggttcctcattacatgttttttgtaacaacactgataaactaattaacaaaataaatatagaagataccagaggcgaactaatatttggaattaaaccttttggccataacaaactcctcatatttggtggtccatttctattaatattttccgcagatcaacagttcactcacatagaagaagtacacagagttgcccacaaagattggatcctggaagctaaatttataaacaatgaaacacaaatcgctacagtttccatgcagaacaaacttcaaatatgggatactgcgttaaatcttttggaaacatttgaatgccaagaaaaatgtattttatatagtgcacatatttgttataatgattacgataagttagtgatactctctggtactgtttttaatgaagttttgttatggaaagttagaagaaatgaatactcgaaggttccagttcttaaaaggttaaagaaacatgatggtgtaatattttgtatacattacaatgaagataatggtataatatgttctacttctgacgaccgctcagctatattatggaaagtagaaaatactgatctcagtttagaactgaacagagagcatcccaacatatttccaatatgccaagtttatggtcatttatcaagagtattccgttgcttggtattgaaggactgttttatcactgctggcgaagattcgttaataaatatttggaaactggatggaaattggctaganaagtggaagctaaccaaatagtccatatgggcattagatttgatcaacagataatgtgtactagtgggggagggaatgttggagtatatacattttctctatacaatatat

SEQ ID NO: 15745 - DNA, 975 bp, Diabrotica virgifera
  misc_feature (830)..(830): n is a, c, g, or t
  misc_feature (889)..(889): n is a, c, g, or t
gagactgcagattatatataaacatgtttataaattcaggtcgatttcaactactgtccttaggaaatctaacgatatatcaaatgagtatgtggaggatatacttgaaactgagagtgaatataacaaggaagtggacaattttatgagcgttaaagatatccataactgtgtgataatacaaccatatgtaaaatggggccctcgcaaactatcagttactccagaggaacaattagaagaagcagtagcactcgtaaaaactttgccatcctggaaagtcgttaataccataaccgtacctctagagtctctggattcaaaaagtctatttaaatcaggaaatatggacaaactgtctaagatggtcagaaaagatcctgaaatatcagcagttttcgtcaatactagtaatttaaaaactgtaacctctacgatattgcaggaaaactttaggctgccgattttggaccgctacagaatagtaatgcagattttaaagatacatgctactagtaaatacgcaaaactccaagtcgctttagccgaattgtattttattcgaagaaaagctgaaagcaaccaagtatttgttacgcatgaccgcgaaactttaaaattgatgtttcaaaatagggagcaaaaattaaaaaaagctatcaagggcctcagggaccaaaggaaactgttacggagtaagaggcgcaaacttgattatccggttgttgctgtagtgggctacacgaatgcaggtaaaacatgcttaatcaaggcactgactggggaagattctttaaaaccgaggaatcaattgttcgctactctagacngtactgttcacagtggaaatttaccttctggtttggaagtttatatgtagatactgtgngattctttgtcgatatacctacggatctcatcgaatgttttattgctacattagaggatgccatttttagccgatttaattctgca

SEQ ID NO: 15746 - DNA, 141 bp, Diabrotica virgifera
  misc_feature (6)..(33): n is a, c, g, or t
  misc_feature (36)..(36): n is a, c, g, or t
  misc_feature (46)..(47): n is a, c, g, or t
  misc_feature (55)..(55): n is a, c, g, or t
  misc_feature (59)..(59): n is a, c, g, or t
  misc_feature (62)..(62): n is a, c, g, or t
  misc_feature (64)..(64): n is a, c, g, or t
  misc_feature (66)..(68): n is a, c, g, or t
  misc_feature (70)..(125): n is a, c, g, or t
ttatannnnnnnnnnnnnnnnnnnnnnnnnnnnaanttatttatanntataattnattntantngnnngnnnnnnnnnnnnnnnnnnnnnnnnnnnnnnnnnnnnnnnnnnnnnnnnnnnnnnnngatccatttttttttg

SEQ ID NO: 15747 - DNA, 759 bp, Diabrotica virgifera
  misc_feature (55)..(74): n is a, c, g, or t
  misc_feature (76)..(96): n is a, c, g, or t
  misc_feature (101)..(121): n is a, c, g, or t
  misc_feature (185)..(206): n is a, c, g, or t
  misc_feature (301)..(322): n is a, c, g, or t
cgttatttattttaaaacactagaatattttctaccacaagccaagacaaattcnnnnnnnnnnnnnnnnnnnncnnnnnnnnnnnnnnnnnnnnncctgnnnnnnnnnnnnnnnnnnnnnttgcaccctgtgtatctgggattactacttaatacttatatatttattattgtccaatatcagnnnnnnnnnnnnnnnnnnnnnntattggacaataaatattaccaatcatgtttttgtaatgaacccgttattcgggtctcagatatatctaagttttctaaaaatactttaaatgcnnnnnnnnnnnnnnnnnnnnnncctccaaatgcttatatcattaatattgaacattattagggatgaactcaagaataaaattctatgaaaatgtaatccccacatagaaattctgcttaaaagttgtcgtatctcaaaacatcaatgttatctatattatatatcattatatatgttttattacttgataatactcttgtatgtaacacatatcattgacattatttacatctagaagtgatgataacatcctaattacccaattgtatatttagtacaaatatatcatctataataaagcaaatctgcaacatgcatttcacctgaccattaataacatgacatattgaattaaatatacacgctcgcctgcccactgcttatatatgatcggacgcggattatgaccgtgctaaggtaccatcatcattactgcttttattgaacgctgatatgaa

SEQ ID NO: 15748 - DNA, 113 bp, Diabrotica virgifera
  misc_feature (25)..(46): n is a, c, g, or t
  misc_feature (48)..(92): n is a, c, g, or t
  misc_feature (94)..(106): n is a, c, g, or t
gttacaaagctcacatttttttacnnnnnnnnnnnnnnnnnnnnnngnnnnnnnnnnnnnnnnnnnnnnnnnnnnnnnnnnnnnnnnnnnnncnnnnnnnnnnnnnactcgcc

SEQ ID NO: 15749 - DNA, 403 bp, Diabrotica virgifera
  misc_feature (117)..(143): n is a, c, g, or t
gcgcccgggttgtgactaattacaagtttttctgattgtaatttttgctcgattaattaaagtagagatattttaaattcttgtgcaactacttcatagctaaaagaaaactaaaannnnnnnnnnnnnnnnnnnnnnnnnnntggttaccaggctcgttcctctggtttctccaatttcaaaagtggaggaaactgtggaggatgatgatgttacaacaacatcaaaggatggcgggtatgagacgaccggaggagtatttaataacagaagatttaataagtcatttgcataaagcatatataataattgaaacgatataattttataatcttattatcaagggtgagaattattgatagggatggatatctgacagagcagttaataataaatcgatgtc

SEQ ID NO: 15750 - DNA, 373 bp, Diabrotica virgifera
  misc_feature (263)..(291): n is a, c, g, or t
ccatcagaacacgaagatttgactatgacgagatggacatttatttgcggtaccgtgaacgctatggcagctgattgggacttcttgtgagaatgaataaaaggaatccacgatcatttggattcccgagcaagagctgaaaatggtccatataattatgagacaatctgctaaaactcctgagataacttatcccaacgacccctgacaaaatgattcattataccccattgggtggggacatgtaactcgcgaaggtatgnnnnnnnnnnnnnnnnnnnnnnnnnnnnnctacagtgaataacacgataaatatcttggaaacattaatatcacgacgaatactacacttagggacgagcttaaaataaaa

SEQ ID NO: 15751 - DNA, 950 bp, Diabrotica virgifera
  misc_feature (529)..(543): n is a, c, g, or t
  misc_feature (925)..(925): n is a, c, g, or t
cgattatcgaatatcgccaaaacttatattttcgtaatgtatacagacggagataaatacaaaaacaatatcagtcagttggctttaaaattttgtacgttgaccatatacgaatacacatcttttatgtatccatcatcataattttcttgtaaaaacatcaaatccctgagaataattaatatcatgctgtatatatttgatgcccaacatggggcatatacatagcgctcacgtttggcgctaaatgtatgacaaaagtttatattttgttacagagcttctttttcttcctcctcctttttataagcaattctgcttgttcattgattgatacttataaaaggttgtcactccatcttctgcgcaatcggccgatactttttctacctattggtaatttatcttttgctattttgatcacacggttctctccaattctgcttatgtgttcgttccgttcattttttctatttagtgtccactgtacgttacattttcttctaaaaatgtcttcactcctctttcnnnnnnnnnnnnnnnttgctgtaattattctcagtactcctatctctagcgtttccagaagtcattatattggtcttccactggctttataaattcttgaagtcatctcagtgtcagtctatttgctttttgtacttcgctttttctgcctgcaatgttgttaggtggatagagagtagcttgatagaactgctgtgtcccaagccgggaaaggtgagaaggggtctacagccaggtagcaccctattgatagactttaaaaccatatagctcatagaaacaggattatgcctcggtaaggaacgatttcattggtacagagcaagcgaaagcattttattccggtttctctatggcttcgattcttctgctgatatcattctggacctggtagttngttattcttgagtttactgatcgcc

SEQ ID NO: 15752 - DNA, 111 bp, Diabrotica virgifera
  misc_feature (2)..(110): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 15753 - DNA, 867 bp, Diabrotica virgifera
  misc_feature (10)..(748): n is a, c, g, or t
  misc_feature (750)..(846): n is a, c, g, or t
  misc_feature (848)..(864): n is a, c, g, or t
gactagttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnaag

SEQ ID NO: 15754 - DNA, 922 bp, Diabrotica virgifera
  misc_feature (606)..(623): n is a, c, g, or t
  misc_feature (832)..(832): n is a, c, g, or t
  misc_feature (840)..(840): n is a, c, g, or t
taagctaacttaggtatcttttagctatcgtataatattgatatgtcaaagagcttataatacggggttggcaaaaaatgaattttatcaggtagatataaatatggcttaattttgcagcgttatggttgaataagattgtgcataaaattaaaacaagtatatagtttgaatgtttatttaataggtgcatcttagttggggtaaactttatttgaaaataatcttaaaattgctgagaatatttatatgttacataaaagaaaacgaatattgagttatattaaaacacattttaattttacaatatctacgaatcaagataatattcagtatttacatcatatttcatcttcagtttcaatctaacttctatatcccctcctcccaactaaattttccgtctactaccagcagcttgactattctttaggcaattatattattctgttcatgttttgtctgtgcgtttcttctgttaacatccacaatagaaaagtaatggattattcggatttagcattaaaaggggcaagttatgaaataaaaaaaccttccagtccagaaaaaacattagcgaagtctctgaaataatatatagggcgnnnnnnnnnnnnnnnnnngtagtgttctctctatttactaatatttttctatgtgaagtagtataattttgattcataaactttctgtaaaccttatattaagaaaaccttatattttggtttgggttagaaagtataaataattgcaagcttaggagatttaactatagccacattgtggtagtatatacgcaaaacatatcaggactgtaaaaatttattttganattccacnagccccgcttctggtgcgatatgcataagtaggtattggaaatttatacttaccgaacatgtacctgggaaataagcaaaaa

SEQ ID NO: 15755 - DNA, 680 bp, Diabrotica virgifera
  misc_feature (100)..(119): n is a, c, g, or t
aaaacatttaaaaataaaaagttcgaaatgtccaaagctgctgcaagattaaaatcactcaaaaaagtaaccgagaaaatacagcatggaaaaattagtnnnnnnnnnnnnnnnnnnnnggcaactgcaggacctccattggggccaatgttgggacagagaggaataaacattgcagctttctgtaaagattttaatgagaaaaccaaagatataaaggaaggtattccactacctacaagaataacagtgaatccagatagaagttatgaacttcaaattaatagacctcctgttgtatattttttaaaacaggcagcgggcattcaaagagctgctatggaaccaggtaaagaaattgctggcagagtcaccttaaaacaagtatacgaaatagctaaaatcaaacaaagtgatccttatctagaaataagacctcttatagacatatgcaatatgatagttggaatagcaaaatcctgtggtattgaagttgtaagaaatttagatgccactgagtacggtgaatttcttaaagaaagaaagttgatagaagagcaacagaagaaggaattacaagaaaagaaagaagcaaaaatgctaagaactggttaaactataataatattaatagatatagctgtgtagtaatgttttgttattaaaattaggtatatttt

SEQ ID NO: 15756 - DNA, 886 bp, Diabrotica virgifera
  misc_feature (805)..(805): n is a, c, g, or t
cgtttactaaacgtaaacgaataaaacaataaaagtacaatgaaaattatttaaataagaacataagtatttcagtatggatcgaccaagtacaagtaagcgaaatgtctttgactccgattcagatagtgtcgacagcactgaagaagctcgccgaagagatctgaaggaaagagatgaattcgcaaataggctcaaaaaacgcgatgaagaacgtactagaaacgttgccagtacttctgataagcgcgcttatgaagaggctgctaaaagacttaaattggacaatgcagaaaaagagaaacttattcctgcactcagagttgcttccaggaggaagtatttggagaagagaaaggaggacaaactacaagaattggaagctgatattgccgatgatgagtacctttttgaggaagatgttttgactgaaagagagaaaaaagatcgtgtacacaagaaagagctgttaaaattggcgcaggaacatgaaaaggccagggaacttgagcgggttcaaaggtatcacatgcccagagatttgggcaaggactccactgctgattacattgaagttgatgacttggagaaggtaccacaatctgaacagaagaaatgggaaaaagatcagatggcctcggcagtgtttaagtttggagcaaaagatgggattaaaaaagaagagtatgagttagtgttagaagatcaaattcagtttatacaagcactacaaatgccaggagtgtctgataagaaagaacccgaactaacggaaacagaaaagaaaaaacttactatagaaganacaaagaaaagccttccgatatacccttttaaagacgacttaatacaggccattagggaacaccaagttttgattatcgaa

SEQ ID NO: 15757 - DNA, 336 bp, Diabrotica virgifera
  misc_feature (2)..(156): n is a, c, g, or t
  misc_feature (159)..(335): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 15758 - DNA, 973 bp, Diabrotica virgifera
  misc_feature (87)..(104): n is a, c, g, or t
  misc_feature (711)..(732): n is a, c, g, or t
  misc_feature (831)..(831): n is a, c, g, or t
  misc_feature (901)..(901): n is a, c, g, or t
agccaataaaaaggctaaagaattagaagcaaagatgaaagacgccaaaggttaccgtgaaaaacaactcaaagaagccgagacggnnnnnnnnnnnnnnnnnncaaaggcagagaagagtagaaacgaatggaagaagcgcgaacaagactatgaaacgttgaatttggaaatttctgaattacgaactggtttggatactgttaaagatcaaatagaagtttgcaagcaaactattgctgaactccagggtcaatatgacgaaatggtcggtggagtttcagaactaaagcaagcggtcaaagcacttcaagctgaagtaaagcaaatacacgcaaaaataaccgaaaacaataaagatattcaaaagaaagacaaagagaaagagaagctgctgcaatcgaataacgatatagaacttaaaattaaagaatggacccatgaattgggcaaattggagcaaaactgcaaaatcgccaaagagagggaaaaagaattttcgaagaagattgatcgtaataatccaaatctaccaaaagcggagaaaatgtctaagaaagaaggtcatgaactggacagtaggattaaaagttacgactctaaaaaacagaaactaggcagagttgttaatacaaaagcccaaattatgtttgaacaagaagaaaaacagtataacgaactacgaaagagagaaaaaatagtagtgcaggnnnnnnnnnnnnnnnnnnnnnncattcaagagatggatactcaaaagaagaattctttaaaattagcatacgaccaagtttccaaggactttggatcgatcttttcaacgcttcttcctgncgcaaacgctagactggtaccgccgcccagaaagacaatcttagaaggtttagaggttaagtctctttangtggagtctggaaagatagtctgactgagctcagtggcgatcagaggtcccttttgcgcatatctctgatcc

SEQ ID NO: 15759 - DNA, 880 bp, Diabrotica virgifera
atattgtacctacttgttgttttagttctaataaattttgttgttttagctaccaataacataaataataatctacagcaaatagattttggcttggaggaagaacaggattttccttatcaagtatccgtccatttgaattataacaaccaatttgtttgtggagcagtagtaatcgctgaagatcaagtacttactttggcgcattgtctttattacgattggggaggtcttttaccgcctataataatatctgttaatagcggcggaaaaatgttaaatactgaagagtatgaatctttttctgtatctgatataagatttcataaagagttcaacacatctgagatgaaatatgatttagccgtgttagatataccagttaagttgatgtcaaaaaactcacccatcattcccataggattacaaagtgattcgatgccttccaggtacgacaactgtatagctattggatggaataacgtttctgctaatcaggaggtaatagatgtgattttgactgattgtaatattgaaacgtctacaaaaatgtgcgcaaaacataaggcgcaaaatgaaactttatgtaacatggttcctggcagtttgttggtatgcagttctacacttgtaggtattatgtccgtagtcccggaatgtgattccaccaaccaaatatctctttttgagagtgctaaacatgctaaagatttattgatatcgtccgctgcatctgtagccgtagggtttccatcaatactaatatggatttacagtattcttacaatacttataaatacttttatacgatgaatgtttaaatcagtttaaatactatgtacctaatatgaataatagatgctgtgaaagcttttttttc

SEQ ID NO: 15760 - DNA, 475 bp, Diabrotica virgifera
  misc_feature (20)..(71): n is a, c, g, or t
  misc_feature (78)..(147): n is a, c, g, or t
  misc_feature (155)..(198): n is a, c, g, or t
  misc_feature (205)..(277): n is a, c, g, or t
  misc_feature (286)..(302): n is a, c, g, or t
  misc_feature (304)..(337): n is a, c, g, or t
  misc_feature (360)..(372): n is a, c, g, or t
  misc_feature (374)..(421): n is a, c, g, or t
ccggggaaaaaataaccccnnnnnnnnnnnnnnnnnnnnnnnnnnnnnnnnnnnnnnnnnnnnnnnnnnnnaagaaannnnnnnnnnnnnnnnnnnnnnnnnnnnnnnnnnnnnnnnnnnnnnnnnnnnnnnnnnnnnnnnnnnnnnggaaaccnnnnnnnnnnnnnnnnnnnnnnnnnnnnnnnnnnnnnnnnnnnnccccggnnnnnnnnnnnnnnnnnnnnnnnnnnnnnnnnnnnnnnnnnnnnnnnnnnnnnnnnnnnnnnnnnnnnnnnnnaaggggggnnnnnnnnnnnnnnnnncnnnnnnnnnnnnnnnnnnnnnnnnnnnnnnnnnnccaaaattttgtggtgtttctcnnnnnnnnnnnnntnnnnnnnnnnnnnnnnnnnnnnnnnnnnnnnnnnnnnnnnnnnnnnnnttctttttgggggggggtgtaatcgcaaggggaattttttttttgggtggggcc

SEQ ID NO: 15761 - DNA, 1011 bp, Diabrotica virgifera
  misc_feature (16)..(924): n is a, c, g, or t
  misc_feature (930)..(1008): n is a, c, g, or t
ctctccactagcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttannnnnnnnnnnnnnnnnnnnnnnnnnnnnnnnnnnnnnnnnnnnnnnnnnnnnnnnnnnnnnnnnnnnnnnnnnnnnnngat

SEQ ID NO: 15762 - DNA, 951 bp, Diabrotica virgifera
  misc_feature (7)..(24): n is a, c, g, or t
  misc_feature (125)..(150): n is a, c, g, or t
  misc_feature (332)..(363): n is a, c, g, or t
  misc_feature (537)..(564): n is a, c, g, or t
  misc_feature (897)..(914): n is a, c, g, or t
gcacacnnnnnnnnnnnnnnnnnnaaggccgtgtcccacgatcaaataatttgatcaaactggtttgagcaaactgaaagtgacagttagtgatgtcacatcctgagtgttcattgtggataatnnnnnnnnnnnnnnnnnnnnnnnnnngtacaaacaagttagacaactcaatacaaaaaatttgatcaaactagactgatagtgagagcacagatttttagaatttcaaaaaaaactgcaattgtgacgtcactttgacgtacttcctcaagtacgtcaagtttgctcaaactgtttgatcaaattatttgatggtgagacgcggcctnnnnnnnnnnnnnnnnnnnnnnnnnnnnnnnnctacatcaggaagtttgaaaaatcatttgatgactcacactgaagaaaatcctctcaaatgtgatttgagagtgcacactgttgaaaaaccatacaaatgtgaaacttgtttaaagcaatttagtcaagcaggtcatttgaaagcacattgaggagtgcacactgggaaaaacnnnnnnnnnnnnnnnnnnnnnnnnnnnngtttactcgggccagttatttgaagaacacttgagaaagacttaagacatgtaaaatttgttttaagttatttgtatgcagtttttccctggactcgtctgatccaaaatatctcggttatcgctgaagcttattgtgtttgcagcccattgttatttcctagacccagatgaggatttttctacccggtagaagtttgtacaggccttttgcttggtatttcttaaatatacccagggtcttgtctttcgttgcccatatagttttttttcttttgcggcccaacgcatcgcaatcatataaaacatgtttttacagtttccgggtttcttnnnnnnnnnnnnnnnnnngcaattcaaaaagaagaatgaataaattggtttggta

SEQ ID NO: 15763 - DNA, 511 bp, Diabrotica virgifera
ggataaatcaaattattagaaggaatacctgcgaaagtccatgtgaatatacgttccagaatgtttagtagcggtagagagattgtgtaacatactgatataaaaccattgtctctgtctgcctcatgtaccagaaaaatatttcagtaaacatctcaaaagtatgatcttattgtaagacttagggaaggagataaggaagaataacatagaatagtctcagctatcacgtatatattgatctttcagttgacatattacatctctatataccaagatgacgatcctcaatgtatagtgtgttagcgataactatgaagtgaaatagttatcgaacgacagacttagctaacgttcgatcaaaacgccaacaatggttacaactaatattgaatcattttctacagatggaggtctcgttattgtcgcaatagaggatcaactggtcctgacttctagactcctagcacacagaatgttgaatagtgcctatagaaaacttttgtcttca

SEQ ID NO: 15764 - DNA, 747 bp, Diabrotica virgifera
  misc_feature (69)..(115): n is a, c, g, or t
  misc_feature (144)..(164): n is a, c, g, or t
  misc_feature (169)..(261): n is a, c, g, or t
  misc_feature (268)..(305): n is a, c, g, or t
  misc_feature (325)..(338): n is a, c, g, or t
  misc_feature (341)..(363): n is a, c, g, or t
  misc_feature (371)..(393): n is a, c, g, or t
  misc_feature (423)..(454): n is a, c, g, or t
  misc_feature (461)..(592): n is a, c, g, or t
cccacgcgtccgaaagactggccgattggcttaccagactttaaatatcccataatatatttactatannnnnnnnnnnnnnnnnnnnnnnnnnnnnnnnnnnnnnnnnnnnnnnctttttttaatcaccccaattaaataaannnnnnnnnnnnnnnnnnnnnccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaaccaaggttacggaccgggggaggggaaggcaaaacttttttaaaagggcccccaaattcaattcccggggccgcgttttaacacggccgggaggggaaaaccccgggggtaccccacttaatccccttggagcaactccccctttccc

SEQ ID NO: 15765 - DNA, 957 bp, Diabrotica virgifera
  misc_feature (19)..(33): n is a, c, g, or t
  misc_feature (446)..(459): n is a, c, g, or t
  misc_feature (461)..(473): n is a, c, g, or t
  misc_feature (579)..(600): n is a, c, g, or t
  misc_feature (876)..(899): n is a, c, g, or t
gactagttctagatatggnnnnnnnnnnnnnnntgggcatcttttcaacaaattgcttagcccccaagaattaagtctctatttactaaaaatcttctttttctttttcgttctccttataaacaattctacttgttcattgacggattcatatctctatgaaaggttgttactctatctttctggagtttcatgtctgttatctgccccgttctcttttctttttagtgtccatacgtttatacactgtacgttacattttcttctactaccttcacttctctttcctataaatatttgttctttcttttgctaaaattgcataggaatattatgccacaatactttgttttattctttttttccgttattgcaaacaatacaatacttaaaaaatattgtttttagtacctgtttagagggaccaatattgaagtacgtgtagnnnnnnnnnnnnnngnnnnnnnnnnnnncgaaatgttaaaaattggttatattgtttatgtaataatgtatatatgtaaggcataactgttaacttgtgttaagtgataactttaaaaagtttgatatttctcnnnnnnnnnnnnnnnnnnnnnntgaactgtaaaaaatacttcttacactgttaaaaattgaactgtatacagtttcctgaactgccaaaccgaaaattgtaatctacagccagggcaagattttgaacatcaatgtacaggatgactcttagagagagcttcacattttgcagaatgttcttgttagatatgttacactgttaaaaaattagctcttgttggaaatgtttgattctttattacaacacaaatattgattccatcctgtatgtatctggtaccattcgaatatacatannnnnnnnnnnnnnnnnnnnnnnntagaatgtttgtatggtccaatatatgttttatatataatttggacgatgtattatac

SEQ ID NO: 15766 - DNA, 744 bp, Diabrotica virgifera
  misc_feature (664)..(686): n is a, c, g, or t
  misc_feature (694)..(743): n is a, c, g, or t
aaaagatccttacgaaaaaatggcgccttcctacaaagttcgttactttaatacgcctggtagggctgaaactattcgaatgatccttagttatggacaaataccttttgaagatgaccgtgttgccagggaggactggccaaaaataaaacctacaacgcctttaggacaacttccaattctagaagttgatggaaaaccaattcctcaaagcactgctatctgcaggtatctggctaacgttacaaatcttgctggtaaagacgcaaaggaaaatcttgctatagatattgctgttgaaacgtttgaagatatgaagaaacctatgggcgaatacatgagagaaagggatgaaagcaaaaaacaagaaaagcttcaaaaattaaaggagacgaatgctttctatctaggaaaactggaggaatacgaaaataaaaacggaggctatattgccttacccaggataacagtggctgacatcatctttattaatatttatgaaaacttggtagatggactaggaaaggattatatgaatccctatccgggattacagaaagttaagcaaaatgttctatcccaacctggaatcagagattggattaaaaatcgaccaaaaacggacaaaaaatatgatttaaaacaagatttgtaaagtatttgnnnnnnnnnnnnnnnnnnnnnnncgtctctnnnnnnnnnnnnnnnnnnnnnnnnnnnnnnnnnnnnnnnnnnnnnnnnnnt

SEQ ID NO: 15767 - DNA, 959 bp, Diabrotica virgifera
  misc_feature (239)..(260): n is a, c, g, or t
  misc_feature (780)..(800): n is a, c, g, or t
cagtgtaccacgaatatatctcagaaactctttagaagactacaacagttcacacagttcttaaaaccatcaattctgcgaagcttcgttgattcgtaaataacgagttctgagaactttatggtttaataagccttgcgaatttgtttattctctttacaggctcagtctagcttgtcgttatacgtaataattcatttaatttaattaacacaaaacaaattaaaagaaaatagagnnnnnnnnnnnnnnnnnnnnnnttcctaaatttcgtgggtggctcgttttctttgacgcgcagtgtatttgaccgagaactattttttaaatagcttgaacggtgctaattcatttgaattttctcattataattttgtgcatttattagtggagtatagacaaataagattttttacttgtcataaaagcagaaggtaaagtctagcaagagaactaaaagactcattaatattcagttcatcgggatgctgttgaaggtgaagttatatgcataagggatcatgccataagacaggtacatcccttgtttatggaatttcactccttaaacgatagcaccctgctaaaagctgaacattaatgagtctcttagttctcttgtttgactataacaattttctttgttatcgaatatttggatctggcatttattatcttaatatctatctttttcacatttttacaaataacacaaattatttacgtaataacacaagttattacatacacttttatacctatataatttctataaatgcnnnnnnnnnnnnnnnnnnnnnacatttaattacatcagtgattcatcatttcattacatcagtgattatttgtgttttgcgaataaacttgatttagcatgttatataagaattttgtattagatatttggtttatatagaaaaaagtccatggtttctcagtgatttgctagaatatat

SEQ ID NO: 15768 - DNA, 596 bp, Diabrotica virgifera
  misc_feature (9)..(28): n is a, c, g, or t
  misc_feature (186)..(204): n is a, c, g, or t
cggacgcgnnnnnnnnnnnnnnnnnnnnaggatcgtagactagatagtgtatttgttttctgtcttaaagagtagtacttgggatagtcataatagagagaaaaaactatagataccacgtagtctcaccgaagtatatatgacaccaactgatattgctcaaacatgaaccctttatcacactannnnnnnnnnnnnnnnnnnggttaaacttaataaacaatattttccactttcataaaccacttagtagtaaaaaaactaacaatctcactctcttataaatatcttcttaccataactatatactttgtgatatctttactcatattctccatatgaattaagtaactatattcaacaccataaactgaccgccttaattaacacaaatccaaagaataactaaatctgaactacatgactcaaattttcgaccctctgatcaaaaactggaaccataagacacctgtattaggaaatatcagccattgatcgcacccaattgagttatattattcctgtaatccccgaacaattggtagatgcaatgcccctgagatgataggaacaattaggaatactaagaaaataaa

SEQ ID NO: 15769 - DNA, 309 bp, Diabrotica virgifera
  misc_feature (2)..(32): n is a, c, g, or t
  misc_feature (43)..(77): n is a, c, g, or t
  misc_feature (255)..(273): n is a, c, g, or t
annnnnnnnnnnnnnnnnnnnnnnnnnnnnnncccttcccacnnnnnnnnnnnnnnnnnnnnnnnnnnnnnnnnnnnccgggcccaccccggtttaaactcaaatcttgtaaaattttaaaacacaaaaacacttaaaaatatagctgctacaccaattataaatttaaatccaacctccaggactcactctttattatcaatttaacctccccaaaaaaattccgctgttctccctaaggtattttattcttannnnnnnnnnnnnnnnnnngccgctcaaaagaacccacttttccgaacccgggtg

SEQ ID NO: 15770 - DNA, 88 bp, Diabrotica virgifera
  misc_feature (10)..(22): n is a, c, g, or t
  misc_feature (24)..(76): n is a, c, g, or t
atttttttcnnnnnnnnnnnnnannnnnnnnnnnnnnnnnnnnnnnnnnnnnnnnnnnnnnnnnnnnnnnnnnnnncataaattattt

SEQ ID NO: 15771 - DNA, 401 bp, Diabrotica virgifera
  misc_feature (243)..(264): n is a, c, g, or t
  misc_feature (326)..(348): n is a, c, g, or t
ctttggtgtcatatctcctaaatttattgtatcatgggtgtagtattgaaaaaactcgtttctgacaaccagtttttccaaatgtttaacctgttacataaatatcagaaacaaacaacaacaaatgacaaaaatgtcgggatcgtcacgtattgacgtcatgcgcagaaccgaacgaatttgaaacactttggtgtcatatctcctaaatttattgtatcatgggtgtagtattgaaattgnnnnnnnnnnnnnnnnnnnnnngttttctatatatacattttatatacgtatttccagtaatgaaggtttttaaaaaattctgnnnnnnnnnnnnnnnnnnnnnnngtttttaacattaatttcaatgttatcggaatttaataaagaatgccattttt

SEQ ID NO: 15772 - DNA, 169 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggttggtttctatct

SEQ ID NO: 15773 - DNA, 610 bp, Diabrotica virgifera
  misc_feature (14)..(34): n is a, c, g, or t
  misc_feature (40)..(78): n is a, c, g, or t
  misc_feature (112)..(135): n is a, c, g, or t
  misc_feature (145)..(168): n is a, c, g, or t
  misc_feature (204)..(225): n is a, c, g, or t
  misc_feature (227)..(239): n is a, c, g, or t
  misc_feature (283)..(330): n is a, c, g, or t
  misc_feature (370)..(404): n is a, c, g, or t
  misc_feature (449)..(481): n is a, c, g, or t
  misc_feature (507)..(525): n is a, c, g, or t
aactaattagagcnnnnnnnnnnnnnnnnnnnnngatagnnnnnnnnnnnnnnnnnnnnnnnnnnnnnnnnnnnnnnnacattcaattttatatatatctatttatttaagnnnnnnnnnnnnnnnnnnnnnnnncattatatcnnnnnnnnnnnnnnnnnnnnnnnngaatcttaaatattttcagggttgagcttaaatacnnnnnnnnnnnnnnnnnnnnnncnnnnnnnnnnnnnccgatcaaaaattttcatattctacaatatgctattatatcctnnnnnnnnnnnnnnnnnnnnnnnnnnnnnnnnnnnnnnnnnnnnnnnngattcatcttatataaatttagtattgatgatcatattannnnnnnnnnnnnnnnnnnnnnnnnnnnnnnnnnncgttcaatataggaattctactacattcttttctcctggatattnnnnnnnnnnnnnnnnnnnnnnnnnnnnnnnnnccccctgcccactgagtaatttgatnnnnnnnnnnnnnnnnnnncgtgctaagctaccatgatccctagtatttttattgcaagctgtcatgagggggttgtaacaaccaaaaactgtcgctattttat

SEQ ID NO: 15774 - DNA, 482 bp, Diabrotica virgifera
  misc_feature (139)..(156): n is a, c, g, or t
  misc_feature (245)..(266): n is a, c, g, or t
gaaagtgctagtcattttaatatctatagaaaaaaaaaaagattttgttgaatttttgtatgaagcagctctgaaaacactaaaaatggtgttaaaaagaactataattagtgttattgatcgccccatgaggggatcnnnnnnnnnnnnnnnnnnaaaatacttactctatctcccaacgtgcactcagctttggcgacaatatctatatcgaaacatgatcaaagtgcctgtgtctttttgannnnnnnnnnnnnnnnnnnnnncgactattctccaatattcgtaaaaaccaaatgtaaatttatttagtacatatatatctataattaactatctaaccattattagtaccgcatattactaaggttgatcttcaaatgtaatttttatttaattccaatatgaaattaagaatctcaccacgatgcacattcagacataagacatccgttgaaagcaattttgatacattatcattc

SEQ ID NO: 15775 - DNA, 851 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (801)..(844): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgagatcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaannnnnnnnnnnnnnnnnnnnnnnnnnnnnnnnnnnnnnnnnnnnctcatcc

SEQ ID NO: 15776 - DNA, 109 bp, Diabrotica virgifera
  misc_feature (24)..(24): n is a, c, g, or t
  misc_feature (71)..(71): n is a, c, g, or t
  misc_feature (80)..(102): n is a, c, g, or t
taacagcgtaattttattggagangtcaaatcgataataaagattgcgacctcgatggtggattaaagttnataattggnnnnnnnnnnnnnnnnnnnnnnntggtcga

SEQ ID NO: 15777 - DNA, 572 bp, Diabrotica virgifera
cctacgcgccgccgcgtcgaagagatgatggagaaaatgcctttttagtggaaggagagagatttgctgttccagaatgtacagcagcagcagtgagaggggtatgaactaccgtgaatagaacctctgtctcgtgtgaaatcggtgtagaacatcaacaaagtacagcaccacatcaaaatgattataggattgaatgacgctaggggtgaaaggtaactaaaataaatgcaccccattggtgatcgaatctaggaatctggagttgttcaagtgaaaatattccctataatgtaagaggctcaaaatccagaatgtgctataagttcagacagaggacaaagtggagctgttatcgacagagtatctcgtaacctgtcggaccgaattgggcaataatagatccaactaataattgagcatcgtatcggatataaatctcgttcaatctggcaacggagctatgtgataaccgttatgctggtctggatagaaggagcgcgttagacccccactagcaactttgctctcacaatgagatgatggtgtgtggccatgggatgacaggtgca

SEQ ID NO: 15778 - DNA, 65 bp, Diabrotica virgifera
  misc_feature (3)..(38): n is a, c, g, or t
  misc_feature (46)..(64): n is a, c, g, or t
ggnnnnnnnnnnnnnnnnnnnnnnnnnnnnnnnnnnnngggggggnnnnnnnnnnnnnnnnnnnc

SEQ ID NO: 15779 - DNA, 895 bp, Diabrotica virgifera
  misc_feature (124)..(142): n is a, c, g, or t
  misc_feature (767)..(767): n is a, c, g, or t
  misc_feature (831)..(831): n is a, c, g, or t
gtgataccgtgagtaacacaatgaaaagcgtcgcttgaagctgattgaagggcagtcgagtgttgtgttagctcttaaataaaaagagagccgcggattaatctcacttttatttaaatcctcnnnnnnnnnnnnnnnnnnntattacgactaataccattgtgtatcagagtgaaagtgggcgaagttgtggagaaagtgttttttctgtatttctgattgattaatatggatgtgacggaatttagggagttcggaaaagctgcggtggattatattgcggactacattgagaccattcgtgagagacccgtattaccatcagtacagcctggctacttaggagaactactacctaaagaagctccacaaactggagaacattggcaagatgttctgcaggacgtggacagaatcatcatgccaggcctcactcactggcactctccaagatttcacgctttctaccccactgcaaattcatttccagctgttgttggggaaatgttaagtgcaggattcggatgcgttggattaagctggattgcaagtccagcatacacggaattagaagttgtaatgatgaactggctcggaaaattaatagatcttccagaagaatttcttaattgttctgaaggacctggaggaggaattattcagggatcggctagtgaggtcacctttattggtcttctagcggccaaagagaaaaaagtcaaagatttaatggagaaaaatcccaacctaaaagaagccgatattanaggaaaactgatagcgtatacatcggaccagtccaattcctctgtcgaaagtccggattattgngatcaatgccaatgcggcttataccttctaatgaaaggggtcaactaacagcaactgcccttct

SEQ ID NO: 15780 - DNA, 926 bp, Diabrotica virgifera
  misc_feature (573)..(593): n is a, c, g, or t
  misc_feature (897)..(897): n is a, c, g, or t
ggaagtttcgagctttctagcatttgctaggaaacataaaataggtgtttttgtacttactttactaggatttttaattgttatgcttaatacccaagtacatccttatttattggcagataatagacattacctgttttatatttggaacagattttatcagaaatatgttttgtttaaatatgccatcgtaccagtgtacatatttgcgtggtatgttattatcaaattgctttatgacaaagatgatataacatttttattcttgtacttagtttgtacaacgatagtattagttactcagaaattgatagaaattcgctacttccttataccgtacatacttttcagactgagattaaaaagcaatgccaataatgcatttaatttagttttagaatttgtaacttatttgttaattaattatataactttacaattgttctttaccaaagttgttacttgggatgattattctgagtttcaaagaataatctggtaagtgtagacaagaatacagtcctgaagtaaagtatttattaatgctatgagatgacaaataaaataccaagnnnnnnnnnnnnnnnnnnnnncacaataagcataccagcccactctagaaatgaaacatgattttcacggttttcacattatctgacaattctaagtcataaggggacatagataaagaaaactgcatatctgggtactattagcaaaaatctgggtactattatactcaataactacattttcgaactttggccttaacgcactcctacaccaatttaagttacgcagacacactgtataaaataattttgtattataaagaaataaggttcaataacggcccaatagctaaaatatgcacacaaggtcttactcatgggtganaatgaaaacaaatgttcttatatctcatg

SEQ ID NO: 15781 - DNA, 850 bp, Diabrotica virgifera
caaagtggttgataagttttataaaaatgtacaagtacctcctttttgtctcccttattggattaagcacatgtttccccggcatcattgactctggacatggtctcagctcatggaatggtggcggcgcagattggcaaaaggctttggctagtgtaggaatcggtgctagtctgggccactcccctggattagatgatggtcatggccagggatcccctgacggttcaatcggtggtgatttccatcacggagtgagcgtggttagtactggaggcggaaacaaaggagctgtattcgatttaaccaatcaaggtacgtaatataattattataaactactgttgtctaccgcgtggaccaatacaaatatcttggctgctggttaaacaataaacttaattataaacaagaagtatatagcgagaatagcggtagcccgacgaggctttatcgaaatgaaaagcttattttgtaacagtagcattaatatcagtcttagatgtcgttttctgcaaagctatgtatggtcaatactgttgtatggaacatacaacatgaaaccctttgactctggctttatactcgtagaaggatcttgaaaatatcttcgaaacctacactaccaacgaaaatctactgagaagaatatgtacagatggggagctgctgaacctaggacgcataatgagaaaccaaaagtaccgcctcgcgcaactgatcatccaggggaaaattgaaggaaaacgtttgaagggagaatgagggaaccacggtgaaattagatctagaattgagcaggctagagccgtccctagaaggatgtccaaagtattatacttttgggaca

SEQ ID NO: 15782 - DNA, 924 bp, Diabrotica virgifera
  misc_feature (143)..(155): n is a, c, g, or t
  misc_feature (158)..(171): n is a, c, g, or t
  misc_feature (184)..(203): n is a, c, g, or t
  misc_feature (855)..(855): n is a, c, g, or t
  misc_feature (870)..(870): n is a, c, g, or t
atatctcctggcatcaatcggtagtggtggaactttgataggacgtgggtatcgatgcgcgctcggtacctaatatttacttttacagaaattgatagatcaaaactaattaatgtagggcagtaaatacttagagagtatannnnnnnnnnnnnagnnnnnnnnnnnnnnatatttttcctgnnnnnnnnnnnnnnnnnnnnggtatagtctccttttagcgcattacaacgattctagcgattttcgaacttctttggccgtccgaagaatacgattctggaaactctgcaaaatatgtgtttgtttcttcaattatctctagatgaatttttttacgagtcatctgatttggcaacacataataatcagaggggtccaaatctggagaataagccgtacgagaaagcaattcgaaccccaactcacgaatttttgccattgtcataacattcttgtgagtcggtccattgccttggagaaacaacactttcttttcatatgtggccgtttcttactgagttcctgcttcagtttgtccaataatgctcaataatattggcttttgatagttttacctttttaaagattgtcaattaaatgcaatcccaaaatagagtggccataacgttttgagcacttttgccggcttcagtccactgccgtgcgttcattcttttctctagtgtgtgtagtagtggatccaggtttcatcaacggttaccaatcaacgccaaaagtctgattgatttagtttcataaggtccaaacacggcaccctgtacaggattatcagcatccaaaataagaactaccacccttagggtgacggaacataccagatatattagatantataatttctctgcnaggataattttttcatattcaaaacttccttccaaagatgaatactcctttact

SEQ ID NO: 15783 - DNA, 843 bp, Diabrotica virgifera
  misc_feature (435)..(452): n is a, c, g, or t
  misc_feature (612)..(633): n is a, c, g, or t
  misc_feature (787)..(787): n is a, c, g, or t
aggatacggctatgatggctacagccaaggttatgactactacggcagtggctatgggggttatggaggttatgattactcaaactatggcggcggtggccgaggcggctacggaaaccaaggaaactggaaccaagcctatggtggctacggttatggccaaggatacggctatgatggctacagccaaggttatgactactacggcagtggctatgggggttatggaggttatgattactcaaactatggcggcggtaactacggtaaatacacccacaggacacattaataaactttttactcccaaccgagatgttgttaatatctcgagtggtgccttgtaagctcggtgtatatgtcaagtgataactgtgtcagggttggctgtaggaaacttgttaccaactatacaaaaacgttatttttggccannnnnnnnnnnnnnnnnntaaacctggttgttctacaataccttgttaaattttaattttcgatggcatgactgttggtatttttcagtttcctacagctaacccattcttagttctacacacaggaaggtcatatataacaagtgtgatattcacactagagactatgtggtcttgnnnnnnnnnnnnnnnnnnnnnnggacatatttacactaagtcgacagttgttctgttcctatacataaattatatgttgacctttatacatatatttaatagtatggaagaagatacattgtgaaaatatctagagcttgaaataaagcatttgttgaaattctacattccctctnaatataccagggaattgacatagttgcaaatatagaatattaactttaagaagcgg

SEQ ID NO: 15784 - DNA, 903 bp, Diabrotica virgifera
  misc_feature (821)..(821): n is a, c, g, or t
ggaaagcagtgaatgtgcattttattagttgaattaatcacaaatattcattactcttgattaaaaatcaaaatatgggttcaattagagtaataactgatgaaacacattttcaaactgaattaacaaatgctgccactagacttgtagtcgtagattttactgcaacctggtgtggaccatgccaaaggatagctccaattttccaacagctagctgcaaaatatcccaaagctgtgtttctaaaagtagatgttgatcagtgccaggaaacagcagctgcccaaggtgtttcagctatgccaacctttattttttatcgtaataggactaaagttgatcgcttacaaggagctgaccctacaggccttgaaaataaaattcaacaatactatggatcagatgattcagaagaaggggaaagtgtggccggacacatggacttgtcaccatttattaccaaagctgaatgtgaatgtttgaatgaaagtgatgaacatccttttacccattgcctaacctctggaggtggcttttttgcaatctgattgtgatgaacagctgataatctccattgcattcaatcagtccgtcaaaatacatagtttgaaaattaaagcaccagcagataaaggtcccaaaaccataagaatttttattaatcaaccaagaacgttagattttgatttggcagatagttatactagtgttcaagacttgcagtttactcctgaagatgtcgaaggagggaatccagtaaacttgagatacgtgaagtttcaaaacgtccaaaatattcaattctttataaaagataatcnttggggggaggtgaagtaactcaaatcgatcatttagctataatcggatcaccgataagtacaactaatatgggcgatttca

SEQ ID NO: 15785 - DNA, 932 bp, Diabrotica virgifera
  misc_feature (808)..(828): n is a, c, g, or t
ccacagaaaaataaaattaactcattgtcgtttagtatgtctgacttcttacttacaggacttttaattctctactattatgacttcgcatcgcgcaatgctgttgtcgctattagatgcagttctgttaggaattggtctgaccgcagacgacagtgtcgctgcagtctgtggtttgcggtctgcagtctgcagtcactttcggaatcataccttacaggtgagaaggtgatgtgttggattcagttgtattagactaacccagtttgcatataattggcaactacctactactcgttgccaaataccatttaaatgcactttaattattctgtggtgcatcagctctaacttgttgatattgttttagaacatgtttttgtagcatctttagaatttcttactgtattttgtcacttttggcaacactctattatggatgcatgaataatagaatattatagatctgggttgtagttttaacaatgaatacatctgccgttttgttaattttggaatattttgaatgttcttagctctggacagcagctaacaatatttagattgtcaacacgtcctaacaaggtctcaagaaatgaggagaagttatttaaatgaaaattccacaacctactgtaattacgattttcctcggtgcagtatatattgttcgtcccctataactttttcacagttcattttcaaacaaatgggtcaaaacataaagtgaaacgaacgtcgatgagcatatacattttgtatactatatactacaaacatgggcgtatgtttcactttatgctttgannnnnnnnnnnnnnnnnnnnnatcgggacgcatgggaaaagttatagcggaacgaaccaatataatgggcccgttaatagggtggccccttttggggcttaaaaaattattcttccctatttttt

SEQ ID NO: 15786 - DNA, 225 bp, Diabrotica virgifera
  misc_feature (2)..(58): n is a, c, g, or t
  misc_feature (70)..(125): n is a, c, g, or t
  misc_feature (157)..(195): n is a, c, g, or t
  misc_feature (198)..(210): n is a, c, g, or t
cnnnnnnnnnnnnnnnnnnnnnnnnnnnnnnnnnnnnnnnnnnnnnnnnnnnnnnnnncattttttcacnnnnnnnnnnnnnnnnnnnnnnnnnnnnnnnnnnnnnnnnnnnnnnnnnnnnnnnncattatttatatcataaattattttattgccnnnnnnnnnnnnnnnnnnnnnnnnnnnnnnnnnnnnnnnacnnnnnnnnnnnnntcccacttttttgat

SEQ ID NO: 15787 - DNA, 872 bp, Diabrotica virgifera
aatgaacagtttgcacagtgtacaatatcaagttggttttaaaatttcccgtttttgctttgaagtccaatagactttgctgttaaagtctgaagataacaaacaattgataaaatttgacagattaagaaaccatgggaaaatcggaagtccagtctctaccaatacatcgtcctgaaccaaaccttatttgtgtaccggccccttgtaaaatcttacaaaataactgtgtgaacggtttagaaaaactagacttgggagaagaactcgaaaacgtcgttgaagaggaagacaaaaccgtggcaataccagagggttacgaaatatataaacatcaaatggctggacatatggataaaggggataatattgggatattgaaggaagatggaatgatattaaaaccagtgataaaaccagaaaacggcgagagggagatcactttttatcaaaacctttccaacacattagataaaaccattttagagctacgaaacttcgtaccaaaatattatggaactaggtgtttagctgtaaatggaaaaacatacgaatttattgttctcgaagatctgatcagagactttaaagaaccttgtgtaatggatattaaaataggcagaaggacttgggatccaacctccacatatgaaaaaatttgttcggaagagagaaaatatcaagactgtaaacgagatctagggttctgtatccctggttttcaagtgtataaattagcaaatagccaattagttaagtacgataaggaatttggaaaaggtctaaacaaagacagagctgaagatgcaatcaagactttcctgaacatggatggcaacagagtatgccgaagtcttatagttcaatttctg

SEQ ID NO: 15788 - DNA, 838 bp, Diabrotica virgifera
  misc_feature (661)..(691): n is a, c, g, or t
cttgtacctcattgccatgaacgaaaagatcaacatatcggccaccatcagtccacaatataggaaaaagtcgttactcttcttctcaaaaatttccatggattctataataacaataattaagtttccaaatgcagtggtcaataaaaagcaagcttgcagtaaagacttcattgatgccggggcttgagagtacgaaaactctaatccagtgatggaaaacataatctctgcagcgaatggcttgtggaggacttttagcagctgtcgcttttgccgtttctgcatttgtcaccatggctattgaaaaaaatgatccagtgttgccatcagctggtaacttacaattaagggtgtataatccgtcaaactgtcagatgtctttaagcaccgatgtaacagaaataaagtcattttccttggatccaatatcttcatatgtgatgacggatattgactggagtggaaataaatctgtaacgtttacatttgaatctaatagtaaagaatgcccaggtggtcaagaaacgtttgatctattagaaaagaatgcctatggtgtttttatccaatcaaatgggacgatccgcttttataaagatgacgttgctaagagtaaaaatggttatcctttagtgagaacgctaccttatactgacannnnnnnnnnnnnnnnnnnnnnnnnnnnnnnaattaatatcaactcaggaaacacttctgcaaaagaattttccagtcctggtcattggtcaataaatgtaggaaagaaacaatttaacaaaactgtaaacttggaacttggtgggacatatgccggaatgttaataaaaaccaaatg

SEQ ID NO: 15789 - DNA, 884 bp, Diabrotica virgifera
  misc_feature (173)..(192): n is a, c, g, or t
  misc_feature (397)..(463): n is a, c, g, or t
  misc_feature (724)..(862): n is a, c, g, or t
catttatttcaagcaaagttaaaactaaaactattaaattttaaaacttcttggatttttgtgcaaaattggttttaatatcatctttttaaaaggaaacaatggaaggggtgtccacacccagcgctgaaggaccgccagaggaaacagttaagcctgttggttgttgccannnnnnnnnnnnnnnnnnnnttgtgactccatgctgcaagaaagtgtacacctgcagattttgtcatgacgaaaatgaaaaccataagttgattagaaaagaagtaactgagctgatatgtgctttgtgtgaaacaaagcaaagagtccaaagctcttgtcaaaactgtggggtagcttttgggaagtatatatgcctagaatgtaatttatttgatgatgaagnnnnnnnnnnnnnnnnnnnnnnnnnnnnnnnnnnnnnnnnnnnnnnnnnnnnnnnnnnnnnnnnnnnttgtgagaagtgcaatatgtgccttccaaaccaaattgaaagtggacataagtgtgtagaaaacgtctccagatccaactgtcctatatgcctagatgacatccatacatccagaatagcgtgtcatataccaccatgcggtcaccttctacacagaccttgttttgaatctcttttatctaatggcctctatgcgtgtcctatctgtcagacgtcattaatgaatatgcagccattgtggaagtactgggacgtggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataaaggacctgttactata

SEQ ID NO: 15790 - DNA, 267 bp, Diabrotica virgifera
  misc_feature (5)..(45): n is a, c, g, or t
  misc_feature (51)..(73): n is a, c, g, or t
tatannnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 15791 - DNA, 716 bp, Diabrotica virgifera
  misc_feature (2)..(685): n is a, c, g, or t
  misc_feature (692)..(715): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnt

SEQ ID NO: 15792 - DNA, 89 bp, Diabrotica virgifera
  misc_feature (2)..(69): n is a, c, g, or t
gnnnnnnnnnnnnnnnnnnnnnnnnnnnnnnnnnnnnnnnnnnnnnnnnnnnnnnnnnnnnnnnnnnnnggttataatattatttttat

SEQ ID NO: 15793 - DNA, 836 bp, Diabrotica virgifera
  misc_feature (121)..(142): n is a, c, g, or t
  misc_feature (282)..(330): n is a, c, g, or t
  misc_feature (493)..(511): n is a, c, g, or t
  misc_feature (803)..(803): n is a, c, g, or t
gatgataatattggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatccaaatcctggtaaaattanaatatatacttcaggatgaccaaaaaatcaaaa

SEQ ID NO: 15794 - DNA, 622 bp, Diabrotica virgifera
cgggcccttccccccgcccccgcacttttccaggttgtgacaaattttttagaaacattaaacaagagttttcgtccatgattagcaatgagtattgctcgagaagcttggaaccctattacatacgaagtcattgtgtgatccttgtcctgagggggattttaccttgtaatgatttattccttatctatgtggtgtctacatctgccatcgtaccagggttcttgtaggacaaatatgctgaagtctttttgtgtgatgagaaggaatacctgaggtgcttactctaatatttcaagtggaccattgaaattgatctattagacatatattgatacaaactcaccattaaattatcagaataatacattgcgaagggtgagcctaacgcaaagccattaatagatcgtacccttccaggtagaatttgcagactaacgagtttattatttcacaatatctaataaggtgccgttacatatcaagatactgagcttgattatgctctacgtcaaagaataaattggagatatgtatttaaaaatgagacgataatatacagtatagaaaattgcttacttattacaaataaaatacgcaaatattggatcccggtgacatg

SEQ ID NO: 15795 - DNA, 918 bp, Diabrotica virgifera
  misc_feature (755)..(755): n is a, c, g, or t
  misc_feature (832)..(832): n is a, c, g, or t
  misc_feature (838)..(839): n is a, c, g, or t
cccacgcgtccgtaagtatttaagcaaataaaccatattttattgggtgtgtaatttgtttgaattaaataaaacattatttagagtaagcaacagaaacccggtcacctaagatttggcaatattgattattttgtgaaaatgtcgatttttattccaaagaggatattttttgattatacaggcatctgtcatttgtcaacccctttcattccggtttcagaccctttaaattttaaataaggaatgttttttctttccatattaaaaatatatcaccccttaaaaaatttaaaagcaacgcctacgtttcgctaaaatggcattttttttctgtcttatcgaaaaatgcatttgtaataaaatatttgcaactttatataagaaacgatcgaaatctgtctaaagacatttttacatattattaaaggtttaaaatgttataatgctccacctctcgtgtaacgccagaattgattagttcattttctttatgttgtgctaaaaattgtttcgcacgctttagctaatagtcgtaattaaaatatacttttgagaagaaaaactgtttatgtcaacgctttttagacatttattttaaataattctagtcactgatcctctaatgtcctatttccgctatttgtattataatcaaaaatattctgtataaatattatatgtatagtattaatctaaaaaatgttggcaatattcttcactaagaatggagaatacttcatgactttaactanaagtttactctgtcaaaactagcaaagtttttgttacatcacaaattatttggtattcagttttgccgaataattanacatgnntagcaatacactgtttcaaaatctaatataatatttatgactcaaaatatttataaatggaaaaatacagtattagttc

SEQ ID NO: 15796 - DNA, 65 bp, Diabrotica virgifera
  misc_feature (6)..(41): n is a, c, g, or t
  misc_feature (48)..(48): n is a, c, g, or t
aaagcnnnnnnnnnnnnnnnnnnnnnnnnnnnnnnnnnnnngtttatnaaattattaataagttt

SEQ ID NO: 15797 - DNA, 835 bp, Diabrotica virgifera
  misc_feature (128)..(147): n is a, c, g, or t
  misc_feature (234)..(252): n is a, c, g, or t
  misc_feature (331)..(349): n is a, c, g, or t
  misc_feature (795)..(831): n is a, c, g, or t
cccgatcgcccgttcgctcatatgcgcttcattaacaattaaaaaaagacaatattttagaataaaacgtgccaaaaattcttacaggtatctgatggaaggtctgatcttgaatttaggtactttgnnnnnnnnnnnnnnnnnnnncttacttgtgtttttgaacctggaaaatcgtccatttttcgtttttttttcagttttaaattgtttataattcgaagacgattgacnnnnnnnnnnnnnnnnnnnggaccttttttgttcccaatgatccaaagaacctaaagtaatgtctacccgggccgaaaaaatagattttttaaaatcnnnnnnnnnnnnnnnnnnnataaatgtggcaataactccgaaattgtggcatttaggtgtggggaatgtcatgtgaggaatgaccagtatctcttaaggattccaaaactcagggggtatatggggtgttctatttgaaataagaaagttcgttggattttcggaaaaacggaagctttgacaacaatgtaattaccactataatatcggccgcattggaggacccttgcccaccaaaatctataaaattggttctagcggtttccgagaaagtgacgtgttgctagactttctcgctaccctgtataaactggggtagtatttggataatagaaaagaagtaattcagctaaagtggccataatacaataaatatagtcaaaatcatcaataaaacaaactgaataagaaatgaaactagagaaaaacaggcaaaagtgtttttaacattggattaaccgagannnnnnnnnnnnnnnnnnnnnnnnnnnnnnnnnnnnnctgc

SEQ ID NO: 15798 - DNA, 924 bp, Diabrotica virgifera
  misc_feature (28)..(44): n is a, c, g, or t
  misc_feature (47)..(63): n is a, c, g, or t
  misc_feature (391)..(410): n is a, c, g, or t
gcattacgctataattactatttctgcnnnnnnnnnnnnnnnnncannnnnnnnnnnnnnnnnctcaaaatcgaaacgacgttggaaaaacggaatgtatccttcaccatctgtttttcgtttgtgcggtgtaacaaactgcaccctcataaattaagtactatatcagacaattgtgtcaacaactcactaatgcattcaagggcgttttcttaaaactgcaaaagtatacgccagacctaaatgatttattgtcatctggtcagagggaagaaacataaacagattatcgttgtggttttctttttagtcacgacacagctggtgaacggttcacacaccaatcgttcggcccttttccgaaacctaagcgcaatacctttttgtaccnnnnnnnnnnnnnnnnnnnncgttcgttttattacattcatttcaattaattccgtcaacatcaccaccggaatatgttctcaaaatctatacaataaaattggtttaattgttttgaaactattaaaactgatcgaattcttttctgtttcaggagaccaagtactttaagaggatcacgctgttcacttcaacagactggaggggcacaaggtgcctttgctttccacttcggacccacaaagcacgaggctagctccgtccggctctagtccagatatggacgatggaggcaaacgacaagccaccagggtgttcaagaagagttccccgaatggaaagattacagtatatttaggtaaaagagatttcgtcgaccacatatcatgcgttgatcctatagatggcgttgtattaatagatcccgattatgtaaaagacagaagagtatttggacatgtactcgccgcatttaggtacggtagaagaagatctcgatgtcctaggcttaacatttcgcaaggacctctactt

SEQ ID NO: 15799 - DNA, 825 bp, Diabrotica virgifera
  misc_feature (750)..(775): n is a, c, g, or t
aatatgaagtgcatgtttttttgtgttcaaatgttgtgttcctttaaacgatttttaaatggtttgtctgtttgtccgatataaatatcctaacattttcagtaagttaatttataaatcctaaaagtgatttctgtcgtgctgaagattatgagaaaacgagataaagaattattgtattgtataatttttgctttatatattttctattatacatattttgtataaactaaaatgtaacaggaattgtgcaaaatattctaaatcccgtctcgacaaaatgagcatcagactataaaactcggtttttccgcaagaaaaaacccacacattgtaaatttatctcaacattcgacccttaatcgtcaatttttaacgatttgcaatttggtggtcaaaaaaaatagtaggtattttatgacgtgtggtcttcccaagagatattaaaaaaattgcatctgcacagatgaaacgttttcaaacacacatacgaagagactattaccaaattttagtactaacaatttcataaaataataaaaaaccgataaagaaatgtttgcatcgaattctgactgtctaaatttacatcggacaaacataatgaatctttaaaacgattaaaaaagcgctagacatcctttaaacacaaaaacgtcagaatccacttttattatggtaaaaaacagcctaacaatgaatttaatgcatactggtaaatctgtcgacatactaatatagattcgaaannnnnnnnnnnnnnnnnnnnnnnnnngttgcaaacaaaaattttatcgcttttatgaaacgtttgatattcaatat

SEQ ID NO: 15800 - DNA, 442 bp, Diabrotica virgifera
  misc_feature (2)..(380): n is a, c, g, or t
  misc_feature (390)..(428): n is a, c, g, or t
  misc_feature (434)..(434): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcnnnnnnnnnnnnnnnnnnnnnnnnnnnnnnnnnnnnnnnttatanattattaa

SEQ ID NO: 15801 - DNA, 904 bp, Diabrotica virgifera
  misc_feature (477)..(495): n is a, c, g, or t
  misc_feature (817)..(817): n is a, c, g, or t
  misc_feature (822)..(822): n is a, c, g, or t
gatcctgtaaggtactgaatatttagggtggagatcttttaaggtgaaattattgatgaaacggctctgaaaaagattgtactaaattttgaaaagagaagcttaaaaaacagagagatgaggattaaatttccagattctcctgaaaagtttttggaaagtgaagtagaattacatgaaattcttcaagaaatgcgaatattggcaaccgcacctgattattatccattgttaatcaaacttcaagttatacccagtttacttgaattgctgtcccatgacaatacagatatagcagttgccactgtagaactcctccaagaacttacagatgtggatagtctgaacgaatcagaagaaggtacggaggctttaatagaatctttactagatcatcaaataatcgccttactagttcaaaatttagaacgtcttgatgaaactgtaaaagaagaagcagatggtgttcataacacnnnnnnnnnnnnnnnnnnnttgactgaattgagctcagaaattataaacgaagccacaaaacagggacttttagcttggttacttaaacgactgaaattgaagactccttttgatcccaataagctctatgtttgtgaaattttgtctatattattacaaaataacgaaaaaaatagattggcactcggagatacggacggtattgatactctattgcaacaactggccttttataaaagacacgatcctaccagttctgaagagcatgaactaatggaaaacttatttgactgtttatgtagtgcattaatggtatttccaaatagagaacgatttttanaaggngaaggcttacagctaatgaatctgatgttaagagaaaagaaacctccagaaatggctccctaaaagtataagattacgctat

SEQ ID NO: 15802 - DNA, 62 bp, Diabrotica virgifera
  misc_feature (5)..(61): n is a, c, g, or t
gaagnnnnnnnnnnnnnnnnnnnnnnnnnnnnnnnnnnnnnnnnnnnnnnnnnnnnnnnnng

SEQ ID NO: 15803 - DNA, 85 bp, Diabrotica virgifera
  misc_feature (6)..(75): n is a, c, g, or t
  misc_feature (80)..(81): n is a, c, g, or t
aaagcnnnnnnnnnnnnnnnnnnnnnnnnnnnnnnnnnnnnnnnnnnnnnnnnnnnnnnnnnnnnnnnnnnnnnnaattnnatta

SEQ ID NO: 15804 - DNA, 608 bp, Diabrotica virgifera
atgtagggaaaggtctactgatgtatgtattgatttatagttaaagagagtgaattgtcgaggtagatgacagcttcttgagatatctacatatgccctaggacgattgtcggctgctaatgcaggtcactctgttttatacgattcatatattccctatcctgaagttcacaatggcgtatccgctttcgttgttgatttcgcaaccttctgataaggagggagcagatcctcgatccagcacttcgtccgatactagacagaatatttataaatttagtattctctactctgatcattatacaggcgtcttgtttatatagattctactagttctccttggggatgagcacagcatatctaggtacttatatctgtactcccttctgccgacagttgtctgccagctgcctacagagctgcgatcttgatgatatcagctgctgagtgcctcacctgctacttgtagtattgatgaactaagtaactaatgcttaagatgacgatcgactataacatagccggagctgataatagtcctagcagagccagcgaacaaacgaatgcatgttcagtcaatggtgcgtgactgatgtcgtctgagtgac

SEQ ID NO: 15805 - DNA, 896 bp, Diabrotica virgifera
  misc_feature (759)..(790): n is a, c, g, or t
  misc_feature (806)..(806): n is a, c, g, or t
  misc_feature (864)..(864): n is a, c, g, or t
cccgtcctttagtgattattctgggtgccacaggttctggaaaaacaaaattatctttagaattggccaagaaattttgcggtgaaataattggtgctgattctatgcaagtgtataaaggtcttgatattattactgctaaagctacaaaagaagaacagtctgtggctccacatcacctgatagatattctggatccacaagagatgtacactgttgttcagtatagaaatagagctttaagcgttatagattctttgtttaataataacaagcttcctgttgtagttggaggtaccaactattatatagaatctctcttatggaagatcctgatagatgatggagattttcagaaagtgggaagtcaattatcaaataatgatcatgagttatcaagtgaagaattgcacaagaaactgaagttattggatccactaatggcaaaaaggcttcatccaaatcacaaaaggaagattctaaggtctctagaaatattgcataagaaaggaaaaaagcacagtgaacttcttgaggaacaacaaagtgctaaggatagttcaaaatcagggggaggtcttcgttttacaaattctttagttttatggcttcagtgtgatcaggaagtgttagaccaaagattgaatgatagagtggatggtatgttgaagcaaggacttttaacagaactacttgaatttcataaagtgtacaatcagcaaagactactaaccaatgacacacctgactacagtaaannnnnnnnnnnnnnnnnnnnnnnnnnnnnnnnccacccgtacctgatnttgagcaaagaagaacaagagtcggatgaaggaaagaagaaactgaatgaaggcattngacagctgaaaatggtgacaaggagatatgct

SEQ ID NO: 15806 - DNA, 304 bp, Diabrotica virgifera
  misc_feature (6)..(28): n is a, c, g, or t
  misc_feature (219)..(300): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnnnnnnnnntaaa

SEQ ID NO: 15807 - DNA, 58 bp, Diabrotica virgifera
  misc_feature (6)..(46): n is a, c, g, or t
ggtgannnnnnnnnnnnnnnnnnnnnnnnnnnnnnnnnnnnnnnnnataattttttga

SEQ ID NO: 15808 - DNA, 68 bp, Diabrotica virgifera; identical to SEQ ID NO: 12374
  misc_feature (2)..(17): n is a, c, g, or t
  misc_feature (19)..(67): n is a, c, g, or t

SEQ ID NO: 15809 - DNA, 566 bp, Diabrotica virgifera
  misc_feature (12)..(14): n is a, c, g, or t
  misc_feature (17)..(17): n is a, c, g, or t
  misc_feature (21)..(21): n is a, c, g, or t
  misc_feature (25)..(25): n is a, c, g, or t
  misc_feature (28)..(28): n is a, c, g, or t
  misc_feature (31)..(32): n is a, c, g, or t
  misc_feature (35)..(36): n is a, c, g, or t
  misc_feature (41)..(41): n is a, c, g, or t
  misc_feature (53)..(53): n is a, c, g, or t
  misc_feature (68)..(68): n is a, c, g, or t
  misc_feature (72)..(72): n is a, c, g, or t
  misc_feature (74)..(74): n is a, c, g, or t
  misc_feature (77)..(78): n is a, c, g, or t
  misc_feature (87)..(87): n is a, c, g, or t
  misc_feature (98)..(99): n is a, c, g, or t
  misc_feature (109)..(110): n is a, c, g, or t
  misc_feature (125)..(125): n is a, c, g, or t
  misc_feature (128)..(128): n is a, c, g, or t
  misc_feature (130)..(130): n is a, c, g, or t
  misc_feature (138)..(138): n is a, c, g, or t
  misc_feature (146)..(146): n is a, c, g, or t
  misc_feature (149)..(152): n is a, c, g, or t
  misc_feature (154)..(155): n is a, c, g, or t
  misc_feature (160)..(161): n is a, c, g, or t
  misc_feature (164)..(165): n is a, c, g, or t
  misc_feature (173)..(173): n is a, c, g, or t
  misc_feature (175)..(175): n is a, c, g, or t
  misc_feature (179)..(180): n is a, c, g, or t
  misc_feature (182)..(183): n is a, c, g, or t
  misc_feature (186)..(186): n is a, c, g, or t
  misc_feature (197)..(197): n is a, c, g, or t
  misc_feature (203)..(203): n is a, c, g, or t
  misc_feature (206)..(206): n is a, c, g, or t
  misc_feature (209)..(209): n is a, c, g, or t
  misc_feature (217)..(218): n is a, c, g, or t
  misc_feature (220)..(221): n is a, c, g, or t
  misc_feature (224)..(224): n is a, c, g, or t
  misc_feature (233)..(233): n is a, c, g, or t
  misc_feature (238)..(240): n is a, c, g, or t
  misc_feature (245)..(245): n is a, c, g, or t
  misc_feature (248)..(249): n is a, c, g, or t
  misc_feature (251)..(251): n is a, c, g, or t
  misc_feature (254)..(254): n is a, c, g, or t
  misc_feature (257)..(257): n is a, c, g, or t
  misc_feature (264)..(266): n is a, c, g, or t
  misc_feature (271)..(272): n is a, c, g, or t
  misc_feature (280)..(280): n is a, c, g, or t
  misc_feature (289)..(289): n is a, c, g, or t
  misc_feature (295)..(296): n is a, c, g, or t
  misc_feature (299)..(299): n is a, c, g, or t
  misc_feature (303)..(303): n is a, c, g, or t
  misc_feature (308)..(308): n is a, c, g, or t
  misc_feature (311)..(311): n is a, c, g, or t
  misc_feature (316)..(316): n is a, c, g, or t
  misc_feature (323)..(323): n is a, c, g, or t
  misc_feature (326)..(326): n is a, c, g, or t
  misc_feature (336)..(336): n is a, c, g, or t
  misc_feature (340)..(340): n is a, c, g, or t
  misc_feature (346)..(346): n is a, c, g, or t
  misc_feature (353)..(353): n is a, c, g, or t
  misc_feature (356)..(356): n is a, c, g, or t
  misc_feature (361)..(362): n is a, c, g, or t
  misc_feature (369)..(369): n is a, c, g, or t
  misc_feature (374)..(374): n is a, c, g, or t
  misc_feature (376)..(376): n is a, c, g, or t
  misc_feature (400)..(400): n is a, c, g, or t
  misc_feature (427)..(427): n is a, c, g, or t
  misc_feature (433)..(433): n is a, c, g, or t
  misc_feature (447)..(447): n is a, c, g, or t
  misc_feature (455)..(456): n is a, c, g, or t
  misc_feature (459)..(459): n is a, c, g, or t
  misc_feature (461)..(461): n is a, c, g, or t
  misc_feature (463)..(463): n is a, c, g, or t
  misc_feature (465)..(465): n is a, c, g, or t
  misc_feature (467)..(467): n is a, c, g, or t
  misc_feature (469)..(469): n is a, c, g, or t
  misc_feature (471)..(471): n is a, c, g, or t
  misc_feature (484)..(484): n is a, c, g, or t
  misc_feature (490)..(490): n is a, c, g, or t
  misc_feature (502)..(504): n is a, c, g, or t
  misc_feature (506)..(507): n is a, c, g, or t
  misc_feature (513)..(513): n is a, c, g, or t
  misc_feature (540)..(540): n is a, c, g, or t
  misc_feature (546)..(546): n is a, c, g, or t
  misc_feature (560)..(560): n is a, c, g, or t
attaactggggnnnggntttntagnaanagnnatnnaatantttttataaatnaaaatgagggaaatngttnanatnnaagttgganaatggggtaannaaattggagnnaaattttgggaaatnatntntgatgaanaaggaatngannnnannggagnntannatggagantntganntnnaanttgaaagaatnaatgtntantanaatgaggnntnnggnggaaaatangtatnnngtggnatnntngtnganttggaannnggtannatggattnagtaaggtngggtannttngganaaatnttnagaanagaaaanttngtgtttgganagtntggagntggaaanaantgggnnaaggganattananagaaggtggtgaattagttgattnagtattagatgttgtaaggaaagaagntgaatnatgtgattgtttanaaggattnnaantnananantnanttggaggtggtantggatnaggtatgggtannntnnttattnagtattagatgttgtaaggaaagaagntgaatnatgtgattgtttanaaggat

SEQ ID NO: 15810 - DNA, 902 bp, Diabrotica virgifera
  misc_feature (37)..(69): n is a, c, g, or t
  misc_feature (395)..(421): n is a, c, g, or t
  misc_feature (869)..(869): n is a, c, g, or t
  misc_feature (884)..(901): n is a, c, g, or t
cgcaagcaaggcgcaaggcaagtgtcaaaatcaatcnnnnnnnnnnnnnnnnnnnnnnnnnnnnnnnnngaataatgtctctaagtagatttagccggttacttgcttttagacatttaaggctagtaacaagaaatcacaactttacaaacattaactctggaagaatttcatcttgcggtaaccagaaccttagaagacttttaagcacacaaacgtcgcctaatgaagatgaacatcattcaattattaaagacacagagaaaccaacaggtgaaagtacaaaatatgaatttaaagctgaaaccaaaatgctcttggatatagtggccagatcattatattcagaaaaagaagtttttatacgagaactaatatccaatgctagtgatgcnnnnnnnnnnnnnnnnnnnnnnnnnnnttcaggagacgagtctgccaaaaaaatacaagatgttgatcgaccattagaaatacatatatcaacagataaacaaaatcgaacaattacaatacaggatacaggtattggaatgacaaaggaggaccttatatcacatttgggtataatagccaagtcaggatctaaggcgtttattgaacaaatcaaagaaaaagctgctgcaggtgataataatattataggacaattcggtgttggtttctacagttcctttatggtagctgataaagtagatgtttattcaagagctgttggagaagaaactggatataaatggtcctctgatggaagcggtacttatgaaatacagcctgcagaaggtgtacaaaacggaaccaagattgttatccatttcgaagcagattgtagagaatttgcagatgacgatactattaagaatgtagtncataagtacagcaannnnnnnnnnnnnnnnnng

SEQ ID NO: 15811 - DNA, 686 bp, Diabrotica virgifera
  misc_feature (5)..(80): n is a, c, g, or t
gtctnnnnnnnnnnnnnnnnnnnnnnnnnnnnnnnnnnnnnnnnnnnnnnnnnnnnnnnnnnnnnnnnnnnnnnnnnnnnagaaaataatatcttcttaaacaaaaaagatattctcttgtacccctcgcgtgccaccgggcgatatgcttaagaattatatctagcatataatatgccacttcgaaagacgagtcataacataaaaatcctcctgcgaaacaaatatattttaacaacttttcttggtacggcttgatattccgatatttatataaccaaacattttaagaaaataaatcaaatatatcaattcccaacaaatttcacaattaaacagatccatatcattaatactactcatttttacggtggagctcaacaacaaaacattattaaaatataatatttacataaaaattactgataaaaaacttcacatatttgagaaaatgttattattgccgttgatatagtaagagtctaattttttacagttcagtaataagaatataactttaaatcattcaacttcacgactgctgatcctagtcaatcataaaaatgtgtatatgtaccaaatatatataggcttcagcgccgagatcggcatcattgtttccgcaccatgtttatcagaaatatggcatctgtgtactaacttataaactccccggctgccccact

SEQ ID NO: 15812 - DNA, 585 bp, Diabrotica virgifera
  misc_feature (2)..(50): n is a, c, g, or t
  misc_feature (52)..(169): n is a, c, g, or t
  misc_feature (171)..(584): n is a, c, g, or t
gnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 15813 - DNA, 575 bp, Diabrotica virgifera
cattttcaaattacatagttgaagaatttaaaaaaattggctatggtttttcacttgattttaataatatacatcacctggagtactgatcctctccgctcattattaatatcctctgaagttcagttaaaaattacaaaaatataagtcgacaaaaaaattatgagaaagtataatagttcaacaacgcaccctagataatagatatgaccagaggaaacgtattgtctgtgatgcgttaaatcagtgagggagtaccagcaagaatatgctctgtgtcaggattggaggttttagttatcttgatataaagtgatgtatgtctatgaagactaccttaattcattgatcaaattcattttcttaggcaacaacaggcatatcagtttcattgtagaactatcaccacctcgcaggatctagaattgctgactgagttacattggtgaaatttaaaaattctttctcttatagattgcggaacctataagattaattttttttcatatctgagccaagcagacaacatataccacctgatgatgacagtggtgtgagtgataagactttatata

SEQ ID NO: 15814 - DNA, 510 bp, Diabrotica virgifera
  misc_feature (388)..(405): n is a, c, g, or t
agtataatgaggggtttgatagagtacgtgtccacataacccctgcggagaccattaaatatatgcattttgtcaaaaatctgtgataaatgggcgcgactatctacctacaaatcgattaatagaaaatttgactctttatattgctgctcgtgagatataggatgtgaaagcgattgtctcgggcttggctcatgtaatcactaacaaatttactgaaggttgtgcttcgtgttaaagcattcataattgtaggatgttgtggtgaaagcacgtttggttacggagatggagagtatagttggagctatagcattagttctaattattgtatccctttctgcggaaaaagtccagaatgtattaataaccatcttacttgcgtggnnnnnnnnnnnnnnnnnngagtcacagatgatcctagatgcgaagattcatggaaatatgctgcagcgctatggtgtcctcatagtattccaatacagtgcagtagagaaaagataagtagtg

SEQ ID NO: 15815 - DNA, 367 bp, Diabrotica virgifera
  misc_feature (16)..(39): n is a, c, g, or t
ccctcccccgcccccnnnnnnnnnnnnnnnnnnnnnnnngtatctcttttacaatcgaaccggttgcattgaatttgtttggttaacacgttttcgatgaaagaatttatatatgatatatctactgctacattaagtgtacgcatgctcgtgtggtgatattttcagactgacattccaatatctctatatgagatattttagcccttcctagggtcccaccaaaggggcatttgccactatctctttatggtttggtgcttgttgagtgttacctttgatattcgatatgaggacatgaatgacagtgttacaactttgtaaccaatcaccttggcgctctacccactcatatgctcatgttcaa

SEQ ID NO: 15816 - DNA, 905 bp, Diabrotica virgifera
  misc_feature (559)..(648): n is a, c, g, or t
cccacgcgtccgatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaattagagtgcttaagcaggccaaacttcgcctgaatactgtgtgcatggaataatggataggaccctcgttctattttgttggttttcggaaccccgaggtaatg

SEQ ID NO: 15817 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggaa

SEQ ID NO: 15818 - DNA, 964 bp, Diabrotica virgifera
  misc_feature (332)..(346): n is a, c, g, or t
  misc_feature (793)..(820): n is a, c, g, or t
  misc_feature (845)..(845): n is a, c, g, or t
  misc_feature (905)..(905): n is a, c, g, or t
  misc_feature (908)..(908): n is a, c, g, or t
  misc_feature (921)..(922): n is a, c, g, or t
  misc_feature (945)..(945): n is a, c, g, or t
agatagtggtttttaagttttacgtctattatgttttaaagtaataagagaaaattaacattttatctgtattagctgtgtttggtagtactatatggcgttttctacccctagttctaccaggaaacgagtgatttcttcagtaatcttcgataaaacaccaaaatctagctatgctacaccaaagaataaaaaggtggaagctctacccactaccccggaatgttttaacaatgttcaagtcgaaacccccgtgatcaaaagaaggactagtaaagataagtttgatgaagttagtaacttaactgtagctgtaaggataaggcctatgnnnnnnnnnnnnnnngttgttgtgggtgcaacagacgtagttcttgtgaaagaaaaagaattgatcatcaaggctcagagtaacactagtggtatgagtagtaatcatcaatttcattacgatcacattttttggtcctgtgatgaatccaatgactcatatgcctctcaggaagatgtatttagaacattaggaagacctttaataaacagtgcttttaaaggatacaatggatgtttatttgcttatggtcaaactggttcaggtaaaagcttcagcatgatgggcaaagacatgtgcgaagctactgatatggattgccaagtgttttccggcatcacaccaagattttgtaaagatatttttaacagaattgctcaactagataaaaactcaatatgtactgtagaagttagttattttgaaatatataatgaaaagatccacgacttgctttcctgnnnnnnnnnnnnnnnnnnnnnnnnnnnnaaagtccgagaacatccagaattgngaccgtatgtagttgacttaagtgtgcaagttgtaaaatctacaaggaattaggcattgnctnttagtaggtaccnngcatagagctacggcagctacancaaatgatgaaaaatcatc

SEQ ID NO: 15819 - DNA, 51 bp, Diabrotica virgifera
  misc_feature (3)..(24): n is a, c, g, or t
  misc_feature (26)..(40): n is a, c, g, or t
  misc_feature (48)..(48): n is a, c, g, or t
aannnnnnnnnnnnnnnnnnnnnncnnnnnnnnnnnnnnncattttanttc

SEQ ID NO: 15820 - DNA, 110 bp, Diabrotica virgifera
  misc_feature (2)..(20): n is a, c, g, or t
  misc_feature (28)..(107): n is a, c, g, or t
cnnnnnnnnnnnnnnnnnnncactcacnnnnnnnnnnnnnnnnnnnnnnnnnnnnnnnnnnnnnnnnnnnnnnnnnnnnnnnnnnnnnnnnnnnnnnnnnnnnnnnnaat

SEQ ID NO: 15821 - DNA, 733 bp, Diabrotica virgifera
  misc_feature (35)..(95): n is a, c, g, or t
  misc_feature (127)..(150): n is a, c, g, or t
  misc_feature (166)..(185): n is a, c, g, or t
  misc_feature (618)..(666): n is a, c, g, or t
cccgtccgcgcgtccgactagttctagaactagtnnnnnnnnnnnnnnnnnnnnnnnnnnnnnnnnnnnnnnnnnnnnnnnnnnnnnnnnnnnnnctttgtgtttcttggtttttccccatgtaccnnnnnnnnnnnnnnnnnnnnnnnnttggggcccccccgcnnnnnnnnnnnnnnnnnnnnaaagataaaacccccccgggccccccccggtgtgatccccgaccagggatatctccaaaggccccactaaatttaaattatagggggccccccatatttaatactttaacccccttcggggccccaatcttatattcctagggatcctcccataaaaagaaccctgttcccccctgggtttttgatcccacctcagcgcaaaaaatcaacagggggggccccccgagaggatccacctctatctaccagggtgtgggcttcctatcccctctttatgggcccccaaatctaagttattggcgcctagtaatgccgatactattaggataaaacgagggcatccctagtaaagatatatgggatgaatcccgcgtctccgcaacgtgtttttcacctgtgtatgaacaacatgtcctcttgcattagatatacnnnnnnnnnnnnnnnnnnnnnnnnnnnnnnnnnnnnnnnnnnnnnnnnncgctggggccgcgtacgcctgagttttttgattgacagcggggatgaggggtgggatgacaaataat

SEQ ID NO: 15822 - DNA, 454 bp, Diabrotica virgifera
  misc_feature (2)..(366): n is a, c, g, or t
  misc_feature (375)..(432): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattatcnnnnnnnnnnnnnnnnnnnnnnnnnnnnnnnnnnnnnnnnnnnnnnnnnnnnnnnnnnggaattatataaatgtttataa

SEQ ID NO: 15823 - DNA, 932 bp, Diabrotica virgifera
  misc_feature (765)..(784): n is a, c, g, or t
ccaattcgcatgagtctgagctgtatagatacgtttcctaaagataattatattgtgttagtttgctgaataagatggatgctcaacaattacgatccatacttcttgtaatatttctgattaaaggaatgatttatctaatatactattgttccagaagaccaaaaaatggtccttcagtcacagtcacaacgacaacgcagcatgctcaatcgccacaggtagtcccaccttatcccatagatacacgtcatccggtaccagctagtaatattacgggatatggaaatcaagccccatatcaacaatacccattccaccaaacaggtaatgtggcatcacccatggcaggagcaactccatacccgccacagccttaccaacaagccgcacacgactacagcgccaacccacctccatacgacgtggcagtatctcaaccacctcttcaaccaccccccaattcaaaggagggctacgtcaagcagtccccttacaacccagggtataattaagttcttctcatccaaccgttgactgttttagttggttcttcttacatttcgttacttaaagaagttggcagaactttttttgtttataattaaagtgtgtttaatgttattgaaatagaagaggtgttaacgcgttgacggacagtgcgtcaaatgtataagcaagtgttgtgacactatatgaattttacaaagtagaataaggaaattgctgaatttttgcttttagcacttatagtttatggaaacnnnnnnnnnnnnnnnnnnnnttgtaaacacgtggacaacaaccatggatgtcgtgtcattcatatgcatctctagatgtaatatgacaaaaatctaccgattttttgtcacaactcgtattttaaaatgtcgtctatagacgttgtgtcacattacatcagtggaaat

SEQ ID NO: 15824 - DNA, 121 bp, Diabrotica virgifera
  misc_feature (6)..(18): n is a, c, g, or t
  misc_feature (20)..(51): n is a, c, g, or t
  misc_feature (54)..(93): n is a, c, g, or t
  misc_feature (95)..(108): n is a, c, g, or t
catacnnnnnnnnnnnnncnnnnnnnnnnnnnnnnnnnnnnnnnnnnnnnnggnnnnnnnnnnnnnnnnnnnnnnnnnnnnnnnnnnnnnnnncnnnnnnnnnnnnnncatttttttgata

SEQ ID NO: 15825 - DNA, 645 bp, Diabrotica virgifera
cgcaagatggctcactttctagatgcggggtcgccacttcttgagatcaaacgaaatactaccccaaaaaagatcccagagacaccgggggaacgggaagatgttcccataaaatgctcccacatgacactggccacttgaacaattcgttcatatgtgacatggattgtcaatgagccgcggagttttgagaggcgtagcagaactgaatctgaaactttcttcttcgactctatgaaagctgtcacacttctagaaactccccccatgatgatagcagatgtcgacaaatacatcaaaaatccgcatgaagtcatccccattccaacaactggtcttcaacatctcatctgaagattagaggcatgcgatactactcctttcgtaacacacaactacaacaccgcatgttgccatctttcacataaatgtagtgaacaactgggagaatggttcgtcgacaatgcctaaaaccaaagagatcaataccgaaatgaagaacaagtcaatgatcgtactcctatgagattgtactgacaacgtgatggagaccccatactgtgatgattctgtggaatggtgaaattgatcttgagatggatccttggaatattcagcgtcctattttaacgatcactattgcct

SEQ ID NO: 15826 - DNA, 76 bp, Diabrotica virgifera
  misc_feature (21)..(50): n is a, c, g, or t
ctcatttatatcataaactcnnnnnnnnnnnnnnnnnnnnnnnnnnnnnnactctttttatatcattatatcactc

SEQ ID NO: 15827 - DNA, 55 bp, Diabrotica virgifera
  misc_feature (2)..(18): n is a, c, g, or t
  misc_feature (23)..(49): n is a, c, g, or t
  misc_feature (52)..(53): n is a, c, g, or t
gnnnnnnnnnnnnnnnnncgagnnnnnnnnnnnnnnnnnnnnnnnnnnnctnnag

SEQ ID NO: 15828 - DNA, 1047 bp, Diabrotica virgifera
  misc_feature (5)..(737): n is a, c, g, or t
  misc_feature (755)..(782): n is a, c, g, or t
  misc_feature (784)..(784): n is a, c, g, or t
  misc_feature (787)..(811): n is a, c, g, or t
  misc_feature (824)..(824): n is a, c, g, or t
  misc_feature (860)..(860): n is a, c, g, or t
  misc_feature (901)..(901): n is a, c, g, or t
  misc_feature (920)..(920): n is a, c, g, or t
  misc_feature (951)..(973): n is a, c, g, or t
  misc_feature (1008)..(1037): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgattacaaaatacnnnnnnnnnnnnnnnnnnnnnnnnnnnncntcnnnnnnnnnnnnnnnnnnnnnnnnncatataagaatanattaccttttaggatacagcgtaatttttattggcnagagtcaaatcgataaataagatgccgacctcgatgttggnattaaagtttataattggntgagcagctataattattaagtctgttcgannnnnnnnnnnnnnnnnnnnnnnagtttaacccggggggaggcccaggttggtttctnnnnnnnnnnnnnnnnnnnnnnnnnnnnnnccaaaaggac

SEQ ID NO: 15829 - DNA, 882 bp, Diabrotica virgifera
  misc_feature (125)..(143): n is a, c, g, or t
  misc_feature (774)..(774): n is a, c, g, or t
gattcacaaaagaagaacataatgtctttcaaagttttatcttttgctgcacttgttgccttcgcaaatgcaggattattaagcgaggctccagtttctggtcctgttatttccgcatactcatnnnnnnnnnnnnnnnnnnntccaaatgtaattaattcagtagctccagtagtgtctgcttactcctcacctttagctttacctgctacagctccagtaattccttcgtactctgcgccagttttagccaatgcagtagctccagttgcatactctgcaccagttacgtattcctcgccagcgccagtcgtgtcagcttattctagtcctttagtagccaaaagcttgacacccgttagctacgcttcatctgctccagttgtatctccagtagcctactcagcaccagccccagtagtgtcagcgtactctagtccattattagccaaaagcttgacacccgtgagctacgcctcgaatgctccagttgtatctccagttggctactcagcaccagtgccagtcgtctcagcttactctagtccattagtagccaaaagcgtgacacccgttagctacgcttcatctgctccagttgtatctccagtagcctactcagcaccagccccagtagtgtcagcgtactctagtccattagtagccaaaagcttgacacccgtgagctacgcctcgaatgctccagttgtatccccagtagcctactcagcaccagccccagtcgtgtcagcgtactctagtccattagtagcncaaagcttgacacccgtgagctacgcctcgactgctccagttgtatcagctttactcgctccagtagtagcccaaggcgtctctcccttagctatagtgcgcctgctc

SEQ ID NO: 15830 - DNA, 95 bp, Diabrotica virgifera
taacagcgtaaattttatcggagagttcaaatcgataataaagattgcggacctcgatgttggattaaagtttataattggggtagcagctatat

SEQ ID NO: 15831 - DNA, 827 bp, Diabrotica virgifera
  misc_feature (138)..(162): n is a, c, g, or t
  misc_feature (445)..(469): n is a, c, g, or t
  misc_feature (804)..(804): n is a, c, g, or t
caaaatccaagcctaaagagaagaaaagcaaaaaggcaaataaaaagcccaaggaaaaacctgtccaagaaaatgacgtaaatgagtcagaaaatactgaaaataaagaaaatgcccatcctagtaaacttcacgtgnnnnnnnnnnnnnnnnnnnnnnnnntcatcatcacagaggagctgaaactagcatccagtaaggagtcaaacaagagagacgacattttcaaacaagaaccggtcaaagagaaggtagtaaaagagaagaaacaaacgactgaagtcggcgtgactgccaaaaacaagaaaaacgcgaagacccaacagaccgaagtcggcaagcaagagaaaccggcgccacctccagaagaaaaggtagaagagaaagtcatcatcgaagttattccggcggttccgcagacgaacggcatcgtcgcaaataccgnnnnnnnnnnnnnnnnnnnnnnnnncgagtttaacactaaacagcaattatctgcagaacgagacggactaattaactcggtgcgtaaagctgaattgtctaagactgagatacaatatcttattgatctattactaaacaagcagcttgaggctcctgcagttatcgatgattggagtgagggtaaatccgatccagttcaaaagctgaaaagacaactcgccgagaaagaaaaagccctcgtcgacgaacaacaggcacttgtcggcgctcaggccaagttgagagagataagaagcgaacaacaggcagaaaaatcacaacttcaacagaaactgcgcttattggaggaatcgatgncaaacaaacagatagaaatccaa

SEQ ID NO: 15832 - DNA, 887 bp, Diabrotica virgifera
  misc_feature (328)..(347): n is a, c, g, or t
  misc_feature (413)..(435): n is a, c, g, or t
  misc_feature (552)..(570): n is a, c, g, or t
  misc_feature (788)..(788): n is a, c, g, or t
  misc_feature (836)..(836): n is a, c, g, or t
gattttgttaataagcaaggataagacgattttgttctttggatataaacattaaactgcaattggtacataaaatcaaatttaacaacaaatatggaaacaaaacaagaacctagtgaggaaatttgtaaaatagaaccagataatgaagcgtttgatggtccttcggatgcgtttaaaattgaaattaaagaagaacctaagacagaaagtgtatacaatgaatttgattatttagacttaaatgaattccctgttaaagctgaagtagaacaagatgaatataaattcacaccatttgaagaagagcaaaaaccaaatgaagcannnnnnnnnnnnnnnnnnnntaaaatgaaaatctgggaaacgttacattcatctcataatggaaaacatacagatcaacacgcagnnnnnnnnnnnnnnnnnnnnnnngtgatagttgcgactggacaaagacattacaactgtgaaatttgtttaaaacagtttagcaaaaagaataatttggaaatacatttgagaatacacactggggaaaaaccgcacacnnnnnnnnnnnnnnnnnnnaaattttctcaagaaggtaatttgaatacacatttgagattgcacactggggaaaaaccgcacacgtgtaaaatttgttttaagcaattttctcaagaaggtaatttgaatacacatttgagattgcacactgggggaaaacctcacaactgtgaaatttgtttacatcagtttactacaataacttctttaaaaatacatttgagactgcacactgnggaaaagccttatcagtgtgaaatttgcgtaaaacaattcactactanaggtcatttgaaaatccacttaagaacgcacactggagaaaaacgtcacaa

SEQ ID NO: 15833 - DNA, 231 bp, Diabrotica virgifera
gccactcgtactttctttgaggtctttctttttggccgtaagcggagagaacaatacccatccccggtgcggaggaccatggtagagaatgtaagcgatgatttttgtataaaagatcgtcttatgaacctggtgccagagggattaacactacaaactgtactatctctgatctgtacgaagtgggagagagttacacgattccgatcctttatagtagcatgcattttt

SEQ ID NO: 15834 - DNA, 162 bp, Diabrotica virgifera
  misc_feature (3)..(147): n is a, c, g, or t
  misc_feature (150)..(150): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnataattttttga

SEQ ID NO: 15835 - DNA, 896 bp, Diabrotica virgifera
  misc_feature (869)..(869): n is a, c, g, or t
gtcagaggtttagcagacaccatgaaatatctacaagttcttctagtcggcgctgttttggctatacaggtgtatagtcaaaactacagacaatctgtataccacaacaatcaccaatcaactagccaatattcccatcaacttccacgaggtgctggttcatgtccagaaaaaaaatggcaggtatcctacagatatgtgtgacggttatgtagaatgcaacgaaggagtcccagaagaaaaagtttgtcaagacggtcttcttttcaacgctgcagcgggtgtgttcgccttcccttgccaatatcctatcgacgtggactgctcaggaagagaacaaactcacccggcacaaccaactgacgaatgtccacaccaattcggttactaccgcatgggtgaccaagcagactgcggcaagttcaagaactgtgtcgacggaagagcctacatcttcgactgtcctgaaggtttggccttcaacggagagacatacagatgcgactggccagatcaagtatcctcgtgcaatgccgaagcatacttgggcttcacctgtccacaagacgccaaaaccctcggcttaggtttgggtcaagaagaataccgatacttcagatcccccaatgactgccaaagatatttcatctgcgtcgaaggtaaacccaggctgtataactgcggtgaaggacgcgcatttaacgatttgatcaacgcctgtgacggtgccgagaatgtcaccgggtgtgcagttcctagtcacaatttcgatacaagggtagatgatagaagaggacagacgtatagcaattattatcggggatgatttatatttatcggtagaattggtacttttgtgataatgtaantagtattttttttaaatcaattttata

SEQ ID NO: 15836 - DNA, 892 bp, Diabrotica virgifera
  misc_feature (6)..(25): n is a, c, g, or t
  misc_feature (255)..(272): n is a, c, g, or t
  misc_feature (316)..(333): n is a, c, g, or t
  misc_feature (795)..(813): n is a, c, g, or t
  misc_feature (831)..(850): n is a, c, g, or t
tatagnnnnnnnnnnnnnnnnnnnnctcttggttgaaccttatttctccatataccattatcgcaaatggatttcaatatcctctgttctatactataatatttatgataagtatctttttttcacaagtattaattaggtttattgtctttttagtcatgatccatatttctatcatggttttatatattttttctacaaccgtgttagcactccatacgagcgttaaaaatgctactttaaggcactagtgcnnnnnnnnnnnnnnnnnncactgcagttcgtattgaccgtatatgcagttttgatgtggtgnnnnnnnnnnnnnnnnnnggaatgtcagttaagttcaagtaaaagtttttgtagatattgtcctgtaattacgtttgtagaaaaaatattgtatggtatgcgtgttaaaaggtgcatttttaaggcactcatgtgaattgcagaactcgctttcgctcattctgcaaactttcacatgcgttccttgaacgtgtacttttaacacttatatcataaataactattgcgacaaagagaagtatgctttgttagcaagcattatccgattccgtatttcctcctcctcctcgctgcaatcctcagttatctgtacacctattgtgcgttccacctttactttacagtacaggttcttatgaccaacagtgatgccaaattttataagaaacaggttttaagcaaacatacttttttctataggataactattaataacttaggaattaatattattgccatattgtggctgtcaggggttcnnnnnnnnnnnnnnnnnnnaaaaatacctttatctgnnnnnnnnnnnnnnnnnnnngtataaaacatttaaacttgactgacaatctatttgatattt

SEQ ID NO: 15837 - DNA, 64 bp, Diabrotica virgifera
  misc_feature (2)..(14): n is a, c, g, or t
  misc_feature (23)..(58): n is a, c, g, or t
gnnnnnnnnnnnnncagacgagnnnnnnnnnnnnnnnnnnnnnnnnnnnnnnnnnnnnttttag

SEQ ID NO: 15838 - DNA, 390 bp, Diabrotica virgifera
  misc_feature (2)..(30): n is a, c, g, or t
  misc_feature (37)..(74): n is a, c, g, or t
  misc_feature (94)..(107): n is a, c, g, or t
  misc_feature (110)..(132): n is a, c, g, or t
  misc_feature (140)..(162): n is a, c, g, or t
  misc_feature (237)..(255): n is a, c, g, or t
gnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggagtgggccaggttggattctatctttaggttattagtatattttaggacgaaaggggcaaggnnnnnnnnnnnnnnnnnnngtgagagaagtagttgatgaagaataatagggtggcggctataggggatgagaactttccgtggagagctatcgaagagctagttctcggttaatgtgtgcaaattggatctgtgattgtcgaatactgaatgtt

SEQ ID NO: 15839 - DNA, 108 bp, Diabrotica virgifera
  misc_feature (8)..(77): n is a, c, g, or t
  misc_feature (79)..(103): n is a, c, g, or t
aatagagnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnttttt

SEQ ID NO: 15840 - DNA, 209 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (204)..(204): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggaccanatata

SEQ ID NO: 15841 - DNA, 822 bp, Diabrotica virgifera
  misc_feature (41)..(60): n is a, c, g, or t
  misc_feature (394)..(412): n is a, c, g, or t
  misc_feature (417)..(437): n is a, c, g, or t
  misc_feature (767)..(786): n is a, c, g, or t
cagagaagctgatgaaaaattttatgggaacaaatttgggnnnnnnnnnnnnnnnnnnnngaaaaaacgcattgacttaaaaactatgataactagaacaatttcaataatcgatacatgacacatattttacttaactgatgaaaatacttaattatttgagtgaaagtttttgtccaaaaatgactgctatttagatccacaaacatttgtaaaagttaatacttttgtccctttattaggttaatatgtttgtggaaaataaaatagctcttcacgtcacatacttctttctaaagcttatcacgcaggggagctatactataatatatatttcatatgttacagaactattgctcactataataaatagtgagcctatataccggaacgnnnnnnnnnnnnnnnnnnnttacnnnnnnnnnnnnnnnnnnnnnatatctcgaatatgcctcgtcgagtaataatttatgtttatattaagacataatagtccgtccgctgtaacttttcccatgcggtgcgattcattttcaatcaaactgagtcaaaacacaaagtaaaacgtacgtcgatgtgtgtagtatatagtatacagtatacaaaatgtataatatacacatcgacgttcgtttcaatttatgttttgacttagtttgattgaagatggatcgtgccgcatggggaggggttacagctgacggactatatgaagagtggagatatataacggtgaaataaatacagaatcgagaaaaatgagtttnnnnnnnnnnnnnnnnnnnngtacttaacggcggatgtaataatttatgtttatat

SEQ ID NO: 15842 - DNA, 841 bp, Diabrotica virgifera
  misc_feature (91)..(113): n is a, c, g, or t
  misc_feature (812)..(840): n is a, c, g, or t
cggacgcgtgggaccaaacgagcactcggccgagaacactgtctcgctacaatactcgttacaatactcgttacgtgtaatcaaggtttannnnnnnnnnnnnnnnnnnnnnncaggcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaaggaccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgtcgtcgctttggttaacactggcgcacctttgctcaaagatctaactgaaatccataagcaagcaagagacgccgccgaagaaattgacaattgtgaaggagataatgcagctggtttgctctgcgtttttcaggtcgccatggatattctcaaagttgaccttcagattcccgatgctgtgaaaggtgatatccaacccgtcattgatgccggtaaagcccttcatacagcaggcaaaaagtgcatccacgatcaagtacccgccttctatgctaacactggaaaactttttgggtgaattgctacatgtgctgctgcctaaattattagaagatgttatgaccttttnnnnnnnnnnnnnnnnnnnnnnnnnnnnnt

SEQ ID NO: 15843 - DNA, 92 bp, Diabrotica virgifera
  misc_feature (13)..(62): n is a, c, g, or t
  misc_feature (64)..(87): n is a, c, g, or t
aaccctatagagnnnnnnnnnnnnnnnnnnnnnnnnnnnnnnnnnnnnnnnnnnnnnnnnnncnnnnnnnnnnnnnnnnnnnnnnnnggggg

SEQ ID NO: 15844 - DNA, 971 bp, Diabrotica virgifera
  misc_feature (43)..(61): n is a, c, g, or t
  misc_feature (169)..(183): n is a, c, g, or t
  misc_feature (839)..(839): n is a, c, g, or t
taaacgtcagaaaaatcgaaaacaagaaaattactgaaagtgnnnnnnnnnnnnnnnnnnngaaaaaatgtcctcaaacaaaaaaatagaagatggattagaacatattcgaaatgcagaaaagagtttaaaaacatccctcttgaagtggcgacctgattatgaaaannnnnnnnnnnnnnncaataaagcagccacctgttttcgcaatgcaaaatcattcgatcaatgcagagactgcttactcaaagtagtagagtgtcacaaacaaaatagggcattattctatgctgcaaaagctctcgatcagtgcgttttggtgagtaaagaattgggagatctaagggcaattccacaatatgccgagagagcagcgaatatgtatcatacccaaggaaatgcagaatctgcagcctccgctttagataaggctgctaaaattatagaacagaaacttccagctgatgctcttaaattatatcaacatgccactgaaattgttatgatccaagatagtaccaggcaagcagcagaatatgcaagtaaaatcgcaagactacatgtaaaactaatgcaatatgacttagcagctgatgctatcagaagagagttaggattacaccagcaaaatgagtcatatcaagcgactggtagacttacagtcgccttagtattagttcagttagctagaggtgacgtggtcgccgcagaaaaggcatttaaagaatggggtaactactgcgaagctccagaattgcaaactttggaatctttgctacaagcttatgacgaagaagatccagaaggcgctaaaagagccttaaacagccccgttatcnaacacatggatgtagaatacgcgatacttgccagggatatgcggttgccagaaagttcgctcccccaaactcgcgtcgttcaagaaaaaccttcgcacctattgatgtcgtatccaaagcacaaggagatga

SEQ ID NO: 15845 - DNA, 908 bp, Diabrotica virgifera
  misc_feature (859)..(859): n is a, c, g, or t
gtatttctggggaatagtatttgttattactaccacaatagtagcgtttcttaaaagagaaacggatgcatcgaatgtagatcatgaacgtgatttgaaatcagcatataaatctttaaagagtataatgggtttgccagctgtacaaactttggttgtgattttgttaacttgtaagattggattctcttccactgatagtgttatgggattaaaattagttgaagctggcattccaaaagaacgattgggccttatggctttaccgttaattccattacagttagctatgcctttagtaatagccaaatataccacaggtcctaaaccgctaaatatattcttgaaagctataccttatcggttagcttttggctttgtagcagcttttgtagtatttataacaccaattttagtacctgatgcttcaaatggcctaccattttattatgtaatattattgtttgcctgctacgctcttcaccaggtgtgcgtgtattgcatgtttgttgcacaaatggcattttttgccaaaatcagtgacagtgcagtcggaggaacgtatatgacgttactaaatactcttacgaatcttggaggtaattggccgactatgcttgccctctattgggttgatccgttgacgtggaaacggtgtgaaggaggagctgagagtgtagacaatatatgtaggaataacgtagaaaaagtactatgcgaaaaagtaggaggcaaatgcgtgacagttctagacggtttctatatagaaaccctcatctgtgtttgcataggatttttatggtatttatggggagcaaagaaagtacgacatctgcagcagttaggtgacaacgcttgnaagctcaaaaataaaaaatcccaaaagagctagcttctttggaaactga

SEQ ID NO: 15846 - DNA, 546 bp, Diabrotica virgifera
  misc_feature (278)..(295): n is a, c, g, or t
gcgcgaccccccgcgtccgcggatttgagaacgggcttagtatttattctctttgacagatgtaaaggtgtcttggtagagtataggtccatcatgacgcccttccggatagaaagataattgactattgttaaaaagcgtcgttatagagagcgcgagcgacatcctatggttcgataaaagaaattctttagctaataatattgccagctagtcaagatacaagcatatagttaggcgcctcgtctgagttgagaacttaataatcactaagatannnnnnnnnnnnnnnnnntctgtgaaaacaatcataactgtaggatgctatggttcacgcacgtttagcaacggagatgctgagtacagctgcagctaaacctgatcataattaaaagaaatctgtgtcgcaggacaaactccacaatattcccataatataaaaacttgaggtgtctctggaaatgatttaataggcgctgatgatgcagcatgtgaagattcatggaaatatgccgcttcgctttgctgtcctcttagtattattct

SEQ ID NO: 15847 - DNA, 51 bp, Diabrotica virgifera
  misc_feature (2)..(50): n is a, c, g, or t
gnnnnnnnnnnnnnnnnnnnnnnnnnnnnnnnnnnnnnnnnnnnnnnnnna

SEQ ID NO: 15848 - DNA, 856 bp, Diabrotica virgifera
  misc_feature (63)..(82): n is a, c, g, or t
  misc_feature (767)..(767): n is a, c, g, or t
  misc_feature (803)..(804): n is a, c, g, or t
  misc_feature (827)..(827): n is a, c, g, or t
cccacgcgtccgcaaaagcttcaataacgaaactgaaaacgatattgtaccgactgacatttnnnnnnnnnnnnnnnnnnnncaatgttacttttctttatctaaatattagttacaacttaaatcctatatttccaatagtcgacctcatggatggccctatcatttgctaaaattagatatttatctgtgtatgtctctattaagtttgtgcatgttagcaggtggtgactactctgaaccactccacagtcgctggtatcagccttcttgtatccttatcttttcagattactagcacaacgtgagacgcaagttcttagtctgtttaaggatatccatgtcaggtaagttgatctgtgtccagtagccatttcgtctgtaggggccaaatgttgtggtaggttgccataggtttcttagctatggaactgacagatatttactttttcagaaagtttttctgaaacttaatcttggctgagtttggtggtcacacaaggagtgtcttctatccatctctggcttctttcgttctacctctgatgacgtgaactgtcttctgatttatggtagagcgattccaattatgggatagacctcttcgatgggtggcggtttcaagcaaccagatattgtacggactgtttcagtgagagccacgtcgacgtttttagaatttactcacactagtgctctaaattccctaacgacaaagtataatgctaaggcagaggtgtggaaagtgtgtggctgtattccaattntgtattagttactttggagatgatattatttcttgnnaagtattttttcttgacctcttngacatgatatggataaagagagtctatct

SEQ ID NO: 15849 - DNA, 944 bp, Diabrotica virgifera
  misc_feature (30)..(47): n is a, c, g, or t
  misc_feature (436)..(486): n is a, c, g, or t
tgtagcaattatgtataagatggcgctacnnnnnnnnnnnnnnnnnnatcaaaaattcaggagcgtaatggcccgtttgaaactttccttaggaaatttcggtacttgacaaatatgagtttattaggggtccggacaaataatcccggacaaaaaatccccacaaattatccccggacaaaaatccaaggacaaaaaatccccacaaataatcctcacaaataatccccacaaataatccccggacaaataatccccacaaaaaatcccggacagataatccccacaatttttttttgacaaaatatccccgcaaaaaatgcccaagtggggtgtcgaatggaagcttgtagccgaggatggtgctggggttgagaagtttgaccggggctgtctgtccatcggtccgtccgaccgcgaatgtgactgctccgtnnnnnnnnnnnnnnnnnnnnnnnnnnnnnnnnnnnnnnnnnnnnnnnnnnncagcgatggtgctggggatgagcagtttggtccgtctgtctgcttgaccgcgaatatggctcccccgtcgctgtgccaggaagaatgacaaatgaggtgtcgagtgagggcttataatccaaggatggtactaaagatgagaagttggaccagggctgtctgtccatcggtccgtccgaccgcgaatgtaactactccgtcattgtgccaggcggaatgacggatggggtggcgagtgtacagtgaacggttataatccaaccatggtactcaagattcacgcacgcatttcgtttccgaaagttgcactttcacgcacgacttggcgggaaagtcaaataccttgtaatattgcattataatatattataatacatgcaataaactaatattgaaaagtttgtttttgacaaccttgtcaaataattgattttgtgtattttcccttctaaataaaa

SEQ ID NO: 15850 - DNA, 773 bp, Diabrotica virgifera
  misc_feature (81)..(102): n is a, c, g, or t
  misc_feature (131)..(149): n is a, c, g, or t
  misc_feature (309)..(336): n is a, c, g, or t
  misc_feature (557)..(575): n is a, c, g, or t
taaagctatactgtggatttagttaagatcggttcaatggattttgcaaaataaattttgtaattaagatttcgcaaaaannnnnnnnnnnnnnnnnnnnnngcaggactgaaaataaatcagagagcaannnnnnnnnnnnnnnnnnnatagaagaatactgtacctttcatttgcaatttgcagaattaaaatcggttaactggcactgcgtcaggaattttttggaataaacattgatttttggtgatacgcgcacgacagcggtgttctattcacactagttgatttccaccaaaatttcttccnnnnnnnnnnnnnnnnnnnnnnnnnnnnctctatattttattgtatgttcatattttaatctcacaaaaatcaaactaatttgaatattgtttgtgaaaaattatttaaacaattgcatatgtttaaaaataatacacttttattaagtgtaacataacataagttaaaatatatgaacaaagaaagtttttgttaaaaaaagtgctatttcaaaggacagagtatgtgtttttattttgcaataaacnnnnnnnnnnnnnnnnnnngaaatgtactaaaaattaaaatttatcaatcattatcaaaggccattggaatgaccaatcagggcgaacgtatccgctgtcctgcgcgtagcaccaaaaattagtgtttatttggaaaaggttctgacgccgtggtagttggccgattttagttatgcaaatttcaaatgaaaggtactgttgtattcttttatatgg

SEQ ID NO: 15851 - DNA, 967 bp, Diabrotica virgifera
  misc_feature (370)..(420): n is a, c, g, or t
  misc_feature (439)..(465): n is a, c, g, or t
  misc_feature (486)..(508): n is a, c, g, or t
  misc_feature (739)..(739): n is a, c, g, or t
  misc_feature (788)..(812): n is a, c, g, or t
  misc_feature (838)..(838): n is a, c, g, or t
  misc_feature (904)..(904): n is a, c, g, or t
ctgattaaaaatgggttcatattcgaaaaattccaaatggaatggttcaatgtgaaatatccaaataatgatgcattcttggggaaagcacattacaacttttttaaagtgtttaaagtgtaaaaaatctttatttctgtttctataaaaaaattttctagcatcaaatataagcaagttacacacaggataatgttggtcccttttgttttgacaaaaaaaaatcaggcagatcactccccaattagtaacttaaatgaaagtaatcgttactgcttgacaagttgcttcacttatgttgtgtttatgtgatctgtaagtttcatcgattcaaagtgcttatttttgaaaaaatttggttttaaagtannnnnnnnnnnnnnnnnnnnnnnnnnnnnnnnnnnnnnnnnnnnnnnnnnncttaaaaattgttagatannnnnnnnnnnnnnnnnnnnnnnnnnngtcggttttactttgctgaannnnnnnnnnnnnnnnnnnnnnnctaaaagacaaaaattggttaagattcggtgtttctaaatttgcatacactcgcgataagtgactcgttcaagcccttttaactaaagctctttctaaaataaggactttaaacccatgaaactttcaaatcacataaacaatacatacacgagtaaagaaactgtgaagtggtagcgattgagttcatttgaaatgctaattggggggtgatttcccaatttcttaccanaaataagggaccaactttattttgagtataatttgtttacttttgatgnnnnnnnnnnnnnnnnnnnnnnnnngcatttttaaacactttaaaaaggtnaaaatgaggtttgcccaaaaagtgcttcgttttttttggtatgccacgttgaagtattcgatttgnaaattgacgaataatgaggttatttttcattagctaatactctgcttctactaaattaacata

SEQ ID NO: 15852 - DNA, 176 bp, Diabrotica virgifera
aaaccatgatgatgaattacaatattcttaccatcaatcttatagtagttcaacaaatctgctggtctaccggatctaggaactactataacattgatgctaaaaatattgtaaaccatgttgatgaattactcaagaagtatatttttaagttaataaatgcacatttttctaac

SEQ ID NO: 15853 - DNA, 229 bp, Diabrotica virgifera
  misc_feature (3)..(228): n is a, c, g, or t
aannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 15854 - DNA, 259 bp, Diabrotica virgifera
ggttcactctcataacagaactattacacaacgcacgaatacgttatctttgatggtgatgacttcgagactgtgacacaagatttcacttgtattatgagaggttgattgtcatatacctattgcctacacaacccttgagtaactgtatcgcaatcagcaatttccacactaagagccgttagagattatgaatattgcggtgatatatttactttaaagtgttccctggccacgggtatgaaatcctatttaagat

SEQ ID NO: 15855 - DNA, 96 bp, Diabrotica virgifera
  misc_feature (6)..(31): n is a, c, g, or t
  misc_feature (38)..(81): n is a, c, g, or t
  misc_feature (83)..(83): n is a, c, g, or t
atttannnnnnnnnnnnnnnnnnnnnnnnnnggggtgnnnnnnnnnnnnnnnnnnnnnnnnnnnnnnnnnnnnnnnnnnnnantaatttttttgat

SEQ ID NO: 15856 - DNA, 917 bp, Diabrotica virgifera
  misc_feature (340)..(358): n is a, c, g, or t
  misc_feature (725)..(763): n is a, c, g, or t
  misc_feature (839)..(839): n is a, c, g, or t
gagaaaaagtcgtcttggtaacatactagtaaaatttcatatttggcggggacagtacttcttgaaaacaaatgtctgtgacaagaagccaaagcaaagacaacaaaaaaacaaaaagaacattcaaatcaagagaatacttcagaccaagaagatattttagacacgacaatcatggcatcagaacagcaagaattatcaggaatagataaattattacaaatgatgcaactccagtcacaaagaatggaacagaaaatggatgaaacaaaacaagcaatagatgaatcacaaaaaaaaatggataaaaatcaggaagaaacatcaaaaaaaatggatnnnnnnnnnnnnnnnnnnnatgacaatcaaaaggaaacaaaacaagcaatagaagagaacaataagaaaatagaggaacgcatagaaaagtatgaaaaggaaataaaaggatgtttgacaacaatgaaaaacgagatagaacagcaagaaatgaaaattaaggatcacatgcaagaacaagaaattagaatgaaggaccacatgaaagaacaagaaatgataattcaaaacaaaatggaggagttaacgaatgggcagaaaaaggaactagaaaatttggaaaataagttagaaaatgctattcaagtagacagagaagaagtggaaaaaagaatcacagaaatagaaaaacaagtcaccgaaaacaggacgcaacagaatgtcgnnnnnnnnnnnnnnnnnnnnnnnnnnnnnnnnnnnnnnncaaaaatttttgcattatttctggggaaaagtcccacaattggaaattaacaaggaaattgcaaatgcgaaatacnatgataggatgggtgtatcagaaaagacatatgctttgcaaatttaccataatgcaaaacattttacatataattact

SEQ ID NO: 15857 - DNA, 95 bp, Diabrotica virgifera
  misc_feature (25)..(26): n is a, c, g, or t
  misc_feature (70)..(70): n is a, c, g, or t
taacagcgtaattttattggagagnntcaatcgataaataagattgcgaccctcgatgtggataaagttnataattggtgtagcagctatattat

SEQ ID NO: 15858 - DNA, 923 bp, Diabrotica virgifera
  misc_feature (813)..(813): n is a, c, g, or t
  misc_feature (819)..(834): n is a, c, g, or t
  misc_feature (884)..(907): n is a, c, g, or t
cggtagacggaccgggcaatttgggtatatgtacattacgaaattaacaagttaaacaaattagctgaaacgtttaagcggttttgaataaaatctgttttggaatagtgtaaccttttggaaatagcagttcctaataggctaatctggggtttaactaagatggcaactattgtaaattccaccgtaattccaaaaaactctacaaatttttatcatttcctgtttacagaaattgcagatcctagaacgaattcatggttcctaataaaggatcctggtcctggcttagctattttaataatatggatgtattttgttcttaatattggtccgaaaatgatgaaggatagggagccgtttgaccttcggaaaacccttatagtttataatttagtgcaagttattattagttcatatatatttataaggggaggtataataggctggtttggtaaatacagctataaatgtcagccaattgattattctgacgcacctgaagcacaagagatgcgccacttaatgtatctatatttcataaacaaattattggaacttctcgacacagtattcttcgtacttaggaaaaaacaaaaccaagtgacgttcctgcatatgtatcaccacaccgtgatgcccatggtgtcatggggaggaataaagtatgttcccggtggtcacggtaccttaataggatttataaactgttttgtacatattattatgtacagttattattcattagcagcctttggaccaaagatacagaaatatttgtggtggagaaatatattacagcaatgcaattgngccagnnnnnnnnnnnnnnnntacacaacagccaattgtttttcagagactgtggatatccacatggacannnnnnnnnnnnnnnnnnnnnnnnatttttctacttttta

SEQ ID NO: 15859 - DNA, 66 bp, Diabrotica virgifera
  misc_feature (12)..(31): n is a, c, g, or t
gggtggatgacnnnnnnnnnnnnnnnnnnnnctcatcaagaatttatctttcagtaaaagcttaat

SEQ ID NO: 15860 - DNA, 850 bp, Diabrotica virgifera
ccacgcgtccgggatgtcaccttaggagaccacccattgaacataaatcccgatagcgaatggcaaacgttttttaaagacaatgaagtgttgctccaaatagataaagacgttagaagactgtgccctgatatatcattctttcaacagccaaccgaatatccttgtaaagaaatagtcaatatgaatgacgtcaaaagactgcatacaagagtacaaagaagtgttctcaaatgtgccaatgttgaaagaaaaggcctaggaatcacaaagatcgcactattatctaaaaaagctaatgaagactacgctcctatgacagaaggtaaagaagctcactgggaagttgtagaaagaatattatttttatacgccaaactgaaccccggccaaggttatgttcagggaatgaacgaaattgtaggaccgatatatttttcatttgctttggacagcgacatatcatttagagaacacgcagaagcagactgtttcttctgttttaccaatttgatgtctgaaattagagacttttttataaaaagtttagatgaatctgataaaggtatcaatggaatgatgaatagactattaaaccaattaaagactagcgacctagacgtatggctcaaattccagcaattagacttaaaacctcaatattatagtttcaggtggatcacactattgctctctcaagaattccctctacctgatgtacttaggatatgggattcattattctcagataaaaaaagatttaattttttaatctttgtctgctgtgcaatgatcgtcattctgaggaaccattattagatggcgattttccgtccaaccctgaactact

SEQ ID NO: 15861 - DNA, 916 bp, Diabrotica virgifera
  misc_feature (445)..(463): n is a, c, g, or t
  misc_feature (502)..(523): n is a, c, g, or t
  misc_feature (559)..(578): n is a, c, g, or t
  misc_feature (580)..(593): n is a, c, g, or t
  misc_feature (845)..(845): n is a, c, g, or t
  misc_feature (847)..(847): n is a, c, g, or t
ctcttaggcaagccgtttcatgaaaatgaaacacagataaacaaatcttgaagtccgcctaccaatgaaacgagtgtgattcatgctcataaaacatttttattttcggagagtttcataaatggtcggacgtctatttgtttggcagtgttttatttccatgaaacgtcatttacgtttcatgtttctttgatgtgccttagacttagtgtgtgaacatcggctcgcacgagccgagctggtatattttatatcgggcagttttaatctttgcgccgccttgggacatttttaaaagacctacctgtttcttgggccgagataggcactgcccgctttaacaataacaaagccaagagatcggctaggcgttgactccatgagaagtgttatctgccttaattcatggcgtatcaattccgatttaaaaatgtgctaaatttgnnnnnnnnnnnnnnnnnnngtttgtaattttattttcaacaggattaggtaagtgtcnnnnnnnnnnnnnnnnnnnnnncatttttgtaaatcgttttagcaaaaaaagtgttcnnnnnnnnnnnnnnnnnnnngnnnnnnnnnnnnnntctttttctaatactctttttcacaaataaatacgttttagggttttcattattagtcacgatatttcaagatttcttgttttcttgacaagaaatcttggtattgacataaaatttcttgtcttgtcttgaaatctaaaattacttcttgtctttgatcttgtgttgaaatcaagacatgatcaagacaagatcttgaaattttcaagaagttggcgaccccctagaggtggatatacccgcttttgattngnttttggtttgttgtaaaattttgtttgtactgttaatttttagtgcgtttgatacttttattaaataaa

SEQ ID NO: 15862 - DNA, 826 bp, Diabrotica virgifera
  misc_feature (799)..(799): n is a, c, g, or t
  misc_feature (805)..(824): n is a, c, g, or t
caccattataacacaacaggccatgcatttgatttacccgatgtgaagatcctgaagaaagaaagtacataattataagaaaagattatgtgtcgaaatgtattacataaataaaaatcaacatcaagcacattacgacacaagcaaaagacattttagttgaaatattcaacgcatgcctttcaggcaataatggcgtaccctctgagtggaaaaagtccataactatccctatatacatatacaaaaaatgtggtagaaaaaattgtaataattacagaggcattagccctaacaacacacaacattccaggaatgtactaccaaagttctatcaatatttgaatgtcctggacatttagggaacattcggtgaacatctgattaaattattcgtggaatgttaccataagacattctgtgaacatactaccaatgttcctatatgttcattttcaaattcacggcgcatgtatttgtgcatggtgcttagagagggcatcacgtgactaaaaacgaccaatgacctcacttcagacttcggtgcttcggccatcttgacatgcatcttggccttggccaccttgccgtgcgtgatcgttgtttgtttttatttgtgctttttaagaatattttttaattcggatacttttataataactttaatagtattattaatatagtgcataaaatcagttggagtagcagaagcaatgtagataaaaaatctgcaggaataatgtttcacaggttagtataatgcaaatatgtaaacaaaggcatgcccctatttcagaanatatcnnnnnnnnnnnnnnnnnnnngc

SEQ ID NO: 15863 - DNA, 945 bp, Diabrotica virgifera
  misc_feature (449)..(477): n is a, c, g, or t
  misc_feature (722)..(742): n is a, c, g, or t
cttcacgcgtccgatggcgaaacaattaacacacgtttagtatctggtgtaataaactgttatgtagaactagggttaaatgaagaagaaccaggagcgaaagggcctaacttaagcgtttacaaggacagttttgaaaacgtttttctagaagataccgagcgattttacatgagggaaagcacttcgttcttgtccgaaaacccagttactgaatatatgaaaagggctgagcaaaggcttgcagaagaacaaaaacgagtccaaaactacctccatataacaacaagtgaacgattagcgggaacttgtgaacgtgttcttatccagaaacatttggaactgttccattcggaattccagcaacttttagacgatgacaaagacgccgatctaggaaggatgtacagcttagttgctaggattccagacggtctcggtgagctgannnnnnnnnnnnnnnnnnnnnnnnnnnnncaaggtttagctgcaatcgagaagtgtggagaaagtgcagttaatgatcctaaggtttacgtcaatacgatattagaggtgcacaagaaatataatgctctagttttagtggcgtttagtaatgacagtggcttcgttgctgccttggacaaggcctgtggcagattcattaatgccaacgctgtcactaaacaagctaattcaagcagtaggtctccggaactacttgcaaaatactgtgatcnnnnnnnnnnnnnnnnnnnnnaaaacgctgaagaggctgagctcgaagacactttaaatcaagtgatggtagtattcaaatatatagaagataaggacgtatttcaaagttctatagtaaaatgttggccaaaaggtagtgcagcatattgtcgctagtgatgatgctgaagcttcgatgatctcaaaattaaaacagcttgtgggtttgatatacgtctaaac

SEQ ID NO: 15864 - DNA, 86 bp, Diabrotica virgifera
  misc_feature (56)..(77): n is a, c, g, or t
tatgaatgccatttcagaatttaaaaatctgaacttgttattgttttttgttattnnnnnnnnnnnnnnnnnnnnnncagattatt

SEQ ID NO: 15865 - DNA, 465 bp, Diabrotica virgifera
  misc_feature (16)..(16): n is a, c, g, or t
  misc_feature (21)..(21): n is a, c, g, or t
  misc_feature (28)..(28): n is a, c, g, or t
  misc_feature (31)..(31): n is a, c, g, or t
  misc_feature (65)..(65): n is a, c, g, or t
  misc_feature (154)..(173): n is a, c, g, or t
ctttcgggcgcccganccaancgggggngancaaagaaaacctttttataaagaaagagaatacnaaaaaaacacaacaacaagacccaaaagaaaaagagataagaatataatacttttatttatttcggcgtgattataattgaagagtacnnnnnnnnnnnnnnnnnnnntacctcatagttggttgatcgattatttttggtgatacaactatattatcatgacggataacactgtaatattattggtgagctcagatcaatactaagtattgcaacctcgatgctgtattaaagttaataatagatgttacagcgataggatcaaatctgttcaactttttttattttacgtgatctgtgattgaaccccgtgtgagccacggtgatttctatcttgaaattattacatatattttagtacgaaatgaaaacaggtctccgataatttatataccaagat

SEQ ID NO: 15866 - DNA, 137 bp, Diabrotica virgifera
  misc_feature (8)..(55): n is a, c, g, or t
  misc_feature (66)..(118): n is a, c, g, or t
ctttatannnnnnnnnnnnnnnnnnnnnnnnnnnnnnnnnnnnnnnnnnnnnnnncatttaattcnnnnnnnnnnnnnnnnnnnnnnnnnnnnnnnnnnnnnnnnnnnnnnnnnnnnncttttttgatcccattttt

SEQ ID NO: 15867 - DNA, 250 bp, Diabrotica virgifera
  misc_feature (12)..(94): n is a, c, g, or t
  misc_feature (101)..(195): n is a, c, g, or t
  misc_feature (206)..(228): n is a, c, g, or t
gggtggtggttnnnnnnnnnnnnnnnnnnnnnnnnnnnnnnnnnnnnnnnnnnnnnnnnnnnnnnnnnnnnnnnnnnnnnnnnnnnnnnnnnnnttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaccctccnnnnnnnnnnnnnnnnnnnnnnngggaagaaagagccccccccca

SEQ ID NO: 15868 - DNA, 252 bp, Diabrotica virgifera
gttaagtcgatagtagttggagcggagctgtttgtattaggttgtagattataaagtgtggataagtgataagtataagtgcgagtgtgataactagctgattaaaacaccgactgtgctatactataggttataaaaatgtttgataatttatgaaataaatctttgttgaaaagtgtaccaaaagtgaagaagtgcatttacagtaactgttatcgtagtaggcctagttctcttcataggcgtgtagtc

SEQ ID NO: 15869 - DNA, 756 bp, Diabrotica virgifera
  misc_feature (6)..(557): n is a, c, g, or t
  misc_feature (564)..(601): n is a, c, g, or t
  misc_feature (621)..(634): n is a, c, g, or t
  misc_feature (637)..(659): n is a, c, g, or t
  misc_feature (667)..(689): n is a, c, g, or t
  misc_feature (719)..(750): n is a, c, g, or t
ccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15870 - DNA, 922 bp, Diabrotica virgifera
  misc_feature (94)..(117): n is a, c, g, or t
  misc_feature (333)..(356): n is a, c, g, or t
  misc_feature (369)..(386): n is a, c, g, or t
  misc_feature (421)..(440): n is a, c, g, or t
  misc_feature (666)..(686): n is a, c, g, or t
  misc_feature (765)..(784): n is a, c, g, or t
  misc_feature (853)..(869): n is a, c, g, or t
  misc_feature (871)..(894): n is a, c, g, or t
  misc_feature (906)..(906): n is a, c, g, or t
gggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaagagnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtataactcnnnnnnnnnnnnnnnnncnnnnnnnnnnnnnnnnnnnnnnnnatcgatgtaaanttaaaccttctttccc

SEQ ID NO: 15871 - DNA, 906 bp, Diabrotica virgifera
  misc_feature (174)..(196): n is a, c, g, or t
  misc_feature (405)..(422): n is a, c, g, or t
  misc_feature (756)..(774): n is a, c, g, or t
cggacgcgtgggcagctgtttgggatcaatttaagggtttttatccgtacgttttggtggcttgaagcatgtaagcctgtgataacactgatgatggaatgttgattccgagaacgttttgtgatacagccctttttagggattttgaatacatatgctttttgcaaagtaagnnnnnnnnnnnnnnnnnnnnnnnatagtttagacttgcttcatctgtttctatcacatatctaaaagataaataatttaattgagatctatactaacatttgtttaaaagcacatttagatactatgaaatctagtaggtagttgaagaaagaataatattgtttgttatcttttttcttggccgtgataggtgcactgcatatgatttaaattttggcactgggttcagtnnnnnnnnnnnnnnnnnngcgcaaataaaggagcgaattggacaaattaacgtctcctgaaataactccattccgaaagattaaggctgatttatgttagaacggcagtgtatgaaacggccgtcttgcgggacgttgaagaatcgtgtgatatgatagacattgagtagtttttactacaacgcgacggggcggcaacggggacgtgagccgtctattgttccacggcccgtgtcgtatacgccgcgtactaacataaatccggctatattgtgcgattaaaagacaaatgtaatttttgtacaaaattttgtaaatactttaatgattgcacattaaaataatataccgnnnnnnnnnnnnnnnnnnnatcgtcagcagtattgtacttttagaattttgctactacataattctataagacgtcagaatcattatcatgatagattttcacggcttcgttagtaaattttcattatattaagaatttatatgcatttta

SEQ ID NO: 15872 - DNA, 886 bp, Diabrotica virgifera
tacagattcagacctatccaaattagttaaaacaaaagtcggtacgctctcaattagaattggaaataaacactttgcgcaatatgatattcaaacttcaaaccgtttgaagaagtttgatttcaagtcaaacctaaagatatcgaaatcaagtcaagtcaaacttttttacagaaaaagtttggttttcaagtcaagtcaagtttgttgaataaaatcaaactagtttgacttgatgcatctctagctgtcgtagtaatcgatggtgacgtccttcgaaaatctgtacgatttatagtgtgtattcgatcccctgtttcacacgctgggaatttgaacgtgcggtcactagaacgtacgacgagattccaatggtggctttagcattccctcaagtacacggcgacttcaccgaacgttccaaccgccgagtaatgagaaaggtaccatatgattattcgagccactattggaatttcatcgcgcgtttcaaccatcggatgtttaaattcttagcgtgtgaaacgaggggtatactccaggattctgtcgttaaattattttccactgtctgctgcaattgcagttataatacccataaacctataaacaatgtaccatattacggttttagggtaaatggaaaagttaccgttattttaggtggccataatattcgaaaaaaagaacctagtcaaataagggtgaaatctagcactgttattattcatccagattggaatagatttcttcttagaaatgatgttggtctagtcatactgccatcagaagtggagttgaatgatgatatccaaacgattccacttccacacgaaaactcaaaagctagctttaagggaaaaatgcattagcaactggatgggga

SEQ ID NO: 15873 - DNA, 347 bp, Diabrotica virgifera
  misc_feature (260)..(279): n is a, c, g, or t
agaagtttacaaagtgtacaaaacacaacacacacattaaacttcttagtagtgtttgtccatttttactcgcattttgtctattttgttttaagtttgtatagttgttttactgctagctagcgatttaatgtttttctctttgatattatgtaaatggcagttcctttttatcgaatttttgtttttaggaggaggtatcatctgatgttaaaaagaccttgttgtctattgttggataaatttctttataccagagnnnnnnnnnnnnnnnnnnnnaataataagaacaaacttttgtaacttataaatcctacttgtaacttataaatatatgtcttacaacg

SEQ ID NO: 15874 - DNA, 909 bp, Diabrotica virgifera
  misc_feature (556)..(582): n is a, c, g, or t
caagtaatcagagcgagcaactttctagactcaaaaaaatgatttttgattcatcacgtggaaaatcagaacgttatttattctaaagaataaatttcagtggattcacggtctccttcaaggggatcatttttctgccgctctgtgtagtctttaccttagcattttagagcaaaaacatttacaataatttatgacaaatggttttagaatacatcgcattgctggtgattatttattttgttctccgacccgcgaaacagctgaattatttgaactcacgtttaaaaaacattttccagtgaatgagtcttaaaatacaaagagcattagaggaagatagttgcgaaattctacattttggccaaattttaaactttgaaacgaaagaaatgcgcaaatgttttagtcaaaataaatgtttgacacatcaattcaaattttgggagtctaaaaacatttaaggagcgtaagcaaattatggaaactgatgtaaattttcgactaactaatcattattttaaacctttcatattacagattaaatatgatttannnnnnnnnnnnnnnnnnnnnnnnnnnggtatggtttatgtggcctacaagttcgacctggctgtaacagcagtttctaaattaaaacaatcatcaaatgagatgccatatttattatgcataattaaaaatactctcacaggccatgcaagaaaagtttgtagatatccaaggataagtgggttacttttcggttactgcgtatgatcgccattaaagctttttggtcgttttaaaaagaataatcgtttttatgtctttaattgatggtttaactaaaaaacgtgtaatttatttgcatctgacagatgaatgtaaaaaaaatgtccgcccattttaaataagttaccggaa

SEQ ID NO: 15875 - DNA, 933 bp, Diabrotica virgifera
  misc_feature (768)..(768): n is a, c, g, or t
cggacgcgtgggggagaatttagtgaacctacgtcagctaagaaaaagacaggatctttagaaaaattgttaccattgaacgagaagttaccatagaagtttttgatttgccagctaaaccagcagtagaacagcgttcaatagttgattccaataatttccttaacaacgaaatagaaaaataccacgacgtacgaccgattatttccaaaattgaagttgcaccctccgaaatcaaagaaacgtcagcagttcttgaaaaaccaaaagatcaagtggacaaagaagaaaaaagtaaatctaaaaagaaagaaggcaaaagcgaatcgggtggtatatttggtatgtttaaaaagaaaccaaaagaaactggagcacaaccagtatcagaagaaataactgaccagattcagcagacaagtaccttcctacaagaagaagtcaacaagcatcatgacgttcgtcctttggttgaagaaaacattgttacaacccaacctgttataaacgaatctattgttgtcactacggaagaaaacttaggtagtccgaatgtcaccactaaaactgaaacaaccaaggaaaagtttgttactacgtcaaaagaccatactgacactataaaaaaggaaactaaaacagaaactactaagaagattattacaacacaaacaacgtctactactcagagtgtaacaaaaacaacttctgctaccatagaatcagatatagctgctgcaacacctgtggtaattgaatcaaccttgncacctattgacggctccaaaggatttttaaagacggaagttgaaaaatatcatgacgtgaaaccaatcattaagtcttctgatcactacaagaggagttggttaagtcttctgaaccaatactccaagaagctgttgatgtcaaagtagaatcaactccgaaaaa

SEQ ID NO: 15876 - DNA, 976 bp, Diabrotica virgifera
  misc_feature (881)..(881): n is a, c, g, or t
  misc_feature (944)..(944): n is a, c, g, or t
gttattagccaaaatggagattgctaaagagcacagagcattagtggaccgtattgctagggaaaatggattcaccgattatgaaataataactagttctgggtcgaacaaaggagacaactttctaggaatccttactgctattaccattaaaaacaaggaaaagagtttggatgttattttaaagacttcagagaccaataaacaagttagagactctactccctttagggacctttataagagagaaatatttttgtacgaacgggttttcaaggaatttaagaagcttcaagaagaatacagcattgaagatcccttcgacagtgtccccaaattttatttgagttttactgaagatgatcttgaaggtttagtgatggagaatctaaaaacacaacaataccagttgtggaataagaaagtcccaataaacccaggacacacaaaagcagtactcattgagtatgccaaatttcacgcagcttcactagcaatgaaatacaaacatcctgaattatttaaagaattgacagaaaatggtccacgtaatccatacgagatcacttaccaagaaggaatccatgaggaaaagatagaacataggaaagcgtttcttactcattctttaactgatagtttcaaagctgtagaggatgatccagttttgacagaatatttagaaaaatatgggcaaaaattattgcctgaagctttctctaaattacaagaaccagaatacaaagttgtcataacacatggagactgttggtgtaataattttatgtttcaatatcaggatccccaacgtaaaacaaaaccctcaagtttacgtattattgactggcaaatgtcttcatttggaagtccttgtacagacngttcctattttctttctggcaatggctcagaagagattttagatgatttttgaacctacatanaaatatatcacgacaaactatcttcgcagctt

SEQ ID NO: 15877 - DNA, 786 bp, Diabrotica virgifera
  misc_feature (2)..(650): n is a, c, g, or t
  misc_feature (652)..(783): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngga

SEQ ID NO: 15878 - DNA, 749 bp, Diabrotica virgifera
  misc_feature (690)..(712): n is a, c, g, or t
cggacgcgtgggcactttctcaagttttgaagccaagatattcttcatcctggtccaccctttccaaataccttgccccaaagaatgagttgtatcaagccatatatctgttcattcctcataacatggtcaagatagtctagattgtgctctttgattgggttaatctcgcatttgttgcccattctatgtagggcctcaacattaatcacacgatccacccatgaagttcttaaaatgtgagttagtgcagtcactgaaggttttcacctccgatttcgttgaaccttcatcgattttcatgagggctggtgagtgcttggcggataccacaaggaacgagggagacatggggccaacttgagcttttactgcggagtggatgccaccccagcggcggctcgcgagtaaatcttcaggggggtcattttggttggaaaacttcaaactgttgattttttaaagtatttaaaagatcttttagcatttatattttagataaaaaatacagaattagataaaagtcaatactatttaccctaggtttccgaaaaatatatttgtctttttatagaggaaatcatttaaaaaatatatgaaacaatggtatgatcagggtattggactgatatatagataggaagatttatagaataataaattgtaaatttattagcacgaaacttgacnnnnnnnnnnnnnnnnnnnnnnntcaattcttctatcctttacttgctgaaaatagtcta

SEQ ID NO: 15879 - DNA, 958 bp, Diabrotica virgifera
  misc_feature (814)..(814): n is a, c, g, or t
  misc_feature (870)..(870): n is a, c, g, or t
tgcaggtttggtcctggtatggacagatacctctagccttaaaataagtaccgccaaaaaataccattaagaatgacgtatcaagcacagaatatagccgaagaaaaggccaaagaggctttaggattattgataaataaggatgtatctataaaaaagggaccaacaattggaaagagatgtcaacaagctcttattcttcatattttgttacttttttgcttcatcatcagaacagcattgactgtcgccatagtagccatgaccgattcaaatgccagcagtaataaagatataccgacctacaactggaatgataaaagtttaattatggcatcatttctatggggctactgcatccctcaaatagtcgcaggatacgtatctgataaatatggcgccaaatggttcttagtcggaagtaccacggtgacggccactgccggtttgctaataccttctgcagctatttattttgactccaaaggagttatggtttgccgatttctacaaggtctatctcaaggatttttgtttccatctatgcacgcagtattgggcaagtggataccggttccagaaaggagtaggcttggtacttttgtttatttaggtgcaccactaggtatagtttcttccttattattaactggatacatatgttcaacaagttatggatggccaatggtcttttaccttttcaacactatcgcattaataatggcagctatttatgcctatgttggcagtaatgaccctagtagtcatccgacaattaccgaggaagaaaaaatttacattataagtagtttanacactgcgactgacaggcacaacctgatggttccttggaaggaaatcttacatccnaggcattcatagcttttgtaataacccatctgtgttttaactttactcactgggatggttatatctgaaaatttctatatatctttga

SEQ ID NO: 15880 - DNA, 921 bp, Diabrotica virgifera
  misc_feature (799)..(799): n is a, c, g, or t
  misc_feature (829)..(829): n is a, c, g, or t
  misc_feature (853)..(853): n is a, c, g, or t
caatgtgaatctgagattttttataatggagtttacttgttctgtgttagttactatatttattgctgcatggattgaaatatcttctggagccgttacaacaacgtcaacaccaacaccacccccaactgaatttcaccttggagaaaagaatattacttggcatccagattataatgagaaattaatcatcacaacagacgagggctttaagatttctgttggaatacaatattgtgacatcgatattacagataaggaatttgttaaaatatatacagataaacctgaagaatctattattgttactggaacagttgctgctagtcctaaatttctttacaataaagacgtgttaaatttagaatttaccggtagtaaaaatagtaatgttacattcgaattcgcaagaattggggatgttatcacaactactaccactgagccaacatcttccacagagtttctgcctaccccaaatattaccgatacctatgaactggtcgtagtcttgacaggtctagcggcatatcaatacagaaatccaactgtattattggattttgcacagatgattacgaatatggctattgattattgtgaagatcagcagtttgagttggtggataatataacaacgaacaatgttgaaataatcggaatctatacttgcaccactggctggcccagttgcagtccttgtgtagaagccaaatttgcagtacctattcatacgaagaacgactctgaaacctggccaggttatcaattaaatcaatatcatcttcagataatgtgngagagatactcagaaaagtaccttactgancggataactacttgtactttaccnagtatgaacaattggatcaaatacagaattattttgtttttttcagtaaactgcattttttttataat

SEQ ID NO: 15881 - DNA, 871 bp, Diabrotica virgifera
  misc_feature (11)..(32): n is a, c, g, or t
  misc_feature (773)..(774): n is a, c, g, or t
  misc_feature (837)..(838): n is a, c, g, or t
gtccgctttgnnnnnnnnnnnnnnnnnnnnnngtaatttccagatataaataagcaatgctgttgttttcataattgcacagagaattaacattttgtactaaccattaatgtgacaccaagtttttcttctggtgttatcactctctttctaccattcttgtacgagatttcgttatgtcttccttgataacacataacaagaaatggaactggttcttcgtcacgcgaaagaaactatgaaacttggtctcattatcaaccatatatttacttattaaattggtttggtatccttcttcaaccctattcacatacatttcatcagttttactcttttttggtttacattcatctgggagcatcattttaaaatgctctcctccaattcttgctcttttaatatgtgaagataaacctgtctctgtagatgctccattattattatcactaaattaattactacttactactaattactactacctactaattataaattactaaatattactattattataaatgactaatgaatattattaattactaagtattattataaattactaaatattcctattattattaattactataattataaattattaagtatcaatattattataaattactatgaagcaatgttactatgttatcggtgctattagataataggtctgttcctttgttttttagtgttacacttttgagtgtaagtgtaagaaattctatggacatttgagtgtaaattacagcggacagtattannacgaaattatcggtgtgccaatcaagcaaagggacaaggaacttccgaaatatggctaactgnnggcacataacataacctaatcccctatattaca

SEQ ID NO: 15882 - DNA, 876 bp, Diabrotica virgifera
  misc_feature (822)..(822): n is a, c, g, or t
caaaggcccaaatactcctccagaaccaccaaactcaccgcctagttcgccagatgcttatgatccattcgaacctaccaaatcgagatctccaacacctgaaccacaactactgggcattaaagattccctcgaaagtatcgatagcagagcagctattgatctgttggagaaatctatgaacccgatgccagagactaccaagtctcttactccgcctctggcagatatacaacccgcggattcgcagagtagcgtccaaataattactcctgattctaatcttggaaaatctcctgaacgaccacaaatccaaacggttcaacagccgtctaaacccgttgcccaaactataccattctcttctgtaccaactccaataattttggctactccttctgttgctactatccctactagaattaatattcttaatactacagtcatttctccaccagtagcatcaccaatacctcaacgaatagttttacccaacataattaagtcaggcatcgtgaagatatctcccaccaagcccactgtgaaaacaaatcccatcaaaccgatacaaaagacgaccaaatcaactaggaagagaaccacaaacggcagcctcgatgatatagtattagatttcgattcgccgtattctccaggaagtagcgattatgaggatctgttcgagcctccgagcgagatcgtaactaagccaatgatcaaaggcaagacaaagtcacatgcctccgcgtttgacgcgttgttcggttcgcctagttacagtaagaagaagaagtacaccaagaaagctaacccaaaaactanaactggtgggagtcaaattggacgaaagatgtttgaaagatcttgacgacttac

SEQ ID NO: 15883 - DNA, 716 bp, Diabrotica virgifera
  misc_feature (53)..(71): n is a, c, g, or t
  misc_feature (119)..(150): n is a, c, g, or t
  misc_feature (152)..(164): n is a, c, g, or t
  misc_feature (197)..(215): n is a, c, g, or t
  misc_feature (431)..(444): n is a, c, g, or t
  misc_feature (446)..(489): n is a, c, g, or t
  misc_feature (529)..(550): n is a, c, g, or t
  misc_feature (560)..(581): n is a, c, g, or t
  misc_feature (621)..(643): n is a, c, g, or t
  misc_feature (654)..(688): n is a, c, g, or t
  misc_feature (690)..(715): n is a, c, g, or t
atttctctttattttgacatcatagaatatttctccgtcaaagtaaagacacnnnnnnnnnnnnnnnnnnncattagtattgggacagaatattttatttctcataaaggaacaactcnnnnnnnnnnnnnnnnnnnnnnnnnnnnnnnncnnnnnnnnnnnnncttcattattttccacttcaacacagctaccannnnnnnnnnnnnnnnnnngataaccccttaaataactttttttgtagacgaaatgccacttcgtctttatatatatctacttctttaagaaatacattaaactcatttattaacactacatctatacctagacatctttatattaccagtattacatatttttagcgatgagctcaacaataacatcttcttaaaacttaatctttccatagaaattaggattaaaagctttcnnnnnnnnnnnnnngnnnnnnnnnnnnnnnnnnnnnnnnnnnnnnnnnnnnnnnnnnnngttttattaacacctaaatttctattatctaactgcatannnnnnnnnnnnnnnnnnnnnncagaattggnnnnnnnnnnnnnnnnnnnnnngttaataaaggactgccgcagcatttctctcacctgatcnnnnnnnnnnnnnnnnnnnnnnncacatatgacnnnnnnnnnnnnnnnnnnnnnnnnnnnnnnnnnnncnnnnnnnnnnnnnnnnnnnnnnnnnnc

SEQ ID NO: 15884 - DNA, 379 bp, Diabrotica virgifera
  misc_feature (4)..(46): n is a, c, g, or t
  misc_feature (52)..(74): n is a, c, g, or t
  misc_feature (265)..(338): n is a, c, g, or t
  misc_feature (343)..(377): n is a, c, g, or t
ttgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnct

SEQ ID NO: 15885 - DNA, 864 bp, Diabrotica virgifera
  misc_feature (842)..(842): n is a, c, g, or t
gtagcaaggactattgccagatcattttgtccagagctgtatggatcttcagctcttgaaacaacagaagtagataactggttaacgctttcccttggtccacttaataatagaagcgaagttaccggtgtcttagaaaccctaaataaagttttaggttcagttacttacttggttgctaaaagaattactgttgctgatttcattgtttttggtagcttatatacaaacaaacactggaatgatttaaccaaatctaaatcggcaccagttaatgttgttcgttggtacgactttctacatgcacaagaagctgttatgaacattttaaataacctaccccaagatgtagcagcttcgttgacacaagcagaaaaacaagttagtcaagagaaaaatactaatattggtaatcgaaatcaagagggaaaatttgtcgatttgccttttgcacagatgggtaaagttattgtcaggtttccaccagaagcatcaggttatttgcacatcggccacgccaaagctgcccttctcaaccaacactatcaggaagctttccaggggaaacttattttacgtttcgatgatactaatcctgccaaagaaaatgtgcattttgaaaacgttattctggaagatgtagcaatgttacagattaaacccgacatattcacatatacctcagattactttgaacttatgttagagttatgtgaaaaaatgatgaaagaaggaaatgcctatgtagatgatactgaaccagaggaaatgaaaactcaaagagaacaaaaaatcgagtcagtcaacaggaataatgatgttcagaagaatttgctatgtgngaagaatgaaaaaggtaccgag

SEQ ID NO: 15886 - DNA, 750 bp, Diabrotica virgifera
  misc_feature (20)..(41): n is a, c, g, or t
  misc_feature (49)..(107): n is a, c, g, or t
  misc_feature (133)..(150): n is a, c, g, or t
  misc_feature (154)..(188): n is a, c, g, or t
  misc_feature (228)..(251): n is a, c, g, or t
  misc_feature (289)..(310): n is a, c, g, or t
  misc_feature (327)..(349): n is a, c, g, or t
  misc_feature (508)..(521): n is a, c, g, or t
  misc_feature (523)..(543): n is a, c, g, or t
aggattattaatcaataacnnnnnnnnnnnnnnnnnnnnnnctaaaagnnnnnnnnnnnnnnnnnnnnnnnnnnnnnnnnnnnnnnnnnnnnnnnnnnnnnnnnnnngaaacgttattcatttttaaatatcnnnnnnnnnnnnnnnnnncacnnnnnnnnnnnnnnnnnnnnnnnnnnnnnnnnnnnctatacctcatattatcaataccacctatttttaagaacnnnnnnnnnnnnnnnnnnnnnnnncaccattccacttctacactaaacattatgattaacannnnnnnnnnnnnnnnnnnnnncatcatctactcttacnnnnnnnnnnnnnnnnnnnnnnncaactctttattaaaatatacatccaaattatctaaatttagtaactgatgataatattagaattacaaaactgtatatctagaaaaaatatatagggttaatacaacacttctgcaacatttcttttcaccgtggctattaaaaccctgtctttttgnnnnnnnnnnnnnnannnnnnnnnnnnnnnnnnnnnctgaatgggcgcgcgtatcttgaccgcgctaaggcagcataatcattagatattttattgaaagctgcaatgacggtgtggatcaactcacaaactgtctttattcaatctataaagaattgtatgtccacgtcaaacagctcacatcctttcacaccacgagaacaccctacatagctacatactcttattaccaaccctttttac

SEQ ID NO: 15887 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15888 - DNA, 339 bp, Diabrotica virgifera
ctgtaattacgacattttgacaaatactgggtattcgatcaaaggttattcctattggtcggatataaattactggtgctgtaaaattaattgcaactaatcttgaattatttcttctcctctgtcatatttatttgctctagtactggtataaaagatgtgaaaataaagcttctaacacagtatcaccgaaaacgaaacatgttttgttatgcaaagtgtgtctcgctgaggccatagatatagtttatccgtcaccatggtaaagtttcaagagatatggaaatcaatccccctatcaacacttcactttccatcaactgtttaaggggacatcac

SEQ ID NO: 15889 - DNA, 880 bp, Diabrotica virgifera
  misc_feature (14)..(29): n is a, c, g, or t
  misc_feature (31)..(75): n is a, c, g, or t
  misc_feature (139)..(157): n is a, c, g, or t
  misc_feature (806)..(806): n is a, c, g, or t
  misc_feature (810)..(810): n is a, c, g, or t
  misc_feature (824)..(841): n is a, c, g, or t
  misc_feature (843)..(860): n is a, c, g, or t
agagcccaatttcnnnnnnnnnnnnnnnngnnnnnnnnnnnnnnnnnnnnnnnnnnnnnnnnnnnnnnnnnnnnntagtacgtggaaattactctataactaaataaaatattgaaaaaatgagcctgtaccgccattnnnnnnnnnnnnnnnnnnncttcaaataaacttttttatcccatgcctagattttatgtaatcttggaactactaaaatgttttatttctaacaagaaatcgaacatataataactaaataactaattaggcagcatagagaaattatcactgtcattttgacaaacctgcgtcagattttctctaatctgttctgtcatctttatcgatatctgttcagtgcagtagtgtgttaatttaagaattagtttttgttgtttcataggaaagtagtgtttattgatagttaacttattatatatttgttgttgttgtataagttgttggcctctttgaaagaatagattgtttttaattgggagttttagttatatgtaggtaggtaagtatattttacgtaaaaatatttcgaattctaatgcgagtatataaagttttaggagaattttttaatctaaaaatattatcaatagtttaacaaaatggaaaaagtaattcaaacgaaaaataaagtgaaaccttccaagaaaaagtccattaaaaaccgtaccaaaattatgcgaaaatcgaaatttgtttcgcttcacaacaaaaaatgattatttattattgttttattattagatatttcatgcaaatacttttctaaatacctatcttaacataanattntcacccagttttgnnnnnnnnnnnnnnnnnncnnnnnnnnnnnnnnnnnntcgttttctatcacttccat

SEQ ID NO: 15890 - DNA, 935 bp, Diabrotica virgifera
  misc_feature (6)..(43): n is a, c, g, or t
  misc_feature (86)..(110): n is a, c, g, or t
  misc_feature (330)..(359): n is a, c, g, or t
  misc_feature (846)..(866): n is a, c, g, or t
  misc_feature (869)..(869): n is a, c, g, or t
aaacannnnnnnnnnnnnnnnnnnnnnnnnnnnnnnnnnnnnnccaaatgggtgaaaattttatgttaacataggtatttgtacgnnnnnnnnnnnnnnnnnnnnnnnnncattgtgaagcgaaacgagagcagtcttattttatttagttcatagagcgccaaaggcactctagaacaccctttaacccttcttagggtcccatcagaggtgcatatttcattctctttgaactactaaaattcgggctaccgttatcggttcacaacgaaatgatgacatgaatgccgtggcggtatctgctaaagacgaacgaaagttttacttctnnnnnnnnnnnnnnnnnnnnnnnnnnnnnncttagaactagtcttctggttaaaccaatcgtggcttgtggcttctaaaatttgcaaaccaacgaattgccggagctaaggaggccgagggaaatctaccaggttatgtcgtacttcatggaatgattatttattattttgattagttctactcgtaatctgagtattcggaactaagctttgttggaattttaccgtgctggacaggcgggaagtgagatgcagcctgatagatcttcctcggcattgttagctcctgcactttttataaaaatacactttcttcaatttttttatccgatgcctagattttgtgtcattttggagctactaatgaaataaaaaattttagtagttccaaaattacacaaagtctaggcatctgataaaaaagtttatttgaagaaattgtatttttttgttcttcttaatggcggtacaggctcttttttttaatattgtatttaattacagagtaatttccacnnnnnnnnnnnnnnnnnnnnntgngccctgtaccgccattctttgtttattacgaatacgtgtgccaatatctcgaaaaatattcaaaat

SEQ ID NO: 15891 - DNA, 796 bp, Diabrotica virgifera
  misc_feature (262)..(290): n is a, c, g, or t
  misc_feature (612)..(632): n is a, c, g, or t
catgacacaaagaatgaaaagtctgattcttctttccgacgtaacgaggaatacaaggtttgacaactctccgaggaagacgcctttccaatggtgatgatgtaactgcatctcgtattggatctagcggattctaaattgatatattctgaatacgaactgacccctgaatcgactcagtcatcctaataagcccacacgtgaccaacacattctcttgcaaattccatgagcgtcagacagttaacagaacaaccctagnnnnnnnnnnnnnnnnnnnnnnnnnnnnncaccatatcgatgcacttcaaccagtcttaatatccgttggctcaatctgtccgctacccaccatatgctctataatgtacataccgatactacaaccattctaaacacaatctgattgcagggaaaatcaggagttcataaccaatgtatctattatggatcgacgaaatgtaaccaaaaccatcttacaagatgataccaatattggcccatcgcaacacagataaaacatttaacccattaacaaacagtgaaacctcgatacagaaactctactccagcctcttcaatactgtgtggaataaatgtatagaaaaacgnnnnnnnnnnnnnnnnnnnnnaccatctgaaaagaattgtgatctagaagatgataacctcgatcatcttttacgagaagaggatagacactgacagaactatgaaacttataatactaagaacgatgtggtcagatgtcaatatatcctacatacgcacttatgacgagaccaaatgtagaata

SEQ ID NO: 15892 - DNA, 953 bp, Diabrotica virgifera
  misc_feature (779)..(798): n is a, c, g, or t
  misc_feature (823)..(824): n is a, c, g, or t
  misc_feature (840)..(840): n is a, c, g, or t
ggatggtggaccacccaggaaggacaattacaatatatgaagtcggaggatgcttagcttacgctttccccctagcttttactccaagtaatatcgagagtggattcagagttacgggtatacggcctttcaattccaatatttttaccgatgaagattttatgtcagcgtatgttactgatcgcgaagatccggaaaacaaatccactttatcccagttttatgttgcacaaccagccatagttaacaataccaacgctccacttctactggcacttttcaccacccctgaaattattagaccacattcctcaagtcgatccatttcacataatcgacaactacgacgaacactaattgaggacaaaaatcagccttctactggcactttcaccacacctcaaaaattagatcccattctgtaaacggagatacttcacaaaatgaacagctacaacaaacatcaaaagagcacaataaccatactttcacttctgccacttttgctagcccagaaatgattagaccccaccctaaagccaagcccaggacttcaacaaagggtagaaagcgagcaactataaaaattctcacagcaacactagaaaaacttgcgcttgaagctgaagttaaggctaaagaagataaaaaattagaaaaagagcaaagggccaaaataagagcactaaagaccgcgtcccaccatcaaataatttgagcaaactgaaagtgacagttagtgacgtcacatcctgagtgttcattgtggataataatgnnnnnnnnnnnnnnnnnnnngtacaaacaagttagacaactcaanntacaaaaacttgatcnaactagactgatagtgagagcacagattttttagaattcaaaaaaactgcaattgtgacgtcactttgacgtacttccctcagtacgtcaagtttgctcaaactggttgatca

SEQ ID NO: 15893 - DNA, 825 bp, Diabrotica virgifera
gaatacagtaaataaaaacatattcataatgacgataggaaaaaataataagatggtacaacacataaacttcagagttcgggtaactctgcaagactcccgtaccttcattggaactttcaaagcgttcgacaagcacatgaatatgatattaggcgactgtgaagagtttcggaaaattaaatcaaaactgtccaaagttgaacgtgaggaaaaacgagtattaggatttgttttactgagaggagaaagcatagtttctttaacaatagaaggccctcccccaccagaagaaggtttacccagagtaccaatccctggagcagccccaggaccaggaattggtagagctggaggtagaggaatgccaccaggcatggcaggtgtacctgtaggccttcaaggacctgtaagaggagtgggaggaccatcccaacaggtcatgacaccaggaggtagaggccaagtatctgcacctccacagatgaatcaaggaccaccaaggatgggaggaccaccaccaggcatgatgggaccacctcccggtatgatgggcatggctccccaaatgggaatgggacgtggaggaccaccgccaatgggaatgagaggacccccacctggtatgatgagaggtggaccacctggacctccaagacctttttaatgaattaggattaagtcaactttgattttgaaatgtgtacaagttacacagttttgggttaagtgagttttgcatgtataatatcgataggatcataatacctttgtattttttgttttgacttaaatgcagaaatacattttttgtaacatataacg

SEQ ID NO: 15894 - DNA, 926 bp, Diabrotica virgifera
cgtccgtggttcctcgctcgcatatttttcggaatccacttgtgacgaagaaagggacttgaggtccaaagaattcttaccccgaagagacgagatgtatttagccggctgaaatgtcaacacgcaaaaaatagtgacttggtcgacgtgtcctgattaacaatcgtaagtaacctagtatttttaccatatatccattgttcctttgttatcgttttttgagctatttgaccaccaacaattgatttaaatgtgagtattaaaagtgtatggcacctatgagaatttccatttaatctctaccaatagtagctatcgaagaaaaatagtaattggcaggtaatttgtattgtttattgcttgtgttgattttattaaattgttttcgttcaatacctgctaataacgtacaacaatattacttaaaaagtaagtacatatttataaattttagtcatttatataaatcattatatatttagctaaactaaactatgcataagtaactaaaatttatataatacttatatgtacttacctatttaatgagttaccaaaatagattatattttatgtattttgaagcaccgcaaacaaaataaagatattacaataaagatattgtatgtatgttctttagtcctagtactacatcattcgtcttcatcctcaacactgcatagatccatagatgatacaaataatgaaataatgcctgttttctttttcatattttacggttttttcctatccctgatccattcaggtaagaaatggtcagatgggggatatgaatgtatatattgtggaataacatcggtggtcagtgttgccaaacggagagaaatttccctttttgctggaatttcaacataaaggtgataaaaggggaaaagtaactcaaagggtacttatccattccaaat

SEQ ID NO: 15895 - DNA, 880 bp, Diabrotica virgifera
  misc_feature (827)..(845): n is a, c, g, or t
caaaaaatagtaaaatagtgttgatagcagttctacagaacaactggaaaaatttgctgccatacgaatagcgaaataatactctggactggaacaaacctattgtaacgtaaacactgacatgcgcatgcggtacgtgatactacaagaaaacgttacgtcaatgtagcacaaactctaaaccatactaaaactgcagcggttgagcgcaggtacaattacacaccacttgaaggtacatacacagatggtgttctaggaatcctttataaaacaacgataaaacacattttacaacaaaatatattttcggtgcggtatggcataccgcatgttagcggttaagggttaaagatacttgcactagccgttttaagattaaagcttaaatgtgaattagtgttaccgatctgctgaaatggtttttctccctcttcttaactggatattaagtaaaaatggtgatgaaaactactctttagtcatttgttttaagagccaccattatttataaaactccgttttagtaattttttttcatatccaattttagttttaaatgattgacaaaattaaatgagatagctgaaattctatcgtgagattatattgtacaagcacgttatacttaattctactttacagttttttctctcctcttcttcttgtatttcgttaattatctactttagtttcttattttctgacaagttaaactagtgttttttttttcacttgtaggcagagttccatattccttgtcgtgggcaacgtatttttaggcacggtattatttggccattatttgagaaagtttgtcttaaatnnnnnnnnnnnnnnnnnnncccctcttttgataccccgagcctggttttatgac

SEQ ID NO: 15896 - DNA, 865 bp, Diabrotica virgifera
  misc_feature (533)..(556): n is a, c, g, or t
cgtgctttctttgttgataaacaatattttaatcaaagtttttgtattatttgtatcctggaacaaaccggcaattgaaaagccatagcgaattaaaaagattctagaatatcaaaaatggcatcagattggacaaccaaagagaaacatcagctgctgatcggattgaaacaatttgggtcgaaaaacttggaggccttacataaatttgtacccaccaaaacccctatagaaatacaattattttgtgatgactatgctaaagctgtcttaactaaagatgaattcgaagataaggtccctccaataaaaaaatggcttttagttttaaaaaggcttcagcatagaaagcctgatactgttcatgatttaattcccagggtactgaaatacattgcgttatatgagaaaagaggaggctcgaaatcacttaacttgagtcagtgttatttagcactatctactatgtgccgtggactggaaactcaaccattagacgataatagtgaatatttcctatatgaatgtttaannnnnnnnnnnnnnnnnnnnnnnnatagtgaatgtaaatcctatcagaagtatattcgcagtaaagcaaccgcaaatggcattacgtctaaagaagcagatgatgtgttaaacccactaggaattccaagttcttttacaaaagggggaaataatgcagaggtcctacagaaataagtggaatgtgtataattgttgtgttacaaataatttcgaatatttttttggcagacactattagtaaattttgtatgagttattgacagtattaaacagtaaagactaataaacataacatgtcaaaattttgatgaaaaaaaataaatttgctttt

SEQ ID NO: 15897 - DNA, 616 bp, Diabrotica virgifera
  misc_feature (579)..(599): n is a, c, g, or t
cagacgtgtatatttaaattcagtgaatagatttaggttttaatgattgtttaaagaatatttacatttttgtgactgacgttcctgtggaatctgcaataggtttgatctttgcagcatgtatagtatatgtaatcacacaatttaacgtagccatatatctgtattccagacgtgtatatttaaattcagtgaatagatttagaagaccatttgtagcaccagtagttcgaaggcaacctcttagaaatgaaaggaattatcttaatttgcctatgaacagaagacctgaagttagaagaagcttagtttcacctgaaattagacgaagttttgttggggaagctaccccaaatatgccaaataaaaatgataatatagtagttgatgaaaggtattgtgtgatatgccaagagcgtagtaaatgtattctggtactgccatgtaaacatgtatgcatgtgtatggagtgtaatgctcaattacagttgtaccatactacctgtccaatttgtaggaatgatattgaaagtactatgaaaatatttgtataatttgataatatataatgtatttacnnnnnnnnnnnnnnnnnnnnngttttatatgtgttctt

SEQ ID NO: 15898 - DNA, 886 bp, Diabrotica virgifera
  misc_feature (37)..(69): n is a, c, g, or t
agagaacagacgtgtttctgctttggttctgacgggnnnnnnnnnnnnnnnnnnnnnnnnnnnnnnnnnatcgctagtagtgtttaattgtgttcctttttgcgattcaactacctacatttgttaaaaaggttgttgatcaacaaagtttttgagtgaaggcaacgaaaggcgttttgagttgagcgttcataaacctcagctcaattcctggtaaaggaagttcagaagtcaacatttctagaagaagacaaggcgaatctaataaagaggatccaaaattttctcgtagggtatgtctgtcaaaatgcagtcaaaaagcaaccgtcttcccttagatggtggtggtacacttagatactggagaagattcttgacctgattgacgattaatacccattatactgttctgaccaataatccaaattgaaaatgtcttattatttcgctatgtccctgtcaacatggtccctgccagcaaagttcaccacctttgtggatcctatcgagaaatacctgtcgcatacccggcacgaggtcggggtaagcttgcgcgagcaaatcgaggaggacttgatgacggcgacggagaaaaggcactcgttcgaaagcagtgccatagatccagtttcgtttatgtatgtggacccgtacgacgtgaatccattatccagaagctcagatttgccccccgcaacgatactagcagatataccgctcaaggtcgaatccagtgtttcacaacagagccagttcgcaacaggaggtggtgtgttttacgttcctccaaggagaatcaagttggaaatggaggaattcggcgacctatcgtcgttcgtttccccccaacggataatatccaatgctgtagatgaactcaatactc

SEQ ID NO: 15899 - DNA, 86 bp, Diabrotica virgifera
  misc_feature (2)..(84): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnga

SEQ ID NO: 15900 - DNA, 903 bp, Diabrotica virgifera
  misc_feature (236)..(255): n is a, c, g, or t
caacgcgttccttcggttaataatgccttacatcactgtatatgcgagatttgctcccaaacagaaggaattcgttgtgacacagttaaaacatttaggatacgtcacattgatgtgtggagatggtacgaatgatgttggggctttgaagcacgcggatgttggcgtggctattctggctaatgctccggaaaagcttccggatccaaaggttcaaaaagagaagttagaaaagnnnnnnnnnnnnnnnnnnnnagaactaaaggaagctatgtcagctcaaagacctaaccatgtacgaaatatgataaaccaaagagataagctacaatccaaagttgataaaatgatgaaggaaatagaagaggaccaaacaccgatcgttaaattaggagatgccagcattgcttcaccgtttaccagcaaactgtcttcgatcatgtgcatttgccacataatcaagcagggaagatgtactctagtcacaacattgcagatgttcaagattttagcgttgaacgcccttatattggcatatacgcaatcggtgttatatctggacggaattaaattaagagatgctcaagccacgttgcagggtctacttgtggccgcttgctttttgtttatatccagatcaaagcctttaaaagtgttgtcgaagcaaagaccattgccgaatattttcaacctatacaccattctgactgtgattacacaatttgctgtacatttttgctgcctaatttatctggtacaggaagctaagttgaggtccctgcctgaggacgatcctttaaaaatcgaagcattagacattagtgatgaagaaaaagagaaactgtcaaacctaacattgtaaatagcaccgtatacatcatttctatggcgctcaaatagcta

SEQ ID NO: 15901 - DNA, 846 bp, Diabrotica virgifera
  misc_feature (77)..(100): n is a, c, g, or t
  misc_feature (519)..(536): n is a, c, g, or t
  misc_feature (818)..(845): n is a, c, g, or t
ctaggaaagaaaattcaaacatgaaggctattgtcaggaccggaaggatggctcaaaatgttttgccattccaactnnnnnnnnnnnnnnnnnnnnnnnncttggaccatttgtgtgcccttgatatcaattccagagcctcgtttatccgtctttctggaataaatgtaccattgttttaaatttgtttaggacccgcttcaagggacccagagatcttggtccaaatgatggaatctggtatgaactgtgcccgtttgaacttctctcacggttctcacgaatatcacgctgagaccatcgccaacatcagaaaggccgtcgaaatgtacagcaagaaaatcggcatgccctacccattggccattgccctagacaccaaaggtcctgaaattcgtactggacttttagaagggggtggctctgctgaagtcgaactagtcaaaggacaaacaatcaaattgaccacagataaggcttatgaatccaaaggcacaaaagactgcatatacgtcgacnnnnnnnnnnnnnnnnnngtagtcaaagcaggaaaccgtgtttacgttgatgatggtctaatttctctagtagtagacagtattcaaggatctttcctcacttgcacagtcgaaaatggtggtactctcggcagccgcaaaggttgcaatcttcccggagttcctgtagacttaccagccgtctcagaaaaggataaatcagatttgagatttggtgtagaacaaaaagtagacatcgttttcgcctctttcatccgtgatggcggcgctttgactgaaatcagaaacattctagggggnnnnnnnnnnnnnnnnnnnnnnnnnnnnc

SEQ ID NO: 15902 - DNA, 745 bp, Diabrotica virgifera
  misc_feature (2)..(76): n is a, c, g, or t
  misc_feature (84)..(513): n is a, c, g, or t
  misc_feature (515)..(619): n is a, c, g, or t
  misc_feature (621)..(639): n is a, c, g, or t
  misc_feature (644)..(671): n is a, c, g, or t
  misc_feature (673)..(728): n is a, c, g, or t
cnnnnnnnnnnnnnnnnnnnnnnnnnnnnnnnnnnnnnnnnnnnnnnnnnnnnnnnnnnnnnnnnnnnnnnnnnnnatattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnngaacnnnnnnnnnnnnnnnnnnnnnnnnnnnntnnnnnnnnnnnnnnnnnnnnnnnnnnnnnnnnnnnnnnnnnnnnnnnnnnnnnnnngttatttaattgtgatg

SEQ ID NO: 15903 - DNA, 123 bp, Diabrotica virgifera
  misc_feature (3)..(88): n is a, c, g, or t
  misc_feature (92)..(122): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnngacnnnnnnnnnnnnnnnnnnnnnnnnnnnnnnng

SEQ ID NO: 15904 - DNA, 617 bp, Diabrotica virgifera
  misc_feature (48)..(65): n is a, c, g, or t
gcgaagagttgttattcatagatataccttgtataaaggaatctttcnnnnnnnnnnnnnnnnnngacacaaaatttctcccaccgaccacgttagaatcggtcagctgtagtttttgcaatttatttcatatcgattaatttttttttcgatacgattatggacaccgaccatcgattgtgagtgatttaactagaaggaataatgtggcacataatatgtacataaaaataagtatttacataaactgtatagtattagggtagatttttatagcaaccatactaaataggttcttcagaattttcttctctacttttaagctaactttgctttcctcatttggtctcgtttttacagtatagtgaatggtaatcggttttcagtttaaaagaatttgatcccatcctgatattttttattccgatttctattttttccttcagcatttctgctgtctttttggctattcagtttttgatattcagtcttacttcgctttctagtatatccggctcatcttctatttcttgtaagttaatgtatatttcagattttggacgccttatagatactagcagcatgatctccacgtctttgctatatcctctttattt

SEQ ID NO: 15905 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (201)..(234): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagggnnnnnnnnnnnnnnnnnnnnnnnnnnnnnnnnnntact

SEQ ID NO: 15906 - DNA, 839 bp, Diabrotica virgifera
  misc_feature (2)..(665): n is a, c, g, or t
  misc_feature (667)..(768): n is a, c, g, or t
  misc_feature (770)..(798): n is a, c, g, or t
  misc_feature (800)..(834): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnngnnnnnnnnnnnnnnnnnnnnnnnnnnnnnnnnnnnggggc

SEQ ID NO: 15907 - DNA, 759 bp, Diabrotica virgifera
ccgactataaaaacgctttcgacaaagttaaatacataattcatatgtaatgtctaaagcgaagaggactcgacaaaaattatattaacatagtgagaaatctctattggaaccaaccggctgcggtaacattaaatggaaatatcacagatgcgcaacacctaagtagagtagtgagacagggccgtgtactttcaccattactctttaatgtattatgctccgaagacttatttacacaagcacttgaacactgtacagaagggatctaatctagataaatagtgaaaatataaataatattcgctatgccgaagtcattattcttgaaagtgagaaagacctgcagaggccactaaacacaatttgtgatattggaaaaagctagaagcttttgagatgtggctttttaggagaattttgaaaataccatggaccgatcatactcgaacgaaatgacgttgcacagaatgggaagatagagaacttttgaccatcattgaaaggagaaagatagcatttggggcacaaccttggaaatgataagcacgagttgttgcaactgattatgaagagtgaagacgaaggaaaaaggggtcctggtagacaacaaatatcctgcctgaaaactattcgcgactggaccgggttaaatacgcagacgcttttaagaaaagcagaagggcagagacaaatttgcaatggttataggaaaccttcattaggaaagccggcactatacgaagaagaagaattatt

SEQ ID NO: 15908 - DNA, 50 bp, Diabrotica virgifera
  misc_feature (17)..(46): n is a, c, g, or t
atttttctacgaaaggnnnnnnnnnnnnnnnnnnnnnnnnnnnnnnctat

SEQ ID NO: 15909 - DNA, 943 bp, Diabrotica virgifera
tgctccatcaatgatattttgataattttttaagatcaaaacaactattgacccagtgaagaatttcattctaaatctaaatatagaaacaattatggcaagtttggtaaagagcacgtatgtacggaaaatacaactactaaaggaaaatatcttgcgaactgctgtgaggaattataagccgagacgagccctcatgtatgtacctggcaacgatttacggaaaataagtaagatatctagtctaaatgtcgattgtatagcactagattgtgaagatggagtggcattcaataagaaggtatggcaaactataaaatagtgtctaagcagcttgcatgtgcttttgtagatagatagaccatagatagatcatgaacattatccatcatttgggcttattccagtattggatgaagctaggcaaacgatacgagattctttagctcaattagtttcaaattcggaaattaaaagtgatataggcgttagagtcaattccattgatagtgatatgtgtgaaaaagacctggaagtttgtttatctggaaaggtgttacctcatactgtattgctgccaaaggtggaagagagtgaccatctgcgatggttttcagaaaaattagacaaaagtatccaaagcagcaacaaagttaatttaataatttatatcgaatcagccaaagcatttacaaacttgacggaaatatgtaagactgctgtagagttatcggaaaaatcaaagtttgtaccaaactcattggtatttggaagcgatgatttctgcgcgagcataggagctacaagaactgaagatgcaatagaagtcctctatgccagacagatgttggtgttgaacgccaaagcttttaatttacaagcaatagatatggtgtacatcaattaccaagatcggggtggattgaaacgtcaaagcgaacag

SEQ ID NO: 15910 - DNA, 136 bp, Diabrotica virgifera
  misc_feature (2)..(18): n is a, c, g, or t
  misc_feature (33)..(50): n is a, c, g, or t
  misc_feature (73)..(90): n is a, c, g, or t
cnnnnnnnnnnnnnnnnnaagtttgtctgaggnnnnnnnnnnnnnnnnnnggaaattgatttaactgcggcgnnnnnnnnnnnnnnnnnngctttctgtataggatgataaaaattaccaatcgttttggtcctct

SEQ ID NO: 15911 - DNA, 883 bp, Diabrotica virgifera
  misc_feature (5)..(30): n is a, c, g, or t
  misc_feature (33)..(745): n is a, c, g, or t
  misc_feature (752)..(789): n is a, c, g, or t
  misc_feature (809)..(822): n is a, c, g, or t
  misc_feature (825)..(847): n is a, c, g, or t
  misc_feature (855)..(876): n is a, c, g, or t
agggnnnnnnnnnnnnnnnnnnnnnnnnnncgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaa

SEQ ID NO: 15912 - DNA, 511 bp, Diabrotica virgifera
  misc_feature (18)..(19): n is a, c, g, or t
  misc_feature (24)..(24): n is a, c, g, or t
  misc_feature (27)..(27): n is a, c, g, or t
  misc_feature (30)..(33): n is a, c, g, or t
  misc_feature (36)..(38): n is a, c, g, or t
  misc_feature (43)..(43): n is a, c, g, or t
  misc_feature (56)..(56): n is a, c, g, or t
  misc_feature (71)..(71): n is a, c, g, or t
  misc_feature (80)..(80): n is a, c, g, or t
  misc_feature (93)..(118): n is a, c, g, or t
  misc_feature (152)..(169): n is a, c, g, or t
  misc_feature (173)..(202): n is a, c, g, or t
  misc_feature (207)..(238): n is a, c, g, or t
  misc_feature (240)..(265): n is a, c, g, or t
cctccttccaggggccgnnttaanaanatnnnnagnnnaaatntacttgtgggagnattggatagaattgnttttttaantttaattgaaagnnnnnnnnnnnnnnnnnnnnnnnnnngtaaagggactaataaagttggatttttgggttnnnnnnnnnnnnnnnnnnatgnnnnnnnnnnnnnnnnnnnnnnnnnnnnnnattcnnnnnnnnnnnnnnnnnnnnnnnnnnnnnnnngnnnnnnnnnnnnnnnnnnnnnnnnnngatatttattgaatttagtatagatattattaagattatagtaatttattatttgaatataaatgattatattattagtattgatgattaggttgttgggatatttagtgatgataatgaataaggaaaaaggatggaattgtaaattgactaggaatatgtattaatagtaagtaatattgattgaaatatattgaagaatatgtgtagataatagtatgttggattttattgatgatatagagt

SEQ ID NO: 15913 - DNA, 463 bp, Diabrotica virgifera
  misc_feature (17)..(17): n is a, c, g, or t
  misc_feature (19)..(19): n is a, c, g, or t
  misc_feature (36)..(41): n is a, c, g, or t
  misc_feature (65)..(65): n is a, c, g, or t
  misc_feature (71)..(71): n is a, c, g, or t
  misc_feature (83)..(83): n is a, c, g, or t
  misc_feature (123)..(140): n is a, c, g, or t
gttttaaaaagggggtngnttaaaaataaaattttnnnnnnaatttaattttataaggaggaagngaggantaaaaaatttanatattttaaaatagtgatattagtttattgtttatgtgtnnnnnnnnnnnnnnnnnnaaaaaaagagatatggaaaaaagagagagtatggagggatgataggtgaaagaaaagagtttaaagaaaattatgaagaagatagtaggaaagaaataaagagagatggtgtataaagtataaaataaagagacggaaagatagtgtagagtatgttttgaagaagaggaggaaagaagataaggtgcatgaggtatatagatgaaattgtaggggcgatataaaaaggatagattatgatagtgaataaaggtgggtagatgaaaaacaaaaaggtgtgaatctaggataagaaaaatgtgtataatgtaaaaaagaatata

SEQ ID NO: 15914 - DNA, 784 bp, Diabrotica virgifera
  misc_feature (421)..(435): n is a, c, g, or t
aaagaaactattcctgataagttattaccctattgtgccactgcaggcttggctagagaagatactgttgtttcagaagtaaataacccaaatggaatacaatttggtagcaatatgtctactttaggccgaagtagaataactgttgcaacctgtagttgtgcaggaacgtttttccagttgagcattcccagaggtcattttactcatatagttgttgacgaagcagcacaagctggagaacctcatgttatgattcctttatcttttgtaaataaaaattctggccaaattatattagcaggtgatcctatgcagctagggcctgttatattatctaaagttgctaccgaatgtggactagcagagtcttatttggaacgaattatgagcagatttccatattgtcgtgatccagaannnnnnnnnnnnnnntctggatttgatccaagatttgtaacgaaattattatataattacagagcccttccggacattcttactttgtacagtacactcttttatcataatgagttgataccgactattgacgatgaaactagcaatgaagcaaaactgctaacttctcttcaagatttcttaccagtcaaacgtgataagctaacccgaatactatttcatggagtaattggtgaaaactatcaaacagcagattctccatcttggtataatccccaggaagtagcccaagtgttttattatgttaatcagttttacaggctttggagtaaaatctgggggtataggcattgtccccccctta

SEQ ID NO: 15915 - DNA, 921 bp, Diabrotica virgifera
  misc_feature (66)..(81): n is a, c, g, or t
  misc_feature (83)..(850): n is a, c, g, or t
  misc_feature (852)..(920): n is a, c, g, or t
atttctcttccaaataataaaataatctttctccgtaaaaggtaaagaaaaattttcatcttaacnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnng

SEQ ID NO: 15916 - DNA, 478 bp, Diabrotica virgifera
aggatcaggaattattagataatgatcattcgaagtgatgacagtatcaacctcaagtaagttgatgatcgagaggttcaaaacaaagtataaaatattatccgactgttttgcttgtaaatagctcatactcatattgtacgatctcaatcggatacctcaccagccgggattggcaccgtgtatatataggtaataagtgaatacttcaatcgtgctgtatcagcatagaaccgcatgataaacagaaaatgaacagatgataattatgcagagaatcttaaagacaggatgtacagagcatactatactcttcaggaaacacttggaattgcattgtctatgtataacgcacttctgcggtgatcgagggaaaaaagcaccgacaacaacaacatcagaagatatctagtacggattgccagaccatggatatgaagttataaaaggcctatgtgctcggcatgcaatattcccc

SEQ ID NO: 15917 - DNA, 898 bp, Diabrotica virgifera
  misc_feature (2)..(770): n is a, c, g, or t
  misc_feature (772)..(798): n is a, c, g, or t
  misc_feature (817)..(846): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnngagaagacccctatagagnnnnnnnnnnnnnnnnnnnnnnnnnnnnnntaggcttaaacctaatttaacataaataaattctattttaaatggggggcgg

SEQ ID NO: 15918 - DNA, 647 bp, Diabrotica virgifera
  misc_feature (78)..(119): n is a, c, g, or t
  misc_feature (136)..(165): n is a, c, g, or t
  misc_feature (196)..(230): n is a, c, g, or t
  misc_feature (269)..(296): n is a, c, g, or t
tttaattggggtaatttagtgtgtgagcgtgtgtggtgttgtgtaccttcacaaccaacttaaattagtagaataacnnnnnnnnnnnnnnnnnnnnnnnnnnnnnnnnnnnnnnnnnntggctggatcatgaacnnnnnnnnnnnnnnnnnnnnnnnnnnnnnnctaattaaatagatctagataattaatatgnnnnnnnnnnnnnnnnnnnnnnnnnnnnnnnnnnngcatgaagtgaaatgctttaccattaaaaggatatatannnnnnnnnnnnnnnnnnnnnnnnnnnngatacacatttaacattttattagactgtgttcatataactagtatttttgatttatatagaaggtatcaccagttcaattatcacaatgaatgaaggatgaatactaaccgagactagaaattttaatcattaaaagttattattgtacgcagaatagtatagtacaatgtgtagataatagactctctttacttgacaaggacgtatagttctcagaaccaaagtccggatacttataatacgattcaaatactcttgctgactataggaagatattacgaatccctttagagctccctaagtatagatgtcatctattcatgacgatgacctctccaagtatcacctc

SEQ ID NO: 15919 - DNA, 520 bp, Diabrotica virgifera
  misc_feature (2)..(501): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatacaggaattcggcat

SEQ ID NO: 15920 - DNA, 150 bp, Diabrotica virgifera
  misc_feature (2)..(18): n is a, c, g, or t
  misc_feature (20)..(62): n is a, c, g, or t
  misc_feature (70)..(88): n is a, c, g, or t
cnnnnnnnnnnnnnnnnngnnnnnnnnnnnnnnnnnnnnnnnnnnnnnnnnnnnnnnnnnnncgaaggcnnnnnnnnnnnnnnnnnnnctctttattcactttatcaaagaaactttatttctaacgccacaacaggtcaaatttttttt

SEQ ID NO: 15921 - DNA, 939 bp, Diabrotica virgifera
  misc_feature (50)..(65): n is a, c, g, or t
  misc_feature (595)..(615): n is a, c, g, or t
  misc_feature (662)..(662): n is a, c, g, or t
  misc_feature (673)..(694): n is a, c, g, or t
ccgggtccgggaaatttcccggggtcggacccacggcggtccgccaattnnnnnnnnnnnnnnnnctctctctcggttctcgggtcattctccaacaaactccttttttcatctcctctctctcaatctccactgtgttcatcgaatgggggataatctctctctaactacacgacagccatatctctcatcatcctcttcctcacccaaatcagagctctcaatactcaaaagaaataatccagcagaaataccagggctcctcgacttataatcatatctagataatcagtaataaccaacaaaatacaaatccaatcactaattcgacagagattaacattaaagtcggtgatcacattcgaatatacttaatcttcccatttcgaatatactcgattataaaaatgccacaagaaaatagcttcagaacaacattaagtggtgaactcgggacaccggttacggatgggacagttgatattacaagaattttgtcgacacaacgaaatttccagtgaaatatagaaaaacactagaaattccttataataagggagatttatatccaaatttattgttctggatcaaatannnnnnnnnnnnnnnnnnnnnatcatagacctcttatacatataaggtcatcatggatacatattgtngtttaattgtnnnnnnnnnnnnnnnnnnnnnntttcaaaatagtaggcattgtagggaaatataaaaatgttgtaacaggttaactcattacgtgaaatatcatctttcacgtcaaaatatcacacttcacatgaaataaatttaatgccaaatggtataatttccaagccaataaagtcatatttcacatcaaatgtcacatttgtcgttaaagtaacatatcctgcctggtaaactgtatcatttggcgtaaaacttaaaattttgacgtgaaat

SEQ ID NO: 15922 - DNA, 881 bp, Diabrotica virgifera
  misc_feature (24)..(45): n is a, c, g, or t
  misc_feature (421)..(457): n is a, c, g, or t
ccttacgcgtccgtattattccannnnnnnnnnnnnnnnnnnnnnaaagaatgtctgtgaacgaaagggtccaggaggaattggaagcgttagaagcaattttattggacgatatctccatagtatatgatgaacagggtcgcccggaattggtcaagtcgacgatttttccctcaactgccaatgaagtcaacaaacaatatgttcgtgtaaccctggaagtgagacttccagaagactatccagattgcatgccaaacgttcaattaagaaatcctcgaggtttagatgattctacgataagcgagatatacaaatcaattggggataaatgcgcagaatatgtcggccaacccgtaatttttgaattgattgagctcatcagagaaagccttacagaaagtaatttgcctacatgccnnnnnnnnnnnnnnnnnnnnnnnnnnnnnnnnnnnnntagttttaccaaaactgagtgttaccactatttccactcctattgcttacataaacatcttgttactaccaaaaggcattatcaagaggagcaagataagctaccgttgtggcaaaagtctaccaaaggatttcaggcaacttgcccagtttgtcgggaatcaataaactgtgatgtcgaagaactgaaatcagctcttcctcctaaagatttagaaaatgctcaaaaattcgaagttaccagtgatttaaggatattacaggaacacatgaaggaattgtttacttatcagaaaagcaaaggcggtattatcgatatcgaagcggaagaaaaatagttgcttcttattaccgaaactaatgaagaggaggcttctgatactagtgaggacccagggcccagcgatacaatgctacaagccgac

SEQ ID NO: 15923 - DNA, 410 bp, Diabrotica virgifera
  misc_feature (3)..(30): n is a, c, g, or t
  misc_feature (32)..(46): n is a, c, g, or t
  misc_feature (48)..(90): n is a, c, g, or t
  misc_feature (98)..(113): n is a, c, g, or t
  misc_feature (115)..(409): n is a, c, g, or t
ccnnnnnnnnnnnnnnnnnnnnnnnnnnnncnnnnnnnnnnnnnnncnnnnnnnnnnnnnnnnnnnnnnnnnnnnnnnnnnnnnnnnnnngtacctcnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 15924 - DNA, 779 bp, Diabrotica virgifera
  misc_feature (325)..(352): n is a, c, g, or t
  misc_feature (427)..(444): n is a, c, g, or t
ggttgtcacctaacttgatgtgcaagggtccgaatgccacctctcacatccacctcaaaaccgatcctccctggtctatacatcgattttcttgaatgatggggctataacgtactaacaaaggcgatataaaaaacgacgatagccaacgcttgtaaacaagcacggcacacaaagaagaagaagatgctaagaagatcgctcaaatcggacagcgggtttgggaggttcgagacatctggcatgtaccatttttgaggtgttccgttgatcttgccgctgtgtataactaaatcaatattattgataattatgaaatcaatgnnnnnnnnnnnnnnnnnnnnnnnnnnnngatattcaagacatacagataatcgcaagaaaataaacataattgtgtgccaaaagatactaggctcgacagccnnnnnnnnnnnnnnnnnngttaaggtagttattgttcagtggaacagttttcttagcatacatggctaatttgtattgagttttcttgtaataataatctggggtacctattgttttattgtgtatcattgtttttggttttggtcggcaactcaagacattcgagagaaagatactgagaaaagtatacggtgcaagagaatatcagcagaaacgacgagattaatgaattaaatgaacggtacgctattcaataggtttgttccaactcaatacaaaaccgttgttagcagtgacacatttttcgttactgcgccatactctcgttgaaacaaaacttatatataagcttt

SEQ ID NO: 15925 - DNA, 581 bp, Diabrotica virgifera
  misc_feature (177)..(195): n is a, c, g, or t
cgtttataagtcaagagagaactaaaagaggagggcgagctagatgattcttttattgacagcataataagtagtgaacaaagtcatatcaaaaacataaagccagatccagatggtccatgtgacaagattcaaacacattcaaaggggagcacaatagacagtggtattacaatnnnnnnnnnnnnnnnnnnnggattaggtaaacagaagcaagaaaaagaggaatcaaaaaatgaaatattaaatacgcctattaaaactgaacagttccgggatgagtcaaacccttcaccttttaacaaagagttgttccagaatttcaccttgcatagccctgcaaccaaggactgggtggaattgatggaagaggaagtgaggcaaaatgacaggaaaagagcagtaaaacgagtgttcactgagccgataaaagaagaaagtagcacctctagttctagttcttcaagtggagaatggaaaactggtagtggcaacagtagtaatgaagaattagaagtactacctcccggaaagaaaacgaggaatgaactgcgaaccttaaatgcaaaataaacatccaa

SEQ ID NO: 15926 - DNA, 438 bp, Diabrotica virgifera
gccatccaatattgccagatcgattccgctagaattggtggagtcaatgagattctatctgtgtacttgatggctcaaaaattaggagtaaaagtatgtcctcacgctggcggtgttggtctctgcgaaatggtacaacatctacaaatgtgggactacgtctccctatctggaacctccgaaggtaaatgggtagaatacgtcgatcagcagcacgagcactttgtgcacccaaccataattgaaaacgcccattatttagctccaagggctcccggttataacacagaactaaagaaagaagcacttgaaggctacgtttaccccaacggaaaagaatgggaaagcatgtttgccaaaggaatattccatgatccaagaaaagcacaataaattaaaaagtacattggaacatattactcttctgtttttatgaag

SEQ ID NO: 15927 - DNA, 760 bp, Diabrotica virgifera
  misc_feature (7)..(715): n is a, c, g, or t
  misc_feature (728)..(758): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctatggaggnnnnnnnnnnnnnnnnnnnnnnnnnnnnnnngc

SEQ ID NO: 15928 - DNA, 856 bp, Diabrotica virgifera
ataatctcttccaagttttgacactctttataaggactttctgcatctttcttctcgttaggtttcttgaacctgctctgcctaacgcgcaactcttgaatcaactccctattactggacagactatcagttcttacgatccccttaaaagaaggcttcggaatcaacccttgtccataagggttaacgtaaatcggtgacagaccatccattggattgaaatctagttcttgcagcggggttttgagtatagaaggacttcttaagggagcatcatagtatccatgttgattgaagtgattattttcagaaacgtttcgcatgtattcattatcaacattttggtttggggcattaccgttttgatttgcgtaatgaatttgagccaaatttatattttggtgatagttttcactgtttggccggatattgttgtaattgaactggaggaaatctgtaggtgagttcacaaaaactggtgatgctggtttaaaatctccattactaggtggtagaagtttctggtctttgtcttccaaccttgttggagatggagagctggatccttcggataaatgtttgccataggaattagatttatcaaaaatctccggtcggaaccatccctctgaaatcttccttgtcgccatgaccgccccccttccctcggactttactgagatcttttccttcccctgcgccccactccccatgtccccgttatctttaattcagggcatccccccgctctggccataaatcgctcatacccatttcactttctgacttttcctacttaccctaatatcgcctcccatctatctgcgcccgggctggcccacccctcccccccccc

SEQ ID NO: 15929 - DNA, 415 bp, Diabrotica virgifera
  misc_feature (4)..(39): n is a, c, g, or t
  misc_feature (52)..(69): n is a, c, g, or t
  misc_feature (73)..(90): n is a, c, g, or t
  misc_feature (316)..(334): n is a, c, g, or t
gagnnnnnnnnnnnnnnnnnnnnnnnnnnnnnnnnnnnnttgttagtattgnnnnnnnnnnnnnnnnnnaatnnnnnnnnnnnnnnnnnnttggaattcagcaacgtttttttcttctgattattatagaaatgtcattatgttttatatatattgtgtcgcgtgacgatagtctaatttgaatagatcgtgaagtttatagagacgtcactaagaaagtattatacatatagatatatttaacaagaaaactataccataaattattatcatcaaaatacaaattagggatgatctaattaaaaacatctttttnnnnnnnnnnnnnnnnnnnccaattagaaccaagaggttctcatattctctattcatgatagtagatatctcttatatctaatcacctcgtatctttacc

SEQ ID NO: 15930 - DNA, 658 bp, Diabrotica virgifera
  misc_feature (600)..(617): n is a, c, g, or t
tactttttaagttagatgaggaagagttgtttttcgctattttcgggtctatttttttgtgaaaagtgaaatacaattatcataataatggtgctagagcagtggttcccaaccttttatgtctggcgacacaccttctgatgttttttcatattcacgacccatcccttacccatgatgatatataatgtacctaagctactcagctactgtaagggccacgctgcgacccacctgaaacctgcccgcgacccactagtggtgtattgggattcacagcatctgttagtaaggatcctattaagagcaagacaatttcttttaatatttaaatgtccttggtaaacaaatacgctttggtcgtacacatgactgacccagattactacacaagtgtatcagttatcgatactgcaaggtcagcttttctgtgacacatattattctttatttataatcaagcagattcggcatttataatacaaacactttcacttttatatatacaaaacatagacagggaattccacattctaaattggttgcgtaaagactgcatatagaaatttgagaccccccagggagaatatacattaagcnnnnnnnnnnnnnnnnnngcactccgaattgcgaataactagcaaagccgccctccccc

SEQ ID NO: 15931 - DNA, 420 bp, Diabrotica virgifera
  misc_feature (15)..(15): n is a, c, g, or t
  misc_feature (21)..(21): n is a, c, g, or t
  misc_feature (30)..(30): n is a, c, g, or t
  misc_feature (32)..(32): n is a, c, g, or t
  misc_feature (37)..(37): n is a, c, g, or t
  misc_feature (58)..(58): n is a, c, g, or t
  misc_feature (61)..(61): n is a, c, g, or t
  misc_feature (63)..(64): n is a, c, g, or t
  misc_feature (86)..(86): n is a, c, g, or t
  misc_feature (97)..(97): n is a, c, g, or t
  misc_feature (138)..(156): n is a, c, g, or t
cctcgctcctagggnccgaanataagagangncgaangccgaattcttttgagggggngangnnagaaaagaggaaaaaaaggagnaggaaagggangggaagaagaaaaggaggaggtattgtgaaagagagtaggnnnnnnnnnnnnnnnnnnngggagtgagttctctaccagccaggctattgccgcaagtaggggagtgtctgcgtacggtatacacaaggaccgtcaacggacagcacctggctaagatgacaagtacgaagcagaaagaacccctagagagacggcaaaacgcgaagaagtggacaacgacgcgaaggctagcggctcaagacaggaaatgtcatcgcagataggacagaacagaaactaatcgagtgccgtcatctgagaacacctatagcagacagcccag

SEQ ID NO: 15932 - DNA, 932 bp, Diabrotica virgifera
  misc_feature (59)..(78): n is a, c, g, or t
  misc_feature (139)..(157): n is a, c, g, or t
caactctaccttatcggtaaagttgaccatttgtgcacagtaaattgaaggtgcaaatnnnnnnnnnnnnnnnnnnnnatgtatgtctttgtactcactttatattgctcaaaaaattacggaatctgaatttcaatgnnnnnnnnnnnnnnnnnnnctcgtatcaaagttgctcgtgaagttaggcgagatgatgacagttgcgattttggggacgacacatacactatcagttcgtccgactcagtaaggataaaaaagaatatcacaattatcttagtgagctattgacaccagctttgtaaaaactgtataataccgtaacctaatgtgctaagccacacccagaacagcatatgacacaattgaaatgaacttataataaatatgcgtgagtgcacaagaatagaggtacaagcataccatatcgtcgtagtagacattctactgagattgactgtcaacataccgctccccacgaatccttactataccactccgtcgatgaagaaacaggatgagttttctataatatcttgagagtagcgacttttctgtcgatgataatccacgtgccccgcctgcaactctccccacacgccgttactgaagcatctactggtgctgtaaaagaaacaactgtatacagacccgccacccacatttagagcattaagtaataatacattatcttgataacgcaggctctatgcctccctctcctcccaacccaccctctaatgtccaactactccacctgaacccccctcctgccccggccttgccccacaccctccccccccacaaaacccatgccctgctaactggagcctccccacctctccaccccacttctccctttccccttcccataaataacccctcttcgccctcttcgcccccccaaaacccgtccccacacaccccacact

SEQ ID NO: 15933 - DNA, 825 bp, Diabrotica virgifera
  misc_feature (672)..(693): n is a, c, g, or t
gaaagtgtcattagacctaatacccgttgtaaccattactttagcatacttttccggttttcagaatatcgagagcacctaataggttacacagtatttttgtcacaaagcttaaatctctatttgtaagttatttagaccttgaaaatgtttggtcagtgttatctctgggtgtgtcgttaaactggttgcctactaaaacaagaaagaactgaaagagtttaaacttctaaaatgattatgatttattgtctccccttgtaccaattctagtgatatttaacagaaaaatcgcgtgtaaactgtagtttttattagagaatgcacggtgttgtttaatttatagtatttaaaaaagtgtcaccctattattaaatttaacttataagattatttgtttgtcgggaaaaatattcaacagaataatataaattaaagaactttaaaacaaattctactattaaacaaaaatatcagctaaatagctaaaaggactactggatgttaaaattaacagttatacataatatatacgtctattatagctataatataaatggttacgtaatgcttattgtttgttataaagttctttcatagattctttatacctacctacctagtatgcctttaaatgtgactgttttctgccttaaattgtatgtatctagnnnnnnnnnnnnnnnnnnnnnnaattcgatgtacctaattatgtttctttctgggaattgcaatatcactatgttatttccgtttttccatgtttggggggatgtatgtaaaattaattaattgaatttttcaataaaacccaccactggaaaa

SEQ ID NO: 15934 - DNA, 407 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(190): n is a, c, g, or t
  misc_feature (200)..(240): n is a, c, g, or t
  misc_feature (243)..(243): n is a, c, g, or t
  misc_feature (247)..(281): n is a, c, g, or t
  misc_feature (285)..(305): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnngacgaaaggnnnnnnnnnnnnnnnnnnnnnnnnnnnnnnnnnnnnnnnnnacnaacnnnnnnnnnnnnnnnnnnnnnnnnnnnnnnnnnnncaannnnnnnnnnnnnnnnnnnnnggttctaaagggaccaaggttaacgacgggtggatggggaggcataagttttttataagggtccccaaaattttaaattccctggccggggtttttacaaac

SEQ ID NO: 15935 - DNA, 841 bp, Diabrotica virgifera
  misc_feature (511)..(532): n is a, c, g, or t
ccttctcggccgcttatctttacactgactatatctgatgcccctcctttgtgtttattggatttctttatatgttttgttatatttttttaccaaaactttctgctattattccaaccctataacacatacacaggctcccgcgaccaaatcaactcctgtttaagctattacttatgatacggcataattcttctacggagacctcgatgctccttacctgtctcttacctattacaccgacattggccggagaaaacctctagaggctacccaaattatctcctcgtgcagcccatccccatttcgccgattgccaatacagcgagaagttccttgccgatcagcaccttcccaagaatagtgcattgctgaatggactatgaatgcacgccctgtcattgtgctgttggcttactagaggagtggaccaccgcaagagtgaccgatacccttgttggagtactatggccatatcctttctctttcttgccttccttcttccttgcgnnnnnnnnnnnnnnnnnnnnnnctcatactcacaaagtcctatgaacaggccatgtaacccacatacgcttgcctcttctgagagactctttatataaagatggagctcttaacttggccgatgcctgaactctgattcactaacgcatgaaagtattgttctatagagatgccagaagctttcctaaatatcatgcttggagttattgataaagacgatggcgttagtattgaggtgtctattttcagtcgaagagaactgcaacattgtccatatgacttatttttcttaatttccgttattttgtttagaaactatttatactttcat

SEQ ID NO: 15936 - DNA, 668 bp, Diabrotica virgifera
  misc_feature (2)..(561): n is a, c, g, or t
  misc_feature (563)..(603): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnngaataaaaagtctcgcctgcccccctggttactttgaacgggcggggttgtatgagcgtgcccgg

SEQ ID NO: 15937 - DNA, 168 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtggtgagccaggttggtttctatc

SEQ ID NO: 15938 - DNA, 843 bp, Diabrotica virgifera
  misc_feature (6)..(33): n is a, c, g, or t
  misc_feature (47)..(66): n is a, c, g, or t
  misc_feature (122)..(139): n is a, c, g, or t
  misc_feature (253)..(271): n is a, c, g, or t
  misc_feature (280)..(300): n is a, c, g, or t
  misc_feature (308)..(330): n is a, c, g, or t
  misc_feature (816)..(839): n is a, c, g, or t
ggagannnnnnnnnnnnnnnnnnnnnnnnnnnnagaggggaggggcnnnnnnnnnnnnnnnnnnnntcgggggtggggagggggggagtgtggagggggggtgtggaggggggggatgtgannnnnnnnnnnnnnnnnntgggaggggggtggaggggagggagggaggggaggagggggagggtgggaggagggggggaggtgtggtaggggtatagggagtaggagcaagagggtatggagggaggaggannnnnnnnnnnnnnnnnnnagagaaggnnnnnnnnnnnnnnnnnnnnngttggatnnnnnnnnnnnnnnnnnnnnnnnccgcccgcggcgcgcccgggcgcggtgtgagggagggtggattggtgaagggggagggggtgggagacggggaggaggggagggaggcgggagggaaaggaggtagggggagagaagatgttgggggagatagctgtcatggtagttagtgggtatggtggggtggtaggctggggcggggggggagatggatggagggtggaagagaggtaaagggggctggggggttgggaggggggaggaggtttgggggagtttgggcggcggggggaggtggtgggggatcaggggggtggaggttgggggaaagggaggggggggcggggagggaaaagggggagaaagggacaacaaggtggaagaggggtaagggaagggagtgggaggggggggggtaggggggccttagattgggaggctcttgggggggggggttttggtgggggttgggagtaaagggaaggggggaaggtagggggggtcggnnnnnnnnnnnnnnnnnnnnnnnntcgg

SEQ ID NO: 15939 - DNA, 888 bp, Diabrotica virgifera
  misc_feature (265)..(293): n is a, c, g, or t
  misc_feature (823)..(823): n is a, c, g, or t
atcctgctaaggaacttgtagaggtgttttttgcttgaaatggcccaaaaaatacaaagtgttgttttgttttgccggggatcgctgttatttgattcctcaagttcttggtctgtagcagtcttgtcgacatccggatcaactgttgcccgggggattcgtgttctacgggtcaaggtgcatgggagggacttgggtgggtccatctgagttggcgaggccgttgtgccccccctggcgacaggactaatgtaggtatgacttnnnnnnnnnnnnnnnnnnnnnnnnnnnnngtgaaaagattggttgaaatgaaaatgtataatacccaagttcaaaaatattttttaccttggaacagttgtcaactcgaaatacgaaacaaccaaaataagatctagagttgaaaaggacatagcaacatttaacaacatgcgacataatatctctcccactaaaaatgcggctgctaaaatgttattatttccggtcttgctatatggcgcagaggcctggacaataatagaaacattaatgaaaaagctagaggcattcgagatgtgggtgtacctacgtatcctcaaaatatcctgggcgacccacaccaacatacaggtattgcgtcgaatgggaaaacaaaaagaaatctcttttacaattaagaaacgaaatcttaaatatttcggtcatatcatgagccatgataaatatcgtatactccaactgataacgcaaggtaaaatagagagcaaacgcggacccggaagaaaagacactcatgacttaaaacttacgccaatgatttggacaaaaatcgattgangtattcagaaacgcctcaaatgaaattaaaattgccatgatgatagccaacgtccacaacggaca

SEQ ID NO: 15940 - DNA, 912 bp, Diabrotica virgifera
  misc_feature (647)..(672): n is a, c, g, or t
ataaactcggttttaattgaaaattgtgaaaattgaaaatgttataaaggaaaaacgattttaatgttggttgcctatactgtacggggcaaaaggaatcgccagaataattcttcactcttcggtaaacctaaactgtaacgctaaaagtagtatgtaccatagtcaaaataactcctcctgacttaaaggtaacccctccttcgaaatttcatttgcggatattccattttcaagttatatcaaaatgaaatttctcgggacagcgccaaagcaaagaatacatatctcccaagaaccgacacaaacggattatctatgaactaaatttttatgcgcatgtgccagatcggccatttctcaatttgtatgaatagtaaataattttggtgacatttgccttgtacaggatcggcgtttgttgtcacagttttttgtttggcttggcttggcgttagtattttgtttttgtatcagtttgtagctcataatattttgtatagacttattttctatatatattttcttatatagcctacaactattaattgttattttccaacatttatacaatttaattctttttgagatatcttgattatgtgaattaattattttaagctttttcatgaactataaactatcgnnnnnnnnnnnnnnnnnnnnnnnnnngggatttcacaaagaatttgaatctaaaatatcatacaaattctctaacctttctttgacctctactgtaccaaatgcatctgcaggaagagcacaaagtcatattttatatgtgttcattccacaagccacgtgctgtgtttaaaaaggtcagaatcaatactcacaaaacttccataaagtacttttatcagcaaacctaaattaatttaataaactatgtttcattaaattgtttct

SEQ ID NO: 15941 - DNA, 718 bp, Diabrotica virgifera
acgacatccaaccaataatgataacaatcgtcttcttcttctgcgccatcatattgattacagcaacagctataccaacccaatcagatgacataagtgttgacgacatcaacaaaaaggtcgagcacaagcttgaaaacataatgttaaaatggttatttacatgaagatcccaaattcatcgacacattccctgacaagtatgacgaccgccttacaaaagagcaagatgatactagaaccgtgcttactaaaatcactcaagcacttaatgtagatatagataaagatgctgaacaaagtaatgatgctgtgaagaaataggattcctgtgtcgaacaacacgaagatgacctcgacaatatcctcgcctgtctcgtcgaaacaggcgtttatgtattaaaaaaaaagatcgcgcctgtccactagaacagtttgaacgttcgtcaaatatcgaactgacaaccataagatagccataaacgccgtcaaagaaagtgacaattgagaaggagatagtgcagctgactggctctgcgtatttcataacgaactgtatattcacgaagatgagcttcagattcccgaagatgtgagaggagccaatcgagccgtaattgatgacgaataagtccttcttacagcagagttaaagagaatccacgatcaagtacccgccttctatgataacactgtaaaacttttgtgagataatgat

SEQ ID NO: 15942 - DNA, 669 bp, Diabrotica virgifera
  misc_feature (110)..(128): n is a, c, g, or t
cttgacatgatcttagtcacttgaatcttttttgtctactagatttttcgtaaacattggatatacatattaagaaaaacaccttacacattacgaatgaaagacgacgnnnnnnnnnnnnnnnnnnnatagataataattatgttttaataatttaagtgtatagaaaaatgacttttggtgtctttctttttcttcgttaatgtgattggtgttcttcgagataattatagctagaatgcttccaatattcatacaatttaattgtgagactaataaatgatttggttgatataagtgtaaagaagcactctacttggaacagaaacgttttccatttgcaaggaaaagaggattaaaaacttttctctcgtgaaattcaaacaaagccaaattaaaacttaattagataaaaggatctacagaaaagcactcgaatggatgattatttagtattttattagtttcagaaaggaaatggaatggtgtttcgttttcatggttccgataagacttgcctttctgataccatggagatacggtttagagcatcaagttgcctccaggctgatttgattcgaggtcaattccagtcggagagtttgactgtatcaggacatctgtcaaagaatggccctgcttaaggccagttcaatgatgacggaaacc

SEQ ID NO: 15943 - DNA, 1033 bp, Diabrotica virgifera
  misc_feature (522)..(542): n is a, c, g, or t
gagtgatttcccgatgtaggatgccacgtaagcgtcgctcgcaagacacagattctgaagatgaacacgacgattcgagacgtcctcaacgcaacgctgccaatgaacgcgagagggcgcgcatgcgcgtacttagtaaagccttttgccgtttgaaaaccactttaccgtgggtaccagcggatacaaaattgtcaaaactggacactttgcgacttgctactagttatattgctcaccttagagcgatactgatggatgaaccagtctccggtgataatctcccaaaacatcccctcactctgacatggccctttaccttccagagatgccccgattccacaacagatgtagtcgacgaaagggatcagcacgtatgggcccatgaaggccccattcagtctatcatcagggaaaaggacatatcttatttctactaattctaatttattttcttttcgtttaggaggagcatgtgagccggcaaaacatgggcgtcaacgagggttttattagaaaggnnnnnnnnnnnnnnnnnnnnngtttaaggtttataggcgaagtaacgaagcactaaaaagccaaaaacctaggaatattgtgcaatacgatgaattgtcatgcaactttttgcattctattcaggagagtgtcacgggagaggaaattttgtgaactaaattaatctacggtagatgaaaattgcattttggacataagaaaaatgcattttaaaagtgcatctcgaagagatgaaaaatgaaaaattaagaactggggaaatactgaaggaaataagttcatttttatactcggggggttttggagggcggttaacccgaatttctttttcggggtggtctccataaggaacctggggcccaggttggaacatgccccctggaggtttaaggtaataacccgttaaaaccaggccgaaaaccttttccccggggtttttggggggcctgccggagcacgcccctggagtgccggggcgcgtcctccccatgcacctatggcgcttgtcgcc

SEQ ID NO: 15944 - DNA, 810 bp, Diabrotica virgifera
  misc_feature (38)..(55): n is a, c, g, or t
  misc_feature (149)..(164): n is a, c, g, or t
  misc_feature (167)..(181): n is a, c, g, or t
  misc_feature (258)..(275): n is a, c, g, or t
  misc_feature (715)..(715): n is a, c, g, or t
taaattttaccatcatgagtaccttttaagaaactgcnnnnnnnnnnnnnnnnnnagtataagtgagataatttaaacgtgtatttgttatttctctacatttctgtatgtgttgcattataatattaaactactcattcattatcggnnnnnnnnnnnnnnnnatnnnnnnnnnnnnnnncgatcagtgaatgttacaaaacttggtaagattcattgatttctcgtttaatgtcgtaccctgcttctgaaaaagcnnnnnnnnnnnnnnnnnncgaacgaggatgccttttgaacagtattctccaccatcgtccgcttgttggttcggaaagcatcctgtactttacagtagcgcctgaagcagggtaatatttaagccctaccaaatactttagtaccttttttaaatgacggtacatttgcctcccaatcgaggccattacaggtttttatatacatggtagaattctaaacagacattaagctttagcctagtcacaagtcaaatttcaaaagctgtgcaaattactttcaaaaaatcgtatgtaccaattgacacttccgccgaaaacagcgtaactccagaggaagactacctcgaccggctgtccactggttggtgggcgctatcttaaggaataaggtgtcgtccacttgtcatcttgacagcaaacgctgagacattgatatttgattgggcttgacagcctanagctttttactagtttttaaggcattgtaaagttatagtagcgttagtcaatgcatgctttgattttaaacataacttattataatttcagtttt

SEQ ID NO: 15945 - DNA, 456 bp, Diabrotica virgifera
  misc_feature (13)..(32): n is a, c, g, or t
  misc_feature (36)..(257): n is a, c, g, or t
  misc_feature (264)..(301): n is a, c, g, or t
  misc_feature (321)..(334): n is a, c, g, or t
  misc_feature (337)..(359): n is a, c, g, or t
  misc_feature (367)..(389): n is a, c, g, or t
  misc_feature (419)..(450): n is a, c, g, or t
tcttcgcgtccgnnnnnnnnnnnnnnnnnnnncagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 15946 - DNA, 308 bp, Diabrotica virgifera
  misc_feature (9)..(114): n is a, c, g, or t
  misc_feature (121)..(201): n is a, c, g, or t
  misc_feature (263)..(281): n is a, c, g, or t
gttaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnnnnnnnnnnnnnnnnnnnnnnnacataaacattaccttaaagggaaaacagcggaatttttttttggacaggcttcaactcggnnnnnnnnnnnnnnnnnnncgccccctcgtgggcgtgctataaaaa

SEQ ID NO: 15947 - DNA, 847 bp, Diabrotica virgifera
aagtagacatttttgcacgctcgtagaaaaaatattatacaaaccgtcgaaaacatctactcccataatggaaaactaacacagtttataccagtacaaagcggagtcagacaaggtgactcgttaagcccacttctctttaatataataatggacgaaataatagaagcagtacgtcaaggtcatggttacagaatggggaacaaagaaatacaaatattatgttatgcaggcgacgccgcgttaatcgccgagacagaagacgatctccaaagattaacacacatattcaatacaacagccactgtatgcaggtaatcaccaacatctgagtcatctgttcaagaatataaaatatatacagtaaaacctcgatataacggaccaattggggggacgggttatccgttaaagccgaaagtccgttatacaaaaatacgtttaaaatgaatcaaaaaactttttttgacagttttgtttgcacttttgaagtttgctgtttttttatactattattaaaaatatgtccgcattatgctataaaaaaaattttactgaaattcttaaaaatacagagacgttttaatttttttcacatttgagcggatttttttgtccgttatatctgaagtccgttaaatagaggtccgttatatcaaggttttactgtacttctattttcatattgcaaatacatatttttatagtgtatgtaaatatttgtacctatttgttttatttgtgactctttgtattctcatagtgtttatataaacagagacaaactatagacagaaaaagttatttacacaaatcctatcatacagtaattagtcctgacagttaa

SEQ ID NO: 15948 - DNA, 602 bp, Diabrotica virgifera
  misc_feature (508)..(531): n is a, c, g, or t
tctcccgggtccggcctactagagaaggtggtctgggcgtcctttcatggtcatgcacgttccagccatcttaagaaggagattgactaagttgatgatctcagcgactcagacgatagctgatatactatcactgccgtacatgagtcgtttctgggagaaacttgtcaaatggacttcgaacaacggaggcagttcggcatccatagcacgtgagctgagcgcgaagttggaaatcgggtatagcgggaatggtcttgctcagggttcttgccatccagagagctctgcctggatacataatccaccgccctactggtcgggaagagattacgtgttttttatccagttgcgaggaaaccttttaccaaccaagggtatcccgtccaatcctccacaagaacggatgtgtaggacgggatgcggtaggtccgagtctctgagccacgtactacagaaatgctcaaaagcacattggcaaagatgtaggagacatgaccagctcgtnnnnnnnnnnnnnnnnnnnnnnnnacgtaaagggtggatatgtcaggtagagccgcgtatcacactaggacacgcgagtcttaaaaatcctgacc

SEQ ID NO: 15949 - DNA, 671 bp, Diabrotica virgifera
  misc_feature (20)..(36): n is a, c, g, or t
  misc_feature (38)..(561): n is a, c, g, or t
cctcctcctaccgcgtccgnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttaggcataacagcgtaattttattgcagagttcaaatcgataataaagattgcgacctcgatgatgttgtaaagtatataatttgtggtagcgggttatatgatta

SEQ ID NO: 15950 - DNA, 457 bp, Diabrotica virgifera
  misc_feature (10)..(44): n is a, c, g, or t
  misc_feature (336)..(353): n is a, c, g, or t
cctctagggnnnnnnnnnnnnnnnnnnnnnnnnnnnnnnnnnnnttaaacagcgctttagttattaagaagagatatataaaaatagagagagtgtatattatatttataaacatttcctttatgttgtgaacagtgtgcctaattctgaacgaagaagtagaaaaagatggaaaagaataggacgaagatgatatagaaaatgattttgcttattgaattattgttttgatagatacaaaagaagtaaggataggatttattcgcaaagattatggccttttgttcatgaaaatattacaaacctttattatagacagcatatgattgatgacannnnnnnnnnnnnnnnnngttcacactaaggactggatggagatgttttcttttattgctatcccacgccttgaaagcacatcatatacgtctcatatgtagcccatcgtcctacctttttt

SEQ ID NO: 15951 - DNA, 819 bp, Diabrotica virgifera
  misc_feature (10)..(50): n is a, c, g, or t
  misc_feature (75)..(117): n is a, c, g, or t
  misc_feature (125)..(745): n is a, c, g, or t
  misc_feature (764)..(805): n is a, c, g, or t
atttcttttnnnnnnnnnnnnnnnnnnnnnnnnnnnnnnnnnnnnnnnnnctctcaacatagttaattcgtatcnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtggaaaaaaaactggnnnnnnnnnnnnnnnnnnnnnnnnnnnnnnnnnnnnnnnnnnaggtttaaattttt

SEQ ID NO: 15952 - DNA, 783 bp, Diabrotica virgifera
ctcctcgcgtccggtgaacgtgtttaacatcaaccatttattccatttctaaaaattcccatataactatgggttcgtcgaggagacgggatcgttccagatctcgagacaggcgagaccgttccaggtctagagacagagaccgagacagacgcgataggaaacgtagtagatctcgagacaggtacagagatagggatcgtcgaagggacagaagcagaagtcgtgatcgcgatcgcgaaagacgccgtgaaagagagcgatctataacgccaccagaacccgatggcgataaaatgatagcagacacccttgctactctagctgccaccagaaacttcgccagtttgatttcaaaagagggagatggcaattcgaatatgtctacagagagcagtgacgatgaaagaaggagaaaaaggaggtctagatggggaggtagcgaacatgagaaaatatttattcctggaatgcctaccatattaccacagaatcttaataaggaacaggaggaagcatatttacatcaccgtcacctgagccgatttatagcagcgatggtaaacgtctgaataccagggagtttcgtacgagaaaacgtcttgaagaggacaggcacactttggttctcagaatgcaaagcatcaatcctgaattcaagccgccacttgattataaaccaccagtaaccagagttagcgacaaagtcatgatacctcaagaagaacattcggaaattaattttgtgggtctttttatttgctcctagaggcaataccctaa

SEQ ID NO: 15953 - DNA, 358 bp, Diabrotica virgifera
  misc_feature (3)..(31): n is a, c, g, or t
  misc_feature (40)..(100): n is a, c, g, or t
  misc_feature (102)..(209): n is a, c, g, or t
  misc_feature (212)..(277): n is a, c, g, or t
  misc_feature (279)..(344): n is a, c, g, or t
agnnnnnnnnnnnnnnnnnnnnnnnnnnnnnatggggtgnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnntgagggagggaggg

SEQ ID NO: 15954 - DNA, 109 bp, Diabrotica virgifera
ccccccggggccgctcccaaggaggaatggaacgagagagctccccgggccgcaaggtgtggcaatatctactatgaggaccagggaaaaaaaggacgagcatcgctga

SEQ ID NO: 15955 - DNA, 1140 bp, Diabrotica virgifera
  misc_feature (933)..(954): n is a, c, g, or t
  misc_feature (1015)..(1063): n is a, c, g, or t
actagatcagaggaagttgtacgagacctgtgcatgactatacaccataatatagtgaccaatacactctctctaggagggtcagattagggatgggaaaaacctaacggttataacctaaaaccggttttttcttctgcaataattggtttttccggttgtttttttgtcacggttataaccactttttcgtttcaaagtaataaccagtgaaaaaccggagtaagtggaaaaaatactgaattcagaaaaaaatgtgaaaatttttcccccatcgcgcgaaaatgagaaattttaagctgactgaaaccgatttcacaacactgatgactgattgctatactgatatggactgatatcccttcgaatggagtatcgcacactgaagcgcaatgtaaatgtaaactcttgggtattgactttgactaaaaaaaaccgaacaccggtttttggaacaaccggttttttgaccggttataaccggtaggttaaaccgtaggtaaaaaacggtataaccgaaaaccggtgttttgtcaacaaccgccatccctactaaatagagaatataggggacaaccaaatattagaacaaatattaaaataggatttagaacatctcgcagtacaaaagtaaataggaaaactatagaaaaatggtaaagtattggcaaaagatgaacaattaaaaaaactgatcaagtctttaaaaaacgtaccatattaacaaataccaagataataaccattgttaaatgactatattataacctatattgtacgaattttatttccaaaaaatcccttgttttcataatttggattttctgtaatagaaaatatgtccaaactttatctataaaaatttgattggatacctttcaacatttttctgaaaattcaaatataaaggcatattcaaaaactattattggnnnnnnnnnnnnnnnnnnnnnnaccttaaaaatttctttgagaacggggaaagggttaagaaaggaaaatgggaattaaaagnnnnnnnnnnnnnnnnnnnnnnnnnnnnnnnnnnnnnnnnnnnnnnnnnttatcccaaacttttccagggaacaggccccccaaacccttcccaaaatcccgggggaaaaagtggggaatttttcc

SEQ ID NO: 15956 - DNA, 907 bp, Diabrotica virgifera
  misc_feature (4)..(41): n is a, c, g, or t
  misc_feature (53)..(75): n is a, c, g, or t
  misc_feature (266)..(807): n is a, c, g, or t
  misc_feature (867)..(894): n is a, c, g, or t
ttgnnnnnnnnnnnnnnnnnnnnnnnnnnnnnnnnnnnnnnaccatttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccactggataaatttgaagggccgaggaattttgacccgtgcaaaggtaacataatccnnnnnnnnnnnnnnnnnnnnnnnnnnnngaaggttggattg

SEQ ID NO: 15957 - DNA, 102 bp, Diabrotica virgifera
ctttgaataaatataaagtctccgccctgccccctgataaatttgaaggccccgcgatcttgacggcgcaaggtagaattaatcattagttttttcactgaa

SEQ ID NO: 15958 - DNA, 253 bp, Diabrotica virgifera
  misc_feature (3)..(252): n is a, c, g, or t
ttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 15959 - DNA, 813 bp, Diabrotica virgifera
  misc_feature (107)..(124): n is a, c, g, or t
  misc_feature (699)..(720): n is a, c, g, or t
  misc_feature (722)..(750): n is a, c, g, or t
gatttctcgtgtaatcgtgtttgaatggaatagagatggactgtggcaatttcgtgatgacagctttacataattaccgtgtaagtaacagttactatataactacnnnnnnnnnnnnnnnnnntagatgtttaacgatcaaattagttaaaaatttagatttatttattcatttacattatttaattctgagtaatagaatattgaatcttgtatatcataattcattataaatctcaacgttgtagttgagaatttcaataaattttgtaagtgaatgaagatactatcgtgtagcttaattaagcatagtgcgtgcagtagaaatatttagttttctaaaagaaatcatggcataaacttagctaaacttaaggttgtaaaaaagttaaaagaaagcatagaataaatgtttgtatacgacgtttttcaagaagtaacatcactgaatccgtcaatcacagacagctttttgccgttgtaggcttctcaggtagattacaattcagtggatgttcgatcaagctgtcatcgtaagtttgtagacttaatagaactgtgccttgtctcctcactgttcattaactgaaagcatgcctgtctataaaacacctacttcacattcgaaagggaccagttcaatcacaagtattagtttttacgtatattttcagatcgaggttcattcagattattgannnnnnnnnnnnnnnnnnnnnntnnnnnnnnnnnnnnnnnnnnnnnnnnnnnaagatgcacctctaagaatttataaaaagaacactatctaaattacgaatcaaagcgactatt

SEQ ID NO: 15960 - DNA, 71 bp, Diabrotica virgifera
cgcattcgcacaatgaaagtggagtgcacctgctttatgtttgttatgcacgttccaaagtgcattaaata

SEQ ID NO: 15961 - DNA, 828 bp, Diabrotica virgifera
  misc_feature (18)..(45): n is a, c, g, or t
  misc_feature (48)..(117): n is a, c, g, or t
  misc_feature (119)..(671): n is a, c, g, or t
  misc_feature (733)..(751): n is a, c, g, or t
  misc_feature (772)..(787): n is a, c, g, or t
  misc_feature (790)..(819): n is a, c, g, or t
ctccccttcacggccgcnnnnnnnnnnnnnnnnnnnnnnnnnnnnctnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaagttcgcctgccccctgttaatttgaatgccgcgggattttgaccgtgctaagcagcnnnnnnnnnnnnnnnnnnnggaaggtggaatgaacggatnnnnnnnnnnnnnnnnccnnnnnnnnnnnnnnnnnnnnnnnnnnnnnnctaaaaatt

SEQ ID NO: 15962 - DNA, 687 bp, Diabrotica virgifera
  misc_feature (226)..(241): n is a, c, g, or t
tacttcgcgtccggtgagattgcaatacttctatctttttcccttatctggaaggaactgtttttgataaagtattctcaacactgtgatgcattggtagtttggatgagtgatgccgaaattctttattgagactttatctccccttaaaaacgtatatctacattccggaatatgcgccggtgctttttcacacaaatcactacacatgggccatccacacttnnnnnnnnnnnnnnnntttctctcgttcacctcttgtccgcatcctaaacacacaggaactgtacttatagcaggaccccatattaagggattttcttggatgatcacatctcccggtttcagatcttttgtggctttcaaatgacgaccgaggacgtcgtctgtgcataccttaaagggtttgcagtgcttcttatgttgcttgcagtcgttcttctggcgctccttgccacaataaagcacgccatgtcactcaccgcatcgatgccccgattgcaaccaccccatcccccctccgacccacttcgttaaagtttaattctttccataataaaccatcataattcctgaccatcgaacaatcgaagaaaacgaacttcccacccacctcccctgcagtccccaactacaagacatcctggtaacgcccatcttacccccttccctgctccaacatacccc

SEQ ID NO: 15963 - DNA, 790 bp, Diabrotica virgifera
  misc_feature (163)..(183): n is a, c, g, or t
  misc_feature (206)..(228): n is a, c, g, or t
ggaactaaacacttaaagtgagaaaaggcaacgtcgcacagcaaattttcatattgctatcgcaaggaagtacacgtcgacagacataactgaaaccgccacggtcagaccgattgaaaccttttgttacgcgaggttgtcagatcaatcgagtttcaaaggnnnnnnnnnnnnnnnnnnnnnacctaccttattcaaattttatnnnnnnnnnnnnnnnnnnnnnnngttcagaaaatgtaagaaaatgggagtacaaatggaagagggtaatctgactactttgttatttgctgacgatgaggtggttctagcggagattacagaggacgctgcttatattgttcggaaactgatcgaggagtatgaagattggggtctggaaataaatacaaacaaaacagaatatatgacaataggctgcacaggcgaagacctaaacttagaaggaaaaataataaaaaacactaaaggatataaatacctgggagttacatttacggaatatggaaacgacgaaacagacatacaacaaaaattaggtagaggaagagccatgtcaagtcagataaactcattactatggagtaaagatatacgggaaagtacgaaaaaacaactatataaaacatttattgaaagtattgttacctatggctcagaaatcctggacaataaattagaaaatgcagaatcaaataaacgccagtagagaacaattttttggcgaaaatgctgcaaatcagcattaacccgaccatggaaggccagatagaataaaaaaaatgac

SEQ ID NO: 15964 - DNA, 834 bp, Diabrotica virgifera
aaaaactagatacgggtcaaattattataattcgaaaaaatatgtaggtatattgtttttgccaatcccatgaaccactagcaagggtgtttacagtttacagtgtcaatatttattattttgatgccatattaacgtgcaaatatttagaatggtgttcatttaagcttaagcagagaagaacaagttgaggaaactgagtttgtagataatttagcaactttaaaatatagtgatgagtcgtctgaaataatggcagatttggcactttattggtctaagaagggatattttgaaaaaccatacgttgtaaaatcaattgaaaaactagactaaatcatatggtgaaaaggtacatgtttcggaacaaaattaactaaaatagtagttgatatattaagcacgccttcatccagtgcagcgactgaaagaagtttcagtacttatggttttttatccactcctctaaaaaaaccggctcattgtcgaacgggctcgtaaggtaacttttattgctcacaatttaaaattgttagacatagaccaatccatgactgagctggccacttgtgaaaaacaaaatcccacaactcatcagtactttgaaatgcagattgtagataactaggacgagctaatgatagaaatagattctgaatctgaggtctcatcttttatcataccacatcgattatttgctgttaagaagaaaatttcatttttgaagttatacttctttacgatcgagggtgaaattttatatttccctggcgcatgtgcagacagacagtatgtagttcgttgctaatatttcaaattatgtatttatcagcg

SEQ ID NO: 15965 - DNA, 522 bp, Diabrotica virgifera
  misc_feature (2)..(445): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttctattcagagatcaacttaaatgatttaaacttagcaatcgatgataatattagaattaataccttgcatat

SEQ ID NO: 15966 - DNA, 652 bp, Diabrotica virgifera
  misc_feature (3)..(50): n is a, c, g, or t
  misc_feature (58)..(594): n is a, c, g, or t
  misc_feature (639)..(651): n is a, c, g, or t
aannnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttattaataagtctttttagcattaacactatctatatcatcnnnnnnnnnnnnng

SEQ ID NO: 15967 - DNA, 685 bp, Diabrotica virgifera
tttcagcgtccgaatatatttagtttatttttctacttgaccattagtgttgaaattgtgtgaccggtggactccagtgtatttaaataactgtattaagggatttttttccaaggaattgcctgaccaatagacctcaatgtgggtatttggtcaactagaatgggatttctgacgccgaaatggccgacgccgaagcggcctacgccgaggcggcctacgccgaaacggctctacgcccgaacggccacgccgaggtggccacgccgaaacggcgacgccgaaacgtcccattccgacaatttaatgcgttagagcaagtcgatcgcgatcgaccggtcgatcgccaaagtttttgaagtcgatcgcgattcacggaaaaaatacaaatgaaaaagatgtggatactaatttacttctgcatacatatgtgaggtggttgaaataattagtcccgaaataattttcttttctagaagaacgagggcaaaatttactgcaatacgataagcgatctggctcccccatcatacttagtatatcatttgatcctcctttattcctaaatacagggcaccctaaacactctgccatatgatgaccgccacacatctactttccccatcaccacgttactattcgccatccctactctacatcatccttctatcttctcccctcctcc

SEQ ID NO: 15968 - DNA, 67 bp, Diabrotica virgifera
  misc_feature (2)..(14): n is a, c, g, or t
  misc_feature (20)..(39): n is a, c, g, or t
gnnnnnnnnnnnnntagagnnnnnnnnnnnnnnnnnnnngtctttttcaagattaagtttatttatt

SEQ ID NO: 15969 - DNA, 871 bp, Diabrotica virgifera
  misc_feature (838)..(838): n is a, c, g, or t
ctgtaaagtattacatagattatccaaatagatgaacaactaatctaaagggacaccaaatgttcagcaatgctcaaaaagtacgatgaaggattataagctacaggtaggctgtggaagtattccaaaatagcaattgtatttttcagttccgattctgttgaatatcaattttatgaaattttactcagctttaccaagatagcagtcgtttctttttgtaagtaaaagatatatccatgggtagcgaagaagttgaaaaacagtaagatattaaatattgcaaacattggctaatcgtttttacaataggaataaactaatcaaaagaagggaaaccaaatatggacctattctcaaaaagttccaaggagagttggcagctacaggttagaattttaaagtacatattggaaaacatcagttatatttttcagttttattctatttgctctcaattctctggaatattcttcccctttatctgaatgatagcagtgttctctatatggcaagcagcattggtggatacagaagagattaagaaacagtaagattttaaagattgcaaacattagctaatgttttttagaatgtatttgaaaatgttatatgtattatccaagttcgtgaactaaccaaaggaaaggaaaccagatatgaagccatcatcaaaaagtacaaagcagagttagcagctgcaggttagagttttgacgtattccaaaacatcagttctatttttcagtttcatttcaattgctcttaattctaagggatttttttcttccccatctgaatgatgatggtgtactcgcatggcaagcattattggtgnatatagaagagattcagaaacagtaagatttta

SEQ ID NO: 15970 - DNA, 846 bp, Diabrotica virgifera
  misc_feature (2)..(782): n is a, c, g, or t
  misc_feature (784)..(799): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnncacacttacaattaacttatataacaaatttatttaatcggggggga

SEQ ID NO: 15971 - DNA, 75 bp, Diabrotica virgifera
  misc_feature (8)..(37): n is a, c, g, or t
  misc_feature (39)..(73): n is a, c, g, or t
atagaggnnnnnnnnnnnnnnnnnnnnnnnnnnnnnngnnnnnnnnnnnnnnnnnnnnnnnnnnnnnnnnnnngg

SEQ ID NO: 15972 - DNA, 879 bp, Diabrotica virgifera
  misc_feature (19)..(19): n is a, c, g, or t
  misc_feature (21)..(22): n is a, c, g, or t
  misc_feature (24)..(45): n is a, c, g, or t
  misc_feature (62)..(62): n is a, c, g, or t
  misc_feature (233)..(251): n is a, c, g, or t
  misc_feature (260)..(308): n is a, c, g, or t
  misc_feature (310)..(343): n is a, c, g, or t
  misc_feature (345)..(378): n is a, c, g, or t
  misc_feature (381)..(394): n is a, c, g, or t
  misc_feature (404)..(422): n is a, c, g, or t
  misc_feature (447)..(483): n is a, c, g, or t
  misc_feature (486)..(542): n is a, c, g, or t
  misc_feature (587)..(615): n is a, c, g, or t
  misc_feature (623)..(651): n is a, c, g, or t
  misc_feature (654)..(666): n is a, c, g, or t
  misc_feature (730)..(742): n is a, c, g, or t
  misc_feature (744)..(764): n is a, c, g, or t
  misc_feature (766)..(789): n is a, c, g, or t
  misc_feature (791)..(826): n is a, c, g, or t
  misc_feature (835)..(862): n is a, c, g, or t
tgtcctacatgggccccgngnntnnnnnnnnnnnnnnnnnnnnnntcttgtagggccccagnaaagaaaaaggggaggaaaagagagcaagagagaagggggagagaaaagggaattttctctcgaggaacaccacccggcggaccaagggaagcagggaacaagaaagaagagaaacagaggcaagagagccgaacgaaaaagagcgaagaaagcaagaagcttattgtagnnnnnnnnnnnnnnnnnnntttgttggnnnnnnnnnnnnnnnnnnnnnnnnnnnnnnnnnnnnnnnnnnnnnnnnncnnnnnnnnnnnnnnnnnnnnnnnnnnnnnnnnnngnnnnnnnnnnnnnnnnnnnnnnnnnnnnnnnnnncgnnnnnnnnnnnnnngaatctctannnnnnnnnnnnnnnnnnntaagaattaggattaagaagtttcnnnnnnnnnnnnnnnnnnnnnnnnnnnnnnnnnnnnnatnnnnnnnnnnnnnnnnnnnnnnnnnnnnnnnnnnnnnnnnnnnnnnnnnnnnnnnnnggagtgatgataatattaggattaaagaattgtatatttaggagnnnnnnnnnnnnnnnnnnnnnnnnnnnnngaacatgnnnnnnnnnnnnnnnnnnnnnnnnnnnnnggnnnnnnnnnnnnngaagcctcgcgtgcccaatgattaatttgaatgaccgagatattttgaccgtgcttaggcaggnnnnnnnnnnnnngnnnnnnnnnnnnnnnnnnnnncnnnnnnnnnnnnnnnnnnnnnnnncnnnnnnnnnnnnnnnnnnnnnnnnnnnnnnnnnnnnataaaaagnnnnnnnnnnnnnnnnnnnnnnnnnnnnaccttatagaggttttt

SEQ ID NO: 15973 - DNA, 907 bp, Diabrotica virgifera
cggacgcgtggggtattctcgctgaacgtcaaatgtgtcaaataaaaaagaggttagataaatataaacaaattacacgtgaattcgtgtaagaaaagaactttttcatgtttgtaattgagtaaagcaaggaaaatagagttggatattcctcataaattgaattctgtaaatattaattaaagacctacaatggctcaacaatacaagtccctacatcctgtaaaatactacagagactatttagcacatgagattcgcccagacggtagagaatttaataaatttagacctattctactcaatgttggaacaatagatacagcagatggatcagctattgctaaagtcggcaatactactgtagtctgtggtattaaagctgaactctgtaaacctaaagcagatgcaccagataaaggattcctggttccaaatttagaattgactcctctatgttcctcaaaatttaggcctggaccacccagcgaccaggctcaagttcttacacaactcatagcagagatcatagacaattccaaatgtatcaacttgaaagatttatgtatatgtaatgataagctggcttggtgtctttatgtagattttgtttgtctagattttgatggatcagtagttgatacatgcctagttagtttcttaggagcaattaaaagtataacactaccatttattgattatgatccagctttagacaacatacaagtaaacttagaagaaagaaaacacatcgaaatatacaataccccagtatctaccacttttgcagtatttgatgacaaagtaattttgaaagatcctacattagaagaaagaagtttgtgttctggtattttaactatcgtgtttaaagatgaggaagttgtgctgtgttcataaaccagga

SEQ ID NO: 15974 - DNA, 297 bp, Diabrotica virgifera
ccactggggccgagttgataaggagagatatgaggaaacccctccaaagacccaccaaaaaaacagaaaaagcagaaagacagagaacaaacgaagaaaacacacaaaaaagatatctccggaggcccgcgaaaaccccaggaagaaacaagaagcacacaaccaacaagcacgaaccaaagagaacacagaaacaacagacaagatggaaaaagaaacacgcaacagacaaacccaggaacgaaaagccaaacaaagcgaaacacaccgaccaaagcacaaaagaaacaaaaacaa

SEQ ID NO: 15975 - DNA, 1046 bp, Diabrotica virgifera
  misc_feature (6)..(848): n is a, c, g, or t
  misc_feature (850)..(919): n is a, c, g, or t
  misc_feature (926)..(981): n is a, c, g, or t
  misc_feature (996)..(1016): n is a, c, g, or t
cctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnntccaaatttttttgnnnnnnnnnnnnnnnnnnnnntaagaggaaagccccggggctttttttttt

SEQ ID NO: 15976 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15977 - DNA, 285 bp, Diabrotica virgifera
  misc_feature (4)..(96): n is a, c, g, or t
  misc_feature (98)..(114): n is a, c, g, or t
  misc_feature (131)..(159): n is a, c, g, or t
  misc_feature (197)..(253): n is a, c, g, or t
atcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnngggaagacccattgagnnnnnnnnnnnnnnnnnnnnnnnnnnnnnttaagttaattataaaacaattttattaattgggggannnnnnnnnnnnnnnnnnnnnnnnnnnnnnnnnnnnnnnnnnnnnnnnnnnnnnnnnccacttttctggataaatcaaataatttcccc

SEQ ID NO: 15978 - DNA, 859 bp, Diabrotica virgifera
  misc_feature (401)..(424): n is a, c, g, or t
  misc_feature (533)..(572): n is a, c, g, or t
  misc_feature (833)..(833): n is a, c, g, or t
ctcgtgcaccatttttttcttgtatcaacagtaaaattatctcgcagatagaagatcgaaaacaacaatatttagaaagcaaaaactttagtcaacagaacgtaatcgtattcgaaaaaaaaaagttccaactttaactcgcgtcattctagactcgtttttactaaattttatcgtgtttttcgtcgaacgctatttttataagaagttttttttttcgttttatcggcatagacttcggatcgtcaattagccagtcacaacttctttgttttctattcatacataaagaaggcagtgaggtctttgatagcaaactcttccgcagctctctactcagttcaaaagctggagttggcggctatggactgtccaagttgctcaccacatttttccattannnnnnnnnnnnnnnnnnnnnnnnttcatatgtacataatatatcaaattatcaggattaataaatttagaggttaattttagtttcagagataaatttcattaaacaatcatatatatgtgtgtatatatgnnnnnnnnnnnnnnnnnnnnnnnnnnnnnnnnnnnnnnnnctgttcagagacaatagataggatacattgaaaggtggaaaaacattacattttattaaatcttcgattaaattataggtgtatggaatgtattttgtgtactcaaagaaagtgtgattcaaatcacccaccttctgacattcagtacaaagatttgaatcaaaaactttaattcttgctagatgtagagggaaacatgcatgtccaaacttcattctgattaatggtgttatatatcttcgaggtactacataattttanagacgttaaatagatatgttattcta

SEQ ID NO: 15979 - DNA, 323 bp, Diabrotica virgifera
  misc_feature (2)..(167): n is a, c, g, or t
  misc_feature (175)..(197): n is a, c, g, or t
  misc_feature (209)..(240): n is a, c, g, or t
  misc_feature (268)..(302): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatagannnnnnnnnnnnnnnnnnnnnnngtttttttaggnnnnnnnnnnnnnnnnnnnnnnnnnnnnnnnnctcgggcggctacaaaaaaactttcacnnnnnnnnnnnnnnnnnnnnnnnnnnnnnnnnnnngtgagccattttttctggaaa

SEQ ID NO: 15980 - DNA, 835 bp, Diabrotica virgifera
  misc_feature (801)..(801): n is a, c, g, or t
caaacagactgttttatgtgtaattgtttttgtaattttaaagtaatagaatggttaacgttaatgaaaatcagatcagaaacattggaaaggttttaaatgactcgtcgagacctttgaaagaaagattccgtgctttatttacactaagaaacatcggaggtgaaatatccattcagtgtattgcctcctgcttctcggattcatcagtattattaaaacatgaattagcatactgtttgggtcaaatgcaagatgaaaaagccaatccaatactcacccaaattttggaagatgtaaaacaagaacctatggttagacatgaagcaggtgaagccctgggagctattggaagtatagaaaatataaaaattcttgagaaatataaaaatgatccagtggtagaagtagcagagacctgccagctggcgttggacagaataaaatggttgcagtctcaaaaacaggatgaaaaactttcagcgaacccttataattcagtggatcctgcacctccttgccaagatactgatgttccagcattgaagaaggtcttactagatgaaaatgccagtctttttgaaagataccgagctatgttttctttacgaaatttacaaactactgaatctatagatgcgttaggaacagctttgcaacacgggagtgccttattcaaacatgaaattgcttttgttttggggcaattacaagatgaaagagccacaaaatatcttaggcagtctttagaggatagtcttgaaaatgaaatggttcgtcatgaatgtgcagaggctttgngtgctatagctactgaagaatgtactgaaatatt

SEQ ID NO: 15981 - DNA, 477 bp, Diabrotica virgifera
  misc_feature (14)..(44): n is a, c, g, or t
  misc_feature (49)..(117): n is a, c, g, or t
  misc_feature (121)..(217): n is a, c, g, or t
  misc_feature (224)..(261): n is a, c, g, or t
  misc_feature (281)..(294): n is a, c, g, or t
  misc_feature (297)..(319): n is a, c, g, or t
  misc_feature (327)..(349): n is a, c, g, or t
  misc_feature (379)..(410): n is a, c, g, or t
  misc_feature (417)..(474): n is a, c, g, or t
cctccccgggtccnnnnnnnnnnnnnnnnnnnnnnnnnnnnnnncctcnnnnnnnnnnnnnnnnnnnnnnnnnnnnnnnnnnnnnnnnnnnnnnnnnnnnnnnnnnnnnnnnnnnnntttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnncga

SEQ ID NO: 15982 - DNA, 302 bp, Diabrotica virgifera
  misc_feature (2)..(222): n is a, c, g, or t
  misc_feature (224)..(286): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnagctcaaatttctttt

SEQ ID NO: 15983 - DNA, 347 bp, Diabrotica virgifera
  misc_feature (27)..(46): n is a, c, g, or t
gtgaaatactcctgacgcgaaaggtannnnnnnnnnnnnnnnnnnnccgtataaggttgcacctacattggatccgtatttctccgatccgatatcggccgacgtctaactgctctgtgtagcttctcctatcaatcgcccgatatcggatcggatccgagaaatacggatccaatataggtgcagccttacatatcttccataatattaatgtactcgggtgaaaaccttttcatattcaggtctttctataggcttcaatagatatattatatacaggttttgatccaggacatactagtcttttatcgatcgtctattgagaacatggccccaaaagacttacg

SEQ ID NO: 15984 - DNA, 1169 bp, Diabrotica virgifera
  misc_feature (5)..(37): n is a, c, g, or t
  misc_feature (43)..(65): n is a, c, g, or t
  misc_feature (256)..(329): n is a, c, g, or t
  misc_feature (334)..(399): n is a, c, g, or t
  misc_feature (417)..(435): n is a, c, g, or t
  misc_feature (444)..(458): n is a, c, g, or t
  misc_feature (460)..(476): n is a, c, g, or t
  misc_feature (479)..(497): n is a, c, g, or t
  misc_feature (512)..(532): n is a, c, g, or t
  misc_feature (670)..(719): n is a, c, g, or t
  misc_feature (724)..(805): n is a, c, g, or t
  misc_feature (808)..(828): n is a, c, g, or t
  misc_feature (837)..(881): n is a, c, g, or t
  misc_feature (894)..(993): n is a, c, g, or t
  misc_feature (996)..(1008): n is a, c, g, or t
  misc_feature (1010)..(1075): n is a, c, g, or t
  misc_feature (1078)..(1148): n is a, c, g, or t
atctnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnttttatccnnnnnnnnnnnnnnnnnnnnnnnnnnnnnnnnnnnnnnnnnnnnnctcatcccctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnncnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnngggagaaaacccaacagaggg

SEQ ID NO: 15985 - DNA, 150 bp, Diabrotica virgifera
  misc_feature (2)..(19): n is a, c, g, or t
  misc_feature (21)..(97): n is a, c, g, or t
  misc_feature (99)..(122): n is a, c, g, or t
  misc_feature (124)..(136): n is a, c, g, or t
gnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnngnnnnnnnnnnnnncaagtttattttag

SEQ ID NO: 15986 - DNA, 854 bp, Diabrotica virgifera
  misc_feature (18)..(38): n is a, c, g, or t
  misc_feature (103)..(126): n is a, c, g, or t
  misc_feature (128)..(141): n is a, c, g, or t
  misc_feature (146)..(174): n is a, c, g, or t
  misc_feature (216)..(241): n is a, c, g, or t
  misc_feature (323)..(344): n is a, c, g, or t
  misc_feature (369)..(410): n is a, c, g, or t
  misc_feature (443)..(487): n is a, c, g, or t
  misc_feature (493)..(510): n is a, c, g, or t
  misc_feature (512)..(528): n is a, c, g, or t
  misc_feature (530)..(690): n is a, c, g, or t
  misc_feature (693)..(725): n is a, c, g, or t
  misc_feature (766)..(783): n is a, c, g, or t
atgtttatctattttaannnnnnnnnnnnnnnnnnnnncgaaggaaagaaagaactccatttaaggatagaccactactatggagagagagtatttcatctcnnnnnnnnnnnnnnnnnnnnnnnncnnnnnnnnnnnnnnctagnnnnnnnnnnnnnnnnnnnnnnnnnnnnngtcgaattcaagagagctaaaaaattaccatttttatcgccnnnnnnnnnnnnnnnnnnnnnnnnnnggaaggaaaaggtatcccgttctaaatatatctaattgtttaggaaataccgtaaccttatttattaacaagatatttatannnnnnnnnnnnnnnnnnnnnnccatcacatattttttaggcatgannnnnnnnnnnnnnnnnnnnnnnnnnnnnnnnnnnnnnnnnnaattaggatcaaaaattttcatatcttaaaacnnnnnnnnnnnnnnnnnnnnnnnnnnnnnnnnnnnnnnnnnnnnngattcnnnnnnnnnnnnnnnnnncnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntannnnnnnnnnnnnnnnnnnnnnnnnnnnnnnnnctttttttattgatagctggaatgaaggcttggatgaaagnnnnnnnnnnnnnnnnnnctttatcaagaagtctatttttaagttgcaaagcttagatgtttttaggagacgagcacagcctatagagt

SEQ ID NO: 15987 - DNA, 517 bp, Diabrotica virgifera
  misc_feature (409)..(430): n is a, c, g, or t
cctttagcgtccgcgtgctccaaattataaaggatattaaaactttagtgtattggaaagccgcctgaatgaataactaaaatatataatgaagataactattttaattttatccacattaatatattctgtacataactataatggccttatagattgtcctatgggttcacaaacacaacctactccgaaaatatcccaagctcttgaaacttcctccaagattaatcagaaatgatttacctgaaataactctagatcctcctcccaattgcaatagatgtcccaaaaggtgaaaatttctatgaatgtgattcatctattcttgaccctcctgtatctgtttatgatattattaatattcctcctgtatatacatttgtctccagaatatcactctattccaccnnnnnnnnnnnnnnnnnnnnnnatttacaattgttatattaacagcctatagtatctttgcttagacaccctgatagactacctggccaccaactttaactatttctat

SEQ ID NO: 15988 - DNA, 486 bp, Diabrotica virgifera
  misc_feature (456)..(476): n is a, c, g, or t
actagttctagatcgagatgcgcatccgttttgattgatgaagttattgagactctatctgcgaacatgtagtttcaaaaaatattagcaaaagtatgtcctcacgctgccagaggaagacctctgcaaaatgttacaattgctacaaacgtgattgtacgactccctatctggaacctccgaagcgatatgtttataatacgtctatcattaccacgaacactttgtgcacccaaccataattgacaacgtccattatttaactccaaggcctcccggatataacacacaactaaagaaagaagcacttgaattctacatttaccccatcggaaaagaatgtaaaagcatggttgccaaactaatacttccatgatccaacaaaatcacaatatcttactatagtacattgcaacatattactcttctgcttttatgaaaaattaaactataaannnnnnnnnnnnnnnnnnnnncgcgtagcga

SEQ ID NO: 15989 - DNA, 666 bp, Diabrotica virgifera
  misc_feature (36)..(36): n is a, c, g, or t
aatgtatgaccaactcacacgtaataaaaaattgcntgaattcaaatgaagatttctcgctattcgataaagatggtgatggaacaattactactaatgaattaggaacagaaatgatgtctctagggcaaaatccaacagaggttgaattacaggatatgatcattgtagaagatgccgatggtaacgaaacgatcgatttcccggaatttttaaagatgatgtaacgtattatgaaatgataccgatagtgaggaataaatacgtgaagtattccgagagatcgactaagacgattaagtattcatctcattagaagaattgagccacgtcatgaccaaattggatgaaaaatatgacagacgaagaagacgatgaaatgattcggaaggacgatatcgatggagatgaaagtcaattactatcagatcgtcaccatggtgaccacttagtgtgataccagagtagcattatcagctttccattgtttcatcccgactcattgtctacatatttcaacacctcgaagtttttgctatgaggacgaatccactaaagagaataacttaaccgatatttgatttacaagacaaacttaattaatatatatatctataaattaatataatggcgtatattattgtaatatatgtgtctttctgttcg

SEQ ID NO: 15990 - DNA, 595 bp, Diabrotica virgifera
  misc_feature (7)..(7): n is a, c, g, or t
  misc_feature (14)..(493): n is a, c, g, or t
tctctcngcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaattttgtattaaaatatacacttaagtcatttaacacttaagaatgaagaggatactagtttaaaagtttgtatattagcaacataaataagtaaatca

SEQ ID NO: 15991 - DNA, 536 bp, Diabrotica virgifera
ctcccagggtccggtttatcaacatccgaagagggattgctcttttctttccgaccgcaagcagccgacgcgggaacgaagcgagaaggaggacagaaaaagagaacggattttttttgtaagactgataagaagggaatgctgtcatcattagtttcacctgcagactaataagatgccttactagcattaaatagtgaatgtgcgcgctcagcccagctgagaagtacggaatgaatgctgtattgtgaccgtgcaacgtgcagcatagtgattagttgttttatagagaggtgaaatgatggatgggatgtaagtaaacatgaccctatttaatatataaagaatgttattgtgaagataacaagtgtacagtgtgctaaaagaagagaagaagctatagagatttatcaaagtattaacaactgtttgtagtactaatcttatttatatgccagattgatttaatatggttgaataaaaaataatagtaccgttttttagcccattacagtaatcatctaattttttgtcgc

SEQ ID NO: 15992 - DNA, 848 bp, Diabrotica virgifera
  misc_feature (6)..(27): n is a, c, g, or t
cttttnnnnnnnnnnnnnnnnnnnnnnaagtagtagcattatttgtttcttaccgaacacttgaaaatggaagattacaaagaagacaaaagggaatcctggttagtcgatgttaagagagacacatcccccgaccaaaattcggcagcggctcccgttgtggctacagttaccccacagaacctccctaagactacatcaacgaatacgccagagacgacttcaaatacaaaggttcaccgaagtatatgaacaaagcctccgaagagatcagaaggtcgttgctgaaattgtaatgaatacacgatggttaatattttccgtattgccatcaaccccgaattgtacatatctgccttctattcctagtaactaggaatagagattatttgtttttaagatagaataaacgttatcataaacgttctgtacaattacatgtacatatgtgaaattattatagaaatttcagagtttgtggactgtattcgagggtgtgttacacaaaaaattgtagagaggtgaattaaatgttatacagaaaatagtcatatcatgttcataaaaaaggcttaactcatatagtagttatttcactcgaaatactcagataaatagttttctcgctctaaactcacgagaacaacacttatgttcccttcggagaccaaagagagggagtttttcgtttacagtgtctaagaatacgtctgcatttctatcgaagtggggatatatgcgaagtaatagtaattattattcatagatgctctaagtaattatctactactgagtgtgaaacttatcgtaatgatacagtgaaaaatataatattatttttcacatgt

SEQ ID NO: 15993 - DNA, 848 bp, Diabrotica virgifera
  misc_feature (85)..(118): n is a, c, g, or t
  misc_feature (568)..(596): n is a, c, g, or t
tttttgtcctaaatgcgcaaaaaacttgtcaaatacctggccagataagactcacttgttttgggtgatttctgcatcatgtcgnnnnnnnnnnnnnnnnnnnnnnnnnnnnnnnnnnccgtcttagcttaaatgaaactatcgaattccgaaatactatattttcgtatatagataatatagatattttttattgttgtcgatttagcttatggaagactagcttataagtgtactttgttatgtttgtttaaaagagcgtacgaaatgttaaaggttaacagagtttaagaagtttcgatttgacagggatgcacactttttaaatacagtacataaatttttccgtctcgtagatgtgcgcatttacccagaaccgatactagtatcacacagacggcaacactgtagagctgaaaatttgattgtctagtacaaaaaattgcaatttttgttgttgcattttaacagtttcaaaccgagaatggtatgtgggacggaaaaatttaagttctgtatgtatatcatataaaatatgtgtacaactaaaatcaacgggtcaacagcnnnnnnnnnnnnnnnnnnnnnnnnnnnnncagcaactgttaaacaagtacactacaactatataagatttctaacatattcaagtataaaagcgataatatcgttggcaactttcagtagaatgttgccaacgactttgaaatgttatttgaattgattatttccaaaaacgagctagaatttatatcttaactgctttatagcttcgtataaacctttgtatatgtatatttcggcaaaaacttgtcttcgtttgtcgaaaaacgctaatttacgaaaaa

SEQ ID NO: 15994 - DNA, 856 bp, Diabrotica virgifera
gacaatgttaaatttcttgtcatctcaaaaattcaaacaactcagaaaaaactaaattgaaacagacgaacaacagcaccgtgtattatgtttatcacaggagtttagatttaattaaaatagaagtgatatttttgtcggagttcgacctttgtatgttcccaatgtggtggtatatttgaagtgaaagattcagtaattgtcctatcgatcataaaaactttaacattattcagtgtttatcagaaacaacaggttagaattccaagtgtaaaatcataaatatataacataaaataatggaagaatacacgcgagaaccttgtccctggagaatcgtagatgactgcggaggcgctttcacaatggggttaattggaggaggagttttccaaagcataaaaggattccgaaacgccccttcaggaattaaccgaagacttattggtagtgtaactgcgattaaacagggatctcctataatagctggtaattttgcagtatggggaggaatgttttcaaccatagactgtgccctaatccacataagaaagaaggaagatccttggaattccatcatcagtggagcagcaacaggaggtatattagcagcaagaaatggtcttccagccatggcaggtagcgcctttattgggggcgtgcttttagctttaatagaaggtgtcggtatactatttaccagactttctgctgaacagtttcagcctcaactcccccctatggaagatcccctcagttttaggagaacaacagtcgaacaacccgggtagttattcttttcaatagaaccatttttattagtctggtatatagttggtaaataattatacattac

SEQ ID NO: 15995 - DNA, 903 bp, Diabrotica virgifera
aacagtcagtacttctacagaaagaaggattaaaggtctattttgcccttacacagtatattttgcctttagatttgattagtaaagatgcttttgctcaatggatggaagtctgcagacaggtcgttgaaagacctgtacctcctgcagcccttcaaccagatgaagatgaacgcccagacttaccgtggtggaaatgcaaaaagtgggcccttcacatcctgtaccgtatgtttgaaagatatggttcaccaggacatgtgactaaagagtacaatgaatttgccgagtggtatttgcaaacgttcagtgcaggcattttggaagttttactgagagtgttagatggctatcgtggtggtaattgggtacctcctagagttctacagcagacattaaactacctcaatcaggcagtgtcccatggacatacgtggaaaatactaaagccacatatgcccgctatcattcaggatgttttgttccctcttatgagttactcggctgaagatcacgaactttggaccgttgatgcacatgaatatatcagagttaagtttgacgtctttgaagattttgtatctccggtaacagctgctcaaacattattacattcttcatgtaaaaaacgaaaagaaatgttgcaaaaaactatggtaatgttgacaactatcctaacgaacacggcaactgaacctgcacaaaaggatggagctttgcacatggtcggttccttagcagatatatttttaagaaagaaaatgtacagggaccagttggatcaactcttcataaagtacgtgtttcccgatttcaacagcgacaggggacacttgcgagctagagcatgctgggttctacactatttttgcagagttcaactttaggcagaaaaatattttg

SEQ ID NO: 15996 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 15997 - DNA, 523 bp, Diabrotica virgifera
  misc_feature (2)..(253): n is a, c, g, or t
  misc_feature (260)..(297): n is a, c, g, or t
  misc_feature (317)..(330): n is a, c, g, or t
  misc_feature (333)..(355): n is a, c, g, or t
  misc_feature (363)..(385): n is a, c, g, or t
  misc_feature (415)..(446): n is a, c, g, or t
  misc_feature (453)..(518): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnataag

SEQ ID NO: 15998 - DNA, 544 bp, Diabrotica virgifera
  misc_feature (10)..(10): n is a, c, g, or t
ctctacgcgnccggcgaaccttcgtagaatggaacctaccttgttccagcccactttgtattcttgtacattgcaagggtagcgacgaacatcctgaattatatttacgttatgtgttttttaccaaacccttgtttgcaaagacacgtgcactgatgatgatcctctcatttcgaagagaggattcgtcttctctcacgttgtatgtttatgaatgaagaatataccatgaaggtgagaaaagaagaatggatattgatatgtacgaagaactaactgatcctgtcattcaatttcagatcaagatgaatatgtagattatatttaatatatggcctatattgtaccagataattaggtaacgtggtgcttattaggatagacgtacaagatacagcttaattaatgacatagacaagacatttaatctgctcgaatgtggacattggactcattctcattgagatacgatcatcagtgaagagtatgctcaaatgccatctggagattgtatatgtgcagatgcctgaatggtgccaattaa

SEQ ID NO: 15999 - DNA, 753 bp, Diabrotica virgifera
  misc_feature (55)..(75): n is a, c, g, or t
ttcgcgtccgttcattttacatgaatttttgtgtatttactatgttctgttaacnnnnnnnnnnnnnnnnnnnnngttggttgtgtgtcatgcctcaacaaatggacatttcctcacagcattgtttagcccgagcactctacgataatgtccccgataccccagacgagctccaatttcggaaaggtgacactttagttgtactggaacaaaacacagcgaacatcgaaggatggtggctttgttccctacgaggaaaacagggaatatgtcctgcgaacagacttcgattaattcctggtgtatttgaagacactggacagcttatcagaggtatttctccgaaccaattttccgaccaaggtgattttatctctttgcaacgacagggaaagagaagaagttggcacgtccttcctaaccaggtcgtaactcccaaaaaattcaacgatgtatttttatacgacatgcctccatcgagatgttctccgatttcagtttcttcaggaattagcccgggtacgataactcgggaccagaacgactgctacgatgtacctccccgaccagtaccagtaggtaatgaaagttttaggaattgcccccgatgctccccagccccatcatgtgcctcaccgatcaatagagattcaggtgacacatatgacattccccagacaacatttaggcattcagaaccaattaacaccctctagttcggctagttctctaacagcggattcacttagttcg

SEQ ID NO: 16000 - DNA, 94 bp, Diabrotica virgifera
  misc_feature (3)..(49): n is a, c, g, or t
  misc_feature (55)..(92): n is a, c, g, or t
ttnnnnnnnnnnnnnnnnnnnnnnnnnnnnnnnnnnnnnnnnnnnnnnnacgagnnnnnnnnnnnnnnnnnnnnnnnnnnnnnnnnnnnnnnga

SEQ ID NO: 16001 - DNA, 634 bp, Diabrotica virgifera
  misc_feature (56)..(80): n is a, c, g, or t
  misc_feature (247)..(269): n is a, c, g, or t
  misc_feature (486)..(504): n is a, c, g, or t
gtttgttttaagatgttttacaacaccaaactaattattgtatattacccgctttnnnnnnnnnnnnnnnnnnnnnnnnnattgcactgaattcgaacgctataccaactaggatacaaggactgtgactatatcggttcggacgtacctaatgacaattgtaacaaacagacaaggcataataaatatacaataaaatgttttaataatactcatcttacttctgaggaacaaaaatccaaagacnnnnnnnnnnnnnnnnnnnnnnnctaaaaacatttatattctcttcacaccttttcttccatccatccaatgatactacagcccaaatcgagccttggcctccttcaataagcttctccaatcatttcgatttaccgctgttcttttccatgaacgagatcccagaaagtgcctgaaatcctcatcgacttcttcttcccatctctttttaggtcttccaaacgtgcttcttccctgcannnnnnnnnnnnnnnnnnnttctattctcatgcatgcgaaccacgtgacctgcccaccgtaatctctgtagcttactgtattgtgctagagttggctcgcatatattgctcgtatatttctctattactgccgaacccgcttattacaa

SEQ ID NO: 16002 - DNA, 197 bp, Diabrotica virgifera
  misc_feature (4)..(50): n is a, c, g, or t
  misc_feature (52)..(64): n is a, c, g, or t
tgannnnnnnnnnnnnnnnnnnnnnnnnnnnnnnnnnnnnnnnnnnnnnncnnnnnnnnnnnnngatttttgttgagtataataagagattaccttacagataacggagtaaatatattgtaaagatgggaacaccagtaattattgcctcctgtaagttgtaaatgactttttgtcttttcgcaggaggccctcgc

SEQ ID NO: 16003 - DNA, 92 bp, Diabrotica virgifera
  misc_feature (27)..(27): n is a, c, g, or t
  misc_feature (44)..(44): n is a, c, g, or t
ggatcactctggatgtcttattaacgntcaaacgtctttcgtcngtatctactgacccagagttaatcgcaaaagcagttgaaaagtctgaa

SEQ ID NO: 16004 - DNA, 887 bp, Diabrotica virgifera
  misc_feature (22)..(42): n is a, c, g, or t
  misc_feature (514)..(534): n is a, c, g, or t
  misc_feature (559)..(584): n is a, c, g, or t
  misc_feature (591)..(610): n is a, c, g, or t
catctcgcgtccggcgataacnnnnnnnnnnnnnnnnnnnnncttacccgtaaaagttgaattagtaaccgctaggaacgacaccagcgaagctcagagcgtatagaatcgacgaatgactaaataaacccacgagacttgggtgtgggaagcgtagaagcagtgttgccatgtattgggtgtactactatatctaatttaaaagtaaacccacggtatgaacattaaccggttccgtcataatatgatgcttccggtcttcggcgtataatatgatgcttaagcagtcaagcattttatgtaaaaatggatgaatctcatgacaatttcagtttagactggtataccctatatagcgtttctcgaatgaccagattctattcccatcagctttttatttgatctaaacttttctcaggtacatttattaaaataaaagctagtcgtaataagacctagcgaataacgacgaattttttatatgagtccttgccgcgtttactattaagtaccnnnnnnnnnnnnnnnnnnnnncgaagtagttttcaatcctaatagnnnnnnnnnnnnnnnnnnnnnnnnnnggtatannnnnnnnnnnnnnnnnnnnattcttatggtttctgtagcactattttccattgtctctcttccatttttttacaaatcctctctgattgtgtctcatctggtttttgtgagaatattcatcttcttaaaatcctttttgttatccaaaatccaatccatttgctacatgtattattatgttatttttctgcgctttactgcgctaaagtaatggacaagatggaataaaattaaattaggttagattttgtacatccctttttctggcgtaattgcttattgctgacgtttcgtct

SEQ ID NO: 16005 - DNA, 558 bp, Diabrotica virgifera
  misc_feature (3)..(3): n is a, c, g, or t
agnccgtgcacgattatcatcggactgacgtgtactctcactcctaatagacttagaaaatggcacgatgactaacaccccgactatgggcccttctaatgcaggcatggtgtggcccgctggctagttatcaatttttcagttcgtctgagacgacgccctcatgaacacggggaaaaatcgaggaaccgacgattgcacgcatatgtctgatcatgacgatcggaacttatcatgaaatgtattatcccagtagacatggcggatatacatggtcatctacggcactggtcatagctgtactgagctctgatattatccaagctgagctctacgtattcatatggacagtgccaatgatcaatttgctagcttgttcttacgctaataaattcactgattgccctctaactgcggtatgtagtgatggtgcggtgtcgctgcagaaaaaaagtccggacaccagcatagatgcttcggagcaacgcctgtgacagtcattttggccgaagcaggactatatgatggactctttcactgcattgacgtctatactag

SEQ ID NO: 16006 - DNA, 897 bp, Diabrotica virgifera
  misc_feature (763)..(781): n is a, c, g, or t
  misc_feature (820)..(837): n is a, c, g, or t
  misc_feature (839)..(839): n is a, c, g, or t
  misc_feature (848)..(848): n is a, c, g, or t
cgcattgaaataccaaggtccggtttcacgaacacgcgtaaaacgcttcgtaactccaagcgatcagtcacaataagatcgagaacactaaagtgttatcgtggtctctattactatacgaccgtgagacctcggaaattaaaacagtatcgaagtcaacaaatcgaattcattcgaaatcgtgggtgtaccaccgaacgctaaaaataagctagaccagcagaactataaatgaagaagtactcgaaaagaatcgaacacacgtcctcatctagtcaatactatcagaattagaaatacgtcatacgtaggacatacaacgcgtcatacggaattttatcagctccaggtaatattagaaggcaacgtcgaaggtaataggagtatagaaaagaaggaaaaatctcgacctcgaaacatcagagatcggacacacacaacaggaaattctttaattcattcaagcgcagaaacagagaaaatttcgccatcttgatcgccgacctcaatagagaagtcacttaaggagaaggaacttcacctaacagaaactttaaacttttttcgtctttcgttatagattaattggtttaagtctaacttcaggttactggtagatggtctggtttgatttaataaaaaactttctactcatacttcttggtaataatctaataagtggtatagcagcataagtggataaagtaaattaaagcgtaatacaaaagttagttttggtgttgtgatacctagaatatgtgannnnnnnnnnnnnnnnnnncatttgtattttctattacaaatttcagaaagtggttgnnnnnnnnnnnnnnnnnncnaataaattnagtgttgtataataagaagttccataagtgtattgtcataaaatataat

SEQ ID NO: 16007 - DNA, 910 bp, Diabrotica virgifera
  misc_feature (827)..(827): n is a, c, g, or t
ctttttgtttcaaacgtgaaagaaaatatactttttggaaaaccattcttgaaaaacaggtaccatgacgtagttaaggtgtgctctctagaaagagattttaaacaatttccctttggtgatagaagcttagtaggtgaaagaggaacatcgttaagtggaggacaacgagcaagaattaatcttgccagagcagtatacactgaagcagatatttacttattcgacgatccgctatcggcggtcgacacaaaggtagcaagacatctttttgatgaatgtatatcgaaatatttatatggaaaaactagaattttggtcacacatcagctccagtttatgaagaaagctgatttgataattattataaacaatggtcaaattgagaaaatagccaaatttaacgaattgtcggaaaatgacttgaatgctcttcaacaagaacctgaggccgatgataaagagaaagaaaaggtaccagagactggcgataagattcgtaaaaattcgacagtacctcatttccagtctatgagttctttggctagttctgtattctcggatgatccgaacgaagaagacgaacttatcgaaaaaggtgccatttcaaatgctacttatgtggaatattggaaatcaggcggtggagttttattcttattctttacaatttttatattcctcgtcgctcaaatgattacgaatgcatcagatctttggcttacacattggactaataacgaggcaaaaagataccatcttagtgattccctacacaatgcaacttccaataaaaccttagaaagaccattactaatgtctactgnattatctgatgagatgtcaacttctgctacgttattaacagattcaacaccatctgcagatagttcacttctaagtttaagtc

SEQ ID NO: 16008 - DNA, 715 bp, Diabrotica virgifera
  misc_feature (83)..(110): n is a, c, g, or t
gtttattacacaacaaatgcgtaccaattgaaggtttcgataacaaatccttttaaaaataaagatgtttcgaaactagtagnnnnnnnnnnnnnnnnnnnnnnnnnnnngaaagatagtacaatgtccgtgaataacattgaatctctttgttctcaaagagttggatacaataaaaagattattaaaactgatacgagtagtttagtaccagaaggagaaaactatgggggagaaatggtaaaattgaatctggtgggccaggacgaaaacagcaatcagagcgaagaaatacatggagtcgcggaaataattcctccctcggagatatatcaggaaatatttaatatccaaagataatattagagctgaagtacagttctactagaaactagtaccgctaattaacatgttcccgttgaaaatgaagaagagattggaacaagagactacggacaagtgtatgagatgacgacgaggcgggagaaaacagaaaggataatgtcattgagcaaaaagaaaacgatgaaaaaggaagacgtagaagaagatgatgtagtatcgaaaattactcgtgaattacaacaaatttgatctgtttattccgtatgaacttatgtttaagcatccaccgttgacttgcaagcctacatgacttttgtgccagctagtgagtggttaaacccaaaacccgtccgtaatttccacctgctat

SEQ ID NO: 16009 - DNA, 790 bp, Diabrotica virgifera
  misc_feature (2)..(44): n is a, c, g, or t
  misc_feature (52)..(164): n is a, c, g, or t
  misc_feature (174)..(351): n is a, c, g, or t
  misc_feature (353)..(538): n is a, c, g, or t
  misc_feature (540)..(783): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatt

SEQ ID NO: 16010 - DNA, 910 bp, Diabrotica virgifera
  misc_feature (776)..(776): n is a, c, g, or t
  misc_feature (805)..(805): n is a, c, g, or t
  misc_feature (851)..(851): n is a, c, g, or t
gcattgtgtttctatatttttattcgtctgccagtacgtctgcaagattttgacaagtattttgtggattaggttacatgacaccaaaatgaatctattccagtttgctattttcttaggatactttagtattggatactgttacacaaaatatggaagaacttgcaaagacataggatgtcccagtactcaagaatgtgtcatggccacagatccatgtagttactaccatagacaaggggaatgcggttcctatcccacatgccaaagagtttcaaatgcacccaggacatgctctacgtacgtttgtccgcctaccaaagtatgtagaatggatggagatacaccaaaatgttttgatgatgtgggcaaagttggccatgtaggttacgagactagtggaaacactaatcatttatcacaaagtggacataatggtaatctgtatcctaatctaccaaaaggagaaacaacacctaggccgaatattaacagaccagttagttcaggtggatatcaaggaggtcaagtaggttctggttatccaggaggacaagtaaattcaggttatccaggtggccaagtaggttcaggctatccaggaggtcaagtaggttcaggctatccaggaggtcaagtaggttcaggctatccaggaggtcaggtaggatctggatatcctggatacacacagcaaggaggttatcccagacaaggatatccacaacaaggatatccacaacagggttatccacaacaaggtaattatccacaangatatcctcaacagggatatccccaatcnagatatcctcaatcaggatatccacaaacaagtaattatccacgancaacagtttatccacagcaatcaggatatccgcagcaaggagcatatcctggatataat

SEQ ID NO: 16011 - DNA, 814 bp, Diabrotica virgifera
  misc_feature (768)..(768): n is a, c, g, or t
  misc_feature (780)..(780): n is a, c, g, or t
gaagaagttggaccttatgcatatgaagaacatctcgaaagggttgatttggaatttccaactgataactctatctcctataaagaaaaaaggaattacgtatttaagcctgagctaaccaaaggccgtcagaacgatcagcttattgtaccaaatatggcagtacttagtggagctgcctttactaagccaaacaactactttcagcggttggcattttctggtttgctatcgacaatgaacgaagaaccatttttgacgaaagctgcagattcctttataactggatataaagatcgtttatacgatatagctaaaacttttatgcctgataatattccgcaacaaatgggtgtgttggctcccaaactcggtcaaactccatacagaattactatcaataatggaaaagatgatattgatcatttggggatagtagaaaaatttaatggagaaactgagttaaactattttgctggaggacagtgtaacagtatcgaatcaacagacggcgcaatacacccaccaagaaaagtccagaaaaaagaacctcttcattatctcttccctgaaggatgccgacgatttcctctaatctttaacacagaaaccaccgtgatagacggtaaagtcccagtttatcaatacatacacccagaagacttgttcgactccgctgatgagaaacccgaaaacggctgtttttgcagtatggatagcgctcaatgtcctctgaaaggtgtttacacgcaactgcatgcaactatnggtcaccagtgntcgtgtctcatcctcatttttcacagagcgatcc

SEQ ID NO: 16012 - DNA, 916 bp, Diabrotica virgifera
  misc_feature (161)..(186): n is a, c, g, or t
  misc_feature (510)..(553): n is a, c, g, or t
  misc_feature (783)..(815): n is a, c, g, or t
  misc_feature (858)..(858): n is a, c, g, or t
gctgtgtaactcgaaaatgtaagatgtatacttcgttaaattagcttgaagtctatttgcatgcttcaaaaaatttaatattctaaaattgttacaaacatttatgagcatcagttattgaaatagtttgtatttgtatatttgcaactttcaacgtacannnnnnnnnnnnnnnnnnnnnnnnnntgtttaaatcatgacaaaggcccaacagaccctaatatgcccaagaagaatatgatagcaaagatatgtccaacctgcaaacaacaggtacctgtggcatgtaagtcttgcccctgtggccattttttctacaatgctagacgcatagctagagagtttgccatagaggcagactataggaggagaactgctagagttcggagagaaaagcctaattattatgatgcccttgagtatgagaagcatatcaaaaagatgaaacaacgtttaagtgaatgtgataatgatgaagaggaagataacagaaaggataatggtaagagnnnnnnnnnnnnnnnnnnnnnnnnnnnnnnnnnnnnnnnnnnnntactaacaaaaatcactcctgaattacaacaacattgtcagtttattctggaacaacttaattttaagcttcaaatggttacttggaagcctacatgactttgtggtagctaatgagttgttaaatccaaaacacttccatatttctaacatgctatgtactaagagtgtaagtcataaaaaagacctgtcaggattcttctatattttgaattttataattaataaggnnnnnnnnnnnnnnnnnnnnnnnnnnnnnnnnnctacagttatgaatcatatttcatctccattttgatatttagntgtaaatagtattcagcagtagtaataaaaaactgtcattattgacttaacatgacag

SEQ ID NO: 16013 - DNA, 835 bp, Diabrotica virgifera
  misc_feature (2)..(18): n is a, c, g, or t
  misc_feature (20)..(64): n is a, c, g, or t
  misc_feature (71)..(824): n is a, c, g, or t
cnnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattatttata

SEQ ID NO: 16014 - DNA, 576 bp, Diabrotica virgifera
  misc_feature (11)..(54): n is a, c, g, or t
  misc_feature (66)..(101): n is a, c, g, or t
  misc_feature (109)..(564): n is a, c, g, or t
ctctctctccnnnnnnnnnnnnnnnnnnnnnnnnnnnnnnnnnnnnnnnnnnnnccgtgagagaannnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaatttcggc

SEQ ID NO: 16015 - DNA, 521 bp, Diabrotica virgifera
  misc_feature (2)..(93): n is a, c, g, or t
  misc_feature (114)..(149): n is a, c, g, or t
  misc_feature (294)..(313): n is a, c, g, or t
  misc_feature (423)..(440): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatcaggtattattaatgnnnnnnnnnnnnnnnnnnnnnnnnnnnnnnnnnnnngctaaagttataaaattataattgttttacatttattgtatttaatactattggcaattgactgagagagagattaaatttttgccatttttgttatcatgagttttatatggattattaaaagtacatgatttataataagtgnnnnnnnnnnnnnnnnnnnnagattatatgtctgaacgagaacttagaatattttactataagttcgagttatattcgaaattttatgctcgtttcacaatagtcatcatgaatttaaggtgtatattgnnnnnnnnnnnnnnnnnntatcatttgtgtattaggtgtttatgaaagttcatatttaaaaagaatataagaatgaaattgtgataaagttagtatatt

SEQ ID NO: 16016 - DNA, 556 bp, Diabrotica virgifera
  misc_feature (39)..(58): n is a, c, g, or t
atgataatttggtagattagttgcagtgtcgcgttttcnnnnnnnnnnnnnnnnnnnntcgatcgtcataaatcaaatactaagaatattacgaggtgagagtgataagtagacggtttattcgaagatcatgtaaacgctcatcgcgtcaattatcgtttgtacgaaaatctgacgaacatatagctcgcgaatcataatcgatcgcgtcgggaattcacacactctaccacggggagcgaccaatcgataacgaaacatcgatcgcgaggatcgtataatatccaaggaataacgagggatccctcatcccaaatcacgcatacgaagcacgcagatatgcacaagacgatgtggcgcgcataagatttcgtgaacacactacccacacgtcgaacatcagagagtcctcatgaaaacacactctcgaacggtagaaggaagcaccacacaatacctaggtcaaccgaaagaagaacgactcaaattaatcgaacgtaaaactaaacaacgaccattcgctcgatcgctaagaacgcgctatcactggattcga

SEQ ID NO: 16017 - DNA, 892 bp, Diabrotica virgifera
  misc_feature (2)..(24): n is a, c, g, or t
  misc_feature (175)..(195): n is a, c, g, or t
  misc_feature (282)..(299): n is a, c, g, or t
  misc_feature (388)..(405): n is a, c, g, or t
  misc_feature (532)..(553): n is a, c, g, or t
  misc_feature (555)..(649): n is a, c, g, or t
  misc_feature (681)..(704): n is a, c, g, or t
  misc_feature (706)..(780): n is a, c, g, or t
  misc_feature (783)..(815): n is a, c, g, or t
  misc_feature (817)..(852): n is a, c, g, or t
  misc_feature (857)..(883): n is a, c, g, or t
cnnnnnnnnnnnnnnnnnnnnnnnctctaacgatagttaatctagtatccgtcgagagaatatctctctctctcacaaaagaaaaatctcatctctctccgtacctcgtcgtatccagggatctattaatctcaatcaatctcatcatcattcatcctctttcgaatctctcaannnnnnnnnnnnnnnnnnnnncttttctccgtaaaataaatatctttcaaatcaatcttccccgtaatcgaaacgttactcgttttcaaataatcattctcaatttcnnnnnnnnnnnnnnnnnncttatctcactaacaatatcatcttatcaattaaataatcttttcatcatctatctcaataattaaatatcttttagggatcgagctcnnnnnnnnnnnnnnnnnnctaaaatttaatctcttcaaataaaaattcaaggattcaaaaatttttcatctttctcaaaataatcggttatctcatctcattttcatcatcatctatctctttttcatttttctcaaatttttcnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctcgtttattaaaaacatcgtctttttcnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnnnnnnnnnnnncnnnnnnnnnnnnnnnnnnnnnnnnnnnnnnnnnnnnaagcnnnnnnnnnnnnnnnnnnnnnnnnnnntatagagtt

SEQ ID NO: 16018 - DNA, 582 bp, Diabrotica virgifera
ctgtctagtgagcagtgatcaaccacaccttttaacatgtgtgacgacgatgccgccgcccccgcgaagatcaacgacctgaatattgtctaacacgaattctttttaatcaaccacgacgccctaccaggcagaagcgatgagcatataatccttaccaaccaaacacaataatgcaaatccatcgagaaactcgtcatccgagagtgactacaactccaagatccaacttccgcatgaaggtagcgaacccagaccttgccgacgtgccaaatcctaacacctagcaccccacgtattaccgagaactccggacccaaagcacatgcgacaccattgccgtctggagaaaacatgagcgaacgcgatccgtgactagccaacctcaagaacccacactcaacacacaaatacgcacgtatcagcaccctgagaaagagatgtacgaagcaaggaggcattaaccccgacaaacgggcattggagatgagcgatatacggacgcccaaagctacacagctccacgttcaaccgtgtcaacaatatcgcggggatacagagccgagcagagcaagcaccacc

SEQ ID NO: 16019 - DNA, 935 bp, Diabrotica virgifera
  misc_feature (344)..(357): n is a, c, g, or t
  misc_feature (359)..(371): n is a, c, g, or t
  misc_feature (383)..(401): n is a, c, g, or t
  misc_feature (852)..(852): n is a, c, g, or t
  misc_feature (878)..(879): n is a, c, g, or t
caaatcgtacacgcgaactacaggttaatatcggattccaaggggaggtatcgtctttacagaacagttttcctcgtctcggcgacaaaattacaggattttcgtcgttgagataaggataaatttcgttttcctttcatcgggaaagtgaaattactttaaaaattcgttatcaaacatcgttttaaatcgggcgtacaaatttatcaaagacaccgtaggagcttatcttaacaaattaggtgttcaaatatatttaggaaagtagagagttattgaaatgaagagatatataaaatttatccagttagaatcgttcctatttgattgaatattatgaatannnnnnnnnnnnnncnnnnnnnnnnnnngtttaattttcnnnnnnnnnnnnnnnnnnngttgaagtttatttatgagattttagaaatctgtatatgtttaagttaaacataacgcaaaaggaaataaatataaactatacaggaagatattgacatattaacaatagtcctaataaaacataatgttgatacacacattcttctagaaacaatgcgaaatttgaaacaaaatatattttttcgacaaataccattcgcttaatttttaaaatacttacattatttagtggtaattttgacaccaccaaaattacaaaattattgttatttctagattagtttaattatatctgtatagttatttattattcattcccgaaattaattttaaaaccgcataccgaaataactaataagcaaattagtaatttaatacaagcaaacaatttatgtagatctacatgtcaaaatacatatcacggcgaacataattactttcacattatgnaagctttcagtaaatactttttcccnntcaagccggacttttgactatatttatcttatcagcattattttgtacattcacat

SEQ ID NO: 16020 - DNA, 589 bp, Diabrotica virgifera
  misc_feature (15)..(15): n is a, c, g, or t
  misc_feature (163)..(184): n is a, c, g, or t
cactacgcggccgantttatttacactacggtcagccgtatcttacattttgctttttattctggaaacaaaacagaagctggaaaagagcccaaaagctcgtttaaattttcctttgtcatttgattgagcgcgactatgaaaacaatagaaattattctgnnnnnnnnnnnnnnnnnnnnnngaacatgattataataatggaatggtatccgaatgaaaatatatctaactttttcaaaactatattaaagtgacgtattaagaatatatttattactaaatacatttacattatgaatatataaaagataatctagggacggaattaaaaatagaattatattaacagttagtttttaaatacatattaggataaaaaatttgaatattttaagatatgaatattatttattttgacatataattatttctatcaattcatcaactataaataaagatatacattcatattatttaaaactatttatgatgttaatattaggtatcaataaatgtacatatctaaaaaatacataggctgaaaataggaaaaagttaccatatttttcacctgattactaaaaac

SEQ ID NO: 16021 - DNA, 192 bp, Diabrotica virgifera
  misc_feature (28)..(49): n is a, c, g, or t
  misc_feature (51)..(151): n is a, c, g, or t
  misc_feature (159)..(179): n is a, c, g, or t
tgataatattagtattatcaaattgacnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcggcnnnnnnnnnnnnnnnnnnnnntataatcattagc

SEQ ID NO: 16022 - DNA, 789 bp, Diabrotica virgifera
  misc_feature (2)..(18): n is a, c, g, or t
  misc_feature (20)..(62): n is a, c, g, or t
  misc_feature (70)..(182): n is a, c, g, or t
  misc_feature (192)..(779): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagttt

SEQ ID NO: 16023 - DNA, 911 bp, Diabrotica virgifera
  misc_feature (819)..(819): n is a, c, g, or t
  misc_feature (891)..(891): n is a, c, g, or t
  misc_feature (894)..(894): n is a, c, g, or t
aagtcgcaagtcttctctcgtctcttctaattttcttgttagccttttgttatccatgtttcaggtctctcccaaatctgtccatcgatctctatcctgaacaacatacctcaaatttgttattatccagatttggccatacggctcacactccctctaagaggaaaattggcttatcccagatacctacggtatcacaaggattgagctctggtgggactcttcatgatatcgagccctaggtgacttggtatgcaggtgtatctcccaagaattttcgtacacatctgatcgttgcgagtagtacagctttctgcatggtgttgtaaagatgttcatctagacccagcttttttatgctttcgaggaggttcttcggaatgaccctagtagtagacataataataggtattgtctgggtactttgtattatccattatcttcgtatttgaatttccagatctctgtacttggcgatcttttcagtaaatttactacgttggattattgttgtttggtatcgccgcatcaatgagtgttgtttgtcttgttaatttattaactagtacgagatctggtctattatgtgccactgtttggtctgtgagcacattgtggtcccagtatagcttgtagttgccatcctcaagcatactctcagggacgtattgataatatgggagatggtccgtttggagaagtcccagcttgatcgttatctcttgatgaaggatttttcccactgcgtcatgccattctttgtattcagttgcagaaaatgcctggcagccccctgtaagatgttggatggtttcttgnacttgacatccatatcggcatctttcgttttgacctgagggtcttgacgatatatttcaggtaatttctggntgntataacctgatcctgaa

SEQ ID NO: 16024 - DNA, 813 bp, Diabrotica virgifera
  misc_feature (51)..(73): n is a, c, g, or t
  misc_feature (106)..(139): n is a, c, g, or t
  misc_feature (185)..(205): n is a, c, g, or t
  misc_feature (239)..(264): n is a, c, g, or t
  misc_feature (335)..(353): n is a, c, g, or t
  misc_feature (383)..(430): n is a, c, g, or t
  misc_feature (438)..(452): n is a, c, g, or t
  misc_feature (454)..(477): n is a, c, g, or t
  misc_feature (494)..(516): n is a, c, g, or t
  misc_feature (701)..(724): n is a, c, g, or t
  misc_feature (757)..(775): n is a, c, g, or t
  misc_feature (778)..(790): n is a, c, g, or t
gtagcaaattgaattaaatatatgatttatagtaaatagtactgtgaaggnnnnnnnnnnnnnnnnnnnnnnntagctaatttgggcttaccttttgtatcagggnnnnnnnnnnnnnnnnnnnnnnnnnnnnnnnnnnccgaaattttaagatatataataaaattacatttaatgttttaagnnnnnnnnnnnnnnnnnnnnngtgaatatattttattcaattaaaaatatctggnnnnnnnnnnnnnnnnnnnnnnnnnngattattttaagtgaaatattatattttgttataatcttcaattttctaggataagctagattatttttcnnnnnnnnnnnnnnnnnnngaatttaaggtaggtttaataatatccatnnnnnnnnnnnnnnnnnnnnnnnnnnnnnnnnnnnnnnnnnnnnnnnngttttagnnnnnnnnnnnnnnncnnnnnnnnnnnnnnnnnnnnnnnnaattatgataaaattannnnnnnnnnnnnnnnnnnnnnngtaattcggcaaatgttattttcgcctgtttaacaaaaacatggtcttttgtttatataaaagatctaacctgccctatgatttattttaaatggctgcagtattttgactgtacaaaggtagcataatcatttgtcttttaattgaaggctggtatgaatggttggatgaaaaatatactttcnnnnnnnnnnnnnnnnnnnnnnnntttttagtcaaaaggctaagattttattgtagnnnnnnnnnnnnnnnnnnnacnnnnnnnnnnnnntatataacttttttagtttttaa

SEQ ID NO: 16025 - DNA, 827 bp, Diabrotica virgifera
  misc_feature (4)..(588): n is a, c, g, or t
  misc_feature (590)..(661): n is a, c, g, or t
  misc_feature (663)..(696): n is a, c, g, or t
  misc_feature (698)..(826): n is a, c, g, or t
cccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 16026 - DNA, 691 bp, Diabrotica virgifera
  misc_feature (2)..(675): n is a, c, g, or t
  misc_feature (688)..(688): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcttanatt

SEQ ID NO: 16027 - DNA, 901 bp, Diabrotica virgifera
  misc_feature (155)..(174): n is a, c, g, or t
  misc_feature (535)..(600): n is a, c, g, or t
  misc_feature (792)..(792): n is a, c, g, or t
  misc_feature (824)..(824): n is a, c, g, or t
accgttcaaggagtacaacttactactacaaacgttatgaatgtgtttaaaaaactcaccgccgccgcgaagatcaattccttgtttcttgtataatacgacattgtcgagtaacagtcgatacaattcgcatgattaagtaatgtggttatcannnnnnnnnnnnnnnnnnnntgaaagatatgtccaaagactctcgatatacgccagtgaatacaaatccagataaaaatccaacatggtggaagcgacgtacaagtatggagaggtgtctaaccttatcaacgggtattgcccttcttattggaatctccttactcatagcacttgccacagtattatatagcagagatcaacatgttagtaataaaccgtacacagcccaaccactacaaggaaaaatagtcacaattacatcccaagatcacgaagatgaaaaagtatgtttaagtccaggatgcattcatactgcatcacgtgtattggaatatatggatgaatcggttgacccttgcgatgatttttatcaatttannnnnnnnnnnnnnnnnnnnnnnnnnnnnnnnnnnnnnnnnnnnnnnnnnnnnnnnnnnnnnnnnntaattggtgatgaacttcaagagcaattgagaactatgatcgaggaaccgatccaagaagatgaaccaaaaccattcaagcttactaagaaattatacaaggcatgtatgaataaaactttgattgaagaggatggaatgaccactattacagaagtgctgaaggagttgggtggttggcctgttttagaangagattcttggaaatgagatgattttgattgnaaaaactctgtatataaatttcgaaaagtgggttatggcgtggattattttattgattttttctgttgtggagatgt

SEQ ID NO: 16028 - DNA, 526 bp, Diabrotica virgifera
  misc_feature (152)..(164): n is a, c, g, or t
  misc_feature (166)..(179): n is a, c, g, or t
  misc_feature (182)..(207): n is a, c, g, or t
  misc_feature (220)..(269): n is a, c, g, or t
  misc_feature (293)..(314): n is a, c, g, or t
  misc_feature (323)..(495): n is a, c, g, or t
  misc_feature (511)..(511): n is a, c, g, or t
catctcaaaattctaattctttcaaatcaaataatctcaggattcaaataattcttcatcatctttcaaaatatcggttatctaatcttcatcctctctcatcattatccatctttctctctttctcatcaaattttttctctaaaatatcnnnnnnnnnnnnncnnnnnnnnnnnnnncgnnnnnnnnnnnnnnnnnnnnnnnnnncgtatcatcttannnnnnnnnnnnnnnnnnnnnnnnnnnnnnnnnnnnnnnnnnnnnnnnnncgtttataaaaacacgtcttttcnnnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagtttcataanatattaataagtttt

SEQ ID NO: 16029 - DNA, 778 bp, Diabrotica virgifera
  misc_feature (2)..(731): n is a, c, g, or t
  misc_feature (734)..(772): n is a, c, g, or t
  misc_feature (777)..(777): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnnnnnnnnnnnnnnnnnnnnnnnataana

SEQ ID NO: 16030 - DNA, 926 bp, Diabrotica virgifera
  misc_feature (742)..(742): n is a, c, g, or t
  misc_feature (849)..(849): n is a, c, g, or t
  misc_feature (857)..(857): n is a, c, g, or t
  misc_feature (860)..(860): n is a, c, g, or t
  misc_feature (875)..(875): n is a, c, g, or t
atttccaatataatccataatctaattaatgtaaaatgtgtgctaatttaataaaccgaaatgctgcaagttatatatacgaaaggtcatgtttttaagtaaagaatggtttttacctttgtacacaatttgtgtaacattttttgggcttttgctttacctttcatatcacacagacatcttctgtttaagttgtgatgaaacagataattccaacatcgttttcgattatatcgtagttggttgtggatctgctggtgctattgcagcaagaagacttgcagaaaatacgaagataaaagttctagttctggaagctggaaaacatggaaattttttgctcgatgtacctgtatttggtttattattacaacaatcggcctatgattggcaatatcaaagcattccccaaacaaatagctgctttggattgcaaaataatgtaagtatgtggccaatgggtaaaataatgggaggaacaggtatgcttaacaacatgatttatgtaagaggatatcctgaagactttaatcattggttcaaagataaagaaggatatgaatttttcaaagatattttaccttactttaagcgcttagaagagtgggactataaaggtaaaactactgcctcaacttatgttagtaacttaacttttaccacaaagttagctgattcaatattaaatgcagccaaagaattaggttacccattattagatgagactgaaaattgtataaanaggttttggtttaccaaagataaatgtaaagaatggccaaagatggacaccagcacacactctattagaacaaaaaatgacaaatattattctaagaactaatagangtgttcanaanatattacttcatgancattttgaagcatatggtgttaatacgctttataagggtcagagtacgtag

SEQ ID NO: 16031 - DNA, 200 bp, Diabrotica virgifera
  misc_feature (7)..(44): n is a, c, g, or t
  misc_feature (61)..(61): n is a, c, g, or t
  misc_feature (64)..(77): n is a, c, g, or t
  misc_feature (79)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttgnatnnnnnnnnnnnnnngnnnnnnnnnnnnnnnnnnnnnnnntgttcgannnnnnnnnnnnnnnnnnnnnnnagtttaaaccggtgtgagcccagttggttnnnnnnnnnnnnnnnnnnnnnnnnnnnnnnnngaaagga

SEQ ID NO: 16032 - DNA, 958 bp, Diabrotica virgifera
  misc_feature (734)..(734): n is a, c, g, or t
aaatcatctcaagatagtaggtgccaaagtaattgctgtaagactgtgcggtttaatagaactgctccagcttcaaacctacaatcaaggtaggccaatagactggaattttacttgtgcgtataggagaatgcacgtgagaactgcttctgctgggtctatttctgagcaggacctcaaaaaaccgggaaataacgaagacgatttgcgtgttattaaaattcattcttcaaaagcccatcagcagcctatcacatgcctagactgcgaaggagggagaatattgactggtagtcaggatcacacgctaaaggttcttaggttagaagatggcaatcctgtgtacacattgcatggccattgtggaccaattacctgtttatttattgacagagtgaatccagcgacttcaggtagtggttcacaagatgggatgttgtgtgtttgggatttattgacaggggcatgtatgtacagcattcaagctcatgatggaagtataacttcgttgacatactcggagagttacgtaatatctctgggtacagacgaacggctttgtgtatgggaacgtttccaaggccacttgctcaacaccattcatgtttcccagacattttccagccaagttttgatgttagcgcaacatttggtagttacagcgagaagcggaggtttgatcatttgggatgtccgaacgggcgattgtgttaggacgataacgttaggaaggngtccgttcgtctttataaatcaactagtgttactgagagacgcagtgttgtgcgattatggaaaacagttaatgatcgttagatttccattgatgacacataagtttgattaatctagatatattttatctaagatgtagattgcagaaatattacttttcatcaaagacttttatagtttataatttttataactttagttttatagttacttttttatagtc

SEQ ID NO: 16033 - DNA, 926 bp, Diabrotica virgifera
  misc_feature (554)..(568): n is a, c, g, or t
  misc_feature (582)..(599): n is a, c, g, or t
  misc_feature (770)..(770): n is a, c, g, or t
  misc_feature (789)..(789): n is a, c, g, or t
  misc_feature (842)..(842): n is a, c, g, or t
  misc_feature (905)..(905): n is a, c, g, or t
aagagtttgtgtgattataaacacataaatagtatatactgttaatgttgttttttatctgttctgttttatttaatgaatgttgtttttatattattattctcaattattaaatcttcataattgttgcgctatacaacaccctgtagattttagtgtagtctaaaaacgatcatggaaactgatgaagaagttgaagatggtgtttttactttaataacaaatctttgtgaacaattttatactagtcaaaatgatataaagtcggctagaaccaaatgctatgaaattttattgaagaaacgtttcacagatagtaagaaagattgcaaggatgataccatagtaagagactcttactgcaacttcctaacttgggagtttaagctaatacatgagtttgatatgaaagatcatgcacatgaattgaaatcatgtgtagacaatctacatcagtctttaaaagaagatcaagagtattttaatagaatacttacatttcttatggaattaaaaaacatacctagaaagaataaagatttattggatctctnnnnnnnnnnnnnnnttaaagaatttgannnnnnnnnnnnnnnnnnccagttacctgactcttttaaagaagtttttaatgcagaggaaaacttgaataccatagagtcctaccaaaacgtaacccacaatgaaatctctaaagatgataacaccttaataccaaacaccaaatttagtgagattttcaaagatgaaggttatcattctcctcctanaagtccagagaacatttgngaacttgcttcaaaattgaaatataatagaagaaaaacatgggagaattttgnataccctgaacctgataaagagttgccatttttatctgaactcggtccactatcttcattatngggtgaaaatttagatctcta

SEQ ID NO: 16034 - DNA, 75 bp, Diabrotica virgifera
  misc_feature (4)..(4): n is a, c, g, or t
  misc_feature (12)..(12): n is a, c, g, or t
  misc_feature (17)..(17): n is a, c, g, or t
tttnttgatccnatttnttttgatataagaataattaccttagggatacagcgtatttttatggagagtcaatcg

SEQ ID NO: 16035 - DNA, 133 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (116)..(117): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgacctttannattttacatgatctga

SEQ ID NO: 16036 - DNA, 869 bp, Diabrotica virgifera
  misc_feature (61)..(77): n is a, c, g, or t
  misc_feature (79)..(104): n is a, c, g, or t
  misc_feature (110)..(157): n is a, c, g, or t
  misc_feature (159)..(171): n is a, c, g, or t
  misc_feature (186)..(200): n is a, c, g, or t
  misc_feature (203)..(215): n is a, c, g, or t
  misc_feature (268)..(288): n is a, c, g, or t
  misc_feature (425)..(443): n is a, c, g, or t
  misc_feature (445)..(466): n is a, c, g, or t
  misc_feature (697)..(697): n is a, c, g, or t
  misc_feature (725)..(741): n is a, c, g, or t
  misc_feature (744)..(791): n is a, c, g, or t
  misc_feature (794)..(820): n is a, c, g, or t
  misc_feature (828)..(855): n is a, c, g, or t
  misc_feature (863)..(863): n is a, c, g, or t
atcgttatttattttcaaataataaaatatcttttagtacaagtaaagaagaattttatgnnnnnnnnnnnnnnnnngnnnnnnnnnnnnnnnnnnnnnnnnnnaacagnnnnnnnnnnnnnnnnnnnnnnnnnnnnnnnnnnnnnnnnnnnnnnnncnnnnnnnnnnnnnctttcgaatctacgnnnnnnnnnnnnnnntgnnnnnnnnnnnnngatagatatcccatataatctttttgtaatggaatgacattcgtatttatacnnnnnnnnnnnnnnnnnnnnngaattaaacttatttattaacaatacacttataattaaatatctttatattattactattaaacagctttagggatgagcttaacaataaaagtctactcaaatttaatctttaactaaaaactaagattaacaaannnnnnnnnnnnnnnnnnngnnnnnnnnnnnnnnnnnnnnnngtaatattattttctagaaattttgtattaacatataaatctaaattacttaaacttcctaatgaccgtcataatagtagtaaaaaactgtatatttagtaaaatacatctgtataatgaatgaattcggcaactccttttcacctgcttattaaaactggtcttcttgcataacatgacgactcgcctgcccctggtaactgggcccccccccgattttgccccgctaangagctaatcctaagttttttatggaaannnnnnnnnnnnnnnnntgnnnnnnnnnnnnnnnnnnnnnnnnnnnnnnnnnnnnnnnnnnnnnnnnagnnnnnnnnnnnnnnnnnnnnnnnnnnntatagagnnnnnnnnnnnnnnnnnnnnnnnnnnnnataaattnattata

SEQ ID NO: 16037 - DNA, 628 bp, Diabrotica virgifera
  misc_feature (2)..(116): n is a, c, g, or t
  misc_feature (125)..(488): n is a, c, g, or t
  misc_feature (490)..(535): n is a, c, g, or t
  misc_feature (544)..(614): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnctggaatggaaggg

SEQ ID NO: 16038 - DNA, 474 bp, Diabrotica virgifera
  misc_feature (160)..(173): n is a, c, g, or t
  misc_feature (175)..(187): n is a, c, g, or t
  misc_feature (211)..(257): n is a, c, g, or t
  misc_feature (285)..(306): n is a, c, g, or t
  misc_feature (315)..(464): n is a, c, g, or t
catctcaaaatttcaattcttctcaaatcaaaaattcaaggattcaaataattcttcatctctttcaaaatatcggttatccatcttcatccctctcacatctctccacttctctcttttcatcaaattttttctctaaaatatcaaatttaaattctcnnnnnnnnnnnnnncnnnnnnnnnnnnntctaaaaaattcgtatcatcttannnnnnnnnnnnnnnnnnnnnnnnnnnnnnnnnnnnnnnnnnnnnnncacccgttattaaaaacacgtcttttcnnnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttttca

SEQ ID NO: 16039 - DNA, 681 bp, Diabrotica virgifera
  misc_feature (2)..(110): n is a, c, g, or t
  misc_feature (121)..(309): n is a, c, g, or t
  misc_feature (315)..(394): n is a, c, g, or t
  misc_feature (493)..(515): n is a, c, g, or t
  misc_feature (555)..(555): n is a, c, g, or t
  misc_feature (578)..(595): n is a, c, g, or t
  misc_feature (626)..(641): n is a, c, g, or t
  misc_feature (643)..(678): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggnnnnnnnnnnnnnnnnnnnnnnnnnnnnnnnnnnnnnnnnnnnnnnnnnnnnnnnnnnnnnnnnnnnnnnnnnnnnnnnngtgatgatgataatattaggatttaaaaattgtatatttatgtaaaatatatagggttaataaagggaatcgcgcacatttttttcacctgtgtatttnnnnnnnnnnnnnnnnnnnnnnntataaaagtctcggctggccactgagtaatttgaatgggncgcgcgtattttgagcgtgcgtnnnnnnnnnnnnnnnnnngtttttttaatggaaggtgggatggaagggnnnnnnnnnnnnnnnngnnnnnnnnnnnnnnnnnnnnnnnnnnnnnnnnnnnngtt

SEQ ID NO: 16040 - DNA, 556 bp, Diabrotica virgifera
  misc_feature (2)..(37): n is a, c, g, or t
  misc_feature (50)..(72): n is a, c, g, or t
  misc_feature (267)..(287): n is a, c, g, or t
gnnnnnnnnnnnnnnnnnnnnnnnnnnnnnnnnnnnnggtcctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgtaatccctaaggtaatttattgttataatgnnnnnnnnnnnnnnnnnnnnnaacggtctaatgcgtcagatcggaattgaaagagcacgtgaagccgtagcagtctgtagaatgcccgagatgaaaggttgcataactagaaaagactatgaaacgattaaaaaagccagataaggaattatgtgattcctatgagtgaaccacgctctaggttgaccagatcgcgaacaagctggcgtatgtgaatgacgagaatagagaacgccatatgtacacagactgtacgagacaaactgacataaacctgtctgggaaaaggc

SEQ ID NO: 16041 - DNA, 921 bp, Diabrotica virgifera
  misc_feature (494)..(520): n is a, c, g, or t
  misc_feature (845)..(845): n is a, c, g, or t
  misc_feature (862)..(862): n is a, c, g, or t
  misc_feature (873)..(874): n is a, c, g, or t
attacttgctagtattcattaataagctacagtctaaaactatattttctttggttcaaatcaatatttgctcacttcactaatgaaaaaatcaataaataatacattaaagtatacaatttcttcaatatacaacaactattatagtatgatgctcgtgaaaggagcttaaacaccatatttcttttctacaaaaacaggaaacacaaaaagtgttttttaatcattattgtctatatatttaatactttctgaaagtaaaattatatgtacattcaactgaaatagtattttttcgatatgtttgtatagcatccactggatgcgtcacagatagcaattttacaattacaattacattaattataataattagtatagttgactgtaataggaatatttttaatgttgaaaattcatttgtataaaaaccaaattgttttagtagaattttttaaatacataatacgaaaagtgcatctttttgtctatgnnnnnnnnnnnnnnnnnnnnnnnnnnnacaatattggcaataaattagacaaagaatatatttctataaataatatttaatcatatttttgagatatttaaaccatatgtcaacaaaaaaagtattaaaacccaaagaaataatgaggatttgtacagaaaaatttattgggattcccctgtactcaaatggccatccgaatcataagcaaaattttgtttatattttcctatacaatactcaagttaaactgcatttgaagatttgaagctggatttaaaagtgaggttgacaaggttttatattttctcgatactactatatggaatggacgcttggaccctgatcgtgncgacaataagaaactgnaagtatataanntatggatataccggagaatctgaaatatcatgaactgattatgtaaa

SEQ ID NO: 16042 - DNA, 554 bp, Diabrotica virgifera
  misc_feature (2)..(16): n is a, c, g, or t
  misc_feature (19)..(61): n is a, c, g, or t
  misc_feature (69)..(181): n is a, c, g, or t
  misc_feature (190)..(553): n is a, c, g, or t
cnnnnnnnnnnnnnnnccnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 16043 - DNA, 491 bp, Diabrotica virgifera
  misc_feature (2)..(293): n is a, c, g, or t
  misc_feature (300)..(337): n is a, c, g, or t
  misc_feature (357)..(370): n is a, c, g, or t
  misc_feature (373)..(395): n is a, c, g, or t
  misc_feature (403)..(425): n is a, c, g, or t
  misc_feature (436)..(436): n is a, c, g, or t
  misc_feature (454)..(483): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntggtcgannnnnnnnnnnnnnnnnnnnnnnagtttaaccgntgtgagcccaggtggtgnnnnnnnnnnnnnnnnnnnnnnnnnnnnnngaaaggac

SEQ ID NO: 16044 - DNA, 344 bp, Diabrotica virgifera
  misc_feature (231)..(256): n is a, c, g, or t
ctgcctttaaggggccggatatgttttcgagtttttctattttactttaaagagtatgaaatgtttgttatttaataatatatgaaaagaattgagtttaggaaagaattagtttgtttcccctaatattattaattagtgttagtaaaaatgaattatatggttagaatttaggaagtgaagaagagaagaaggtaaaggaatgtattaaaataaaaatgtaaggatagnnnnnnnnnnnnnnnnnnnnnnnnnngataaaaaatagaataaatatttgaaaaaagatatgaattatatttgtagaaaatgtttatatgttgaaatagaatgtaataattaag

SEQ ID NO: 16045 - DNA, 698 bp, Diabrotica virgifera
  misc_feature (17)..(17): n is a, c, g, or t
  misc_feature (59)..(59): n is a, c, g, or t
  misc_feature (80)..(101): n is a, c, g, or t
gccactagagggccgangaaagaaagaaaaacataaatatacccctttgaggaaggaangagaaagaagagaaaagaggnnnnnnnnnnnnnnnnnnnnnngagaaggaagagaattcttttatggagtatcttgaacttctgatattaataagttagagttatatactttgtaaactgaattctgatatcgtaaaatgttgtatgatgtttaggaatgttactcataaatattcctgaatttagaggagagcatggtgtggagtatatgaatgatctaaatcaaatggaagtccttactgaaatgtcagtatgttagatagtcactacaactccataataaataataggacttgcccacttttacatgaccatcctactgcagctcattttaacttctaactaactttccgtcgaataactaaacattattacagtgcaaagatgcatacaatcaattcggatgtatatatctcaatgcggaattatctgcatataagcatagctacacatctttatcaatcagcagatactgtgtagttatcgatgaatattttttccattccgtagtatatcattagataatattgcaccttttcctatgtcgataaccaggtgcctagtatgcactaatagatgtcgattgacttacaaagtttcctttgcgtcatacatacgctaaggagactacttcagcga

SEQ ID NO: 16046 - DNA, 418 bp, Diabrotica virgifera
  misc_feature (19)..(19): n is a, c, g, or t
  misc_feature (28)..(28): n is a, c, g, or t
tcttttaaggggccgcggntggctcggngatatagacagaaccctttaaaatgagcggaagaaaggggaacacgaggacacagcgaatatattcacagcagcgccatcacagtgtcccttcttattgggtttgttcctacaagcagccaaaccagacggaaactatcagagaatagacgaccagccgagtagaggaaacgaggggataacactgatgattttattaatgttctctcactgatcaactatttgctgatgaattatgactagtttgactgttacttgcaacagacctattatatccacttcttacgattggctaagcaagatatacgtctatttctttggaatctcttgccctatatcttgacttgtagaatcatttgatatatatctaaatttactattactcatattg

SEQ ID NO: 16047 - DNA, 475 bp, Diabrotica virgifera
  misc_feature (4)..(23): n is a, c, g, or t
  misc_feature (28)..(53): n is a, c, g, or t
  misc_feature (63)..(112): n is a, c, g, or t
  misc_feature (127)..(179): n is a, c, g, or t
aagnnnnnnnnnnnnnnnnnnnncatcnnnnnnnnnnnnnnnnnnnnnnnnnnatgtaattgnnnnnnnnnnnnnnnnnnnnnnnnnnnnnnnnnnnnnnnnnnnnnnnnnnctagattgaatatcnnnnnnnnnnnnnnnnnnnnnnnnnnnnnnnnnnnnnnnnnnnnnnnnnnnnngagaagaatatacaggagccgatttatttacaaagctattattcagtaatagatggaatatttgtttgaaaaattaggctcttccgactttgtatgcaaaacagttgtctaaaaaccttaattattgaataaggctgcggtgaatgttgtataggtaactaatgactatgtcttataactgtacaaaatgtgttttgtgctgcgtcacactggcaatcattgtctcgtgctagaacggaaaacaacgtactgatcggcatctaaagggacacccaaaggcgcactccgtccgacgt

SEQ ID NO: 16048 - DNA, 914 bp, Diabrotica virgifera
  misc_feature (2)..(29): n is a, c, g, or t
  misc_feature (31)..(46): n is a, c, g, or t
  misc_feature (48)..(816): n is a, c, g, or t
  misc_feature (818)..(890): n is a, c, g, or t
  misc_feature (897)..(912): n is a, c, g, or t
cnnnnnnnnnnnnnnnnnnnnnnnnnnnncnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnngggggannnnnnnnnnnnnnnntt

SEQ ID NO: 16049 - DNA, 767 bp, Diabrotica virgifera
aaaactgtggttccccaaaagtccaggttaaacttgagttgaactcgacatgagaaatcggccctataagtctggtaaccagacacctaggctaataattaacaatatggagttaaaaggtgtggacgacacatttacatgccaggttcgttactgactaagaacaacgtcagcgaaaaaatcaaaaggagaatggtccttgccaataagagtgactatagcctgagaagacaagtggactcaaaacttccaagaaaaattaaactgatgtaaaaaaacaataataagaccagttttaacatacagagatcaaacgtggtcactacacagaatggccaagagctgcaagtgtttcatacgagaatatatgtgggaatataagattataagaagaatattggggactaaaagagcaggttttagggcgtaaacgccacagagttatatagaagctttcgggaagctaatgttgtaaaatttattaaggtagcacactttagatggagggagagaggtgcgacggtgagaaaagtatgtgactgaagaagaccagtggggcgaaatactagaggtagaccgaaacttaggtacctatacaacttgggagacttccagaaagaaaggatcgagaaaagttgctagatctatacaggatggaatgcggtatgagggaacgttctaaagaaaggctttggctcatagagagctgtggttccaatgacgatgatgattcacttctaatgataaagttcccattttttttttgt

SEQ ID NO: 16050 - DNA, 982 bp, Diabrotica virgifera
  misc_feature (151)..(173): n is a, c, g, or t
  misc_feature (385)..(410): n is a, c, g, or t
  misc_feature (885)..(885): n is a, c, g, or t
ccacagacgactggtttcaattgctataatttactaagtagcatcaggtctccggtacggcaaaataaatgctgaaattacaatagccagtatttagggtactgcctggtacaaaatatacagtattatgtccctgtgtatccatatggannnnnnnnnnnnnnnnnnnnnnncgaaaaaaagttattctccataaaatgctctgcttggtccaaaacctaagatttaaccatcaaatatcaaattttttcaatatacgaggtatgtcaaaaagtttgaatttcactcaaggtagctttatttttcacaatattgaaaattgctgttatgaaaagttgttgggaattaaaaactatattccagtatgcaattacatccttctacnnnnnnnnnnnnnnnnnnnnnnnnnnttatgcataacattattttcagttctttcaattcagtttattaataattttgcgaaaagaggtgattctcaataaaaggttctgcatggtctgaaacctaaaatacagccatcttatgtcaaattttatctattttatacgaggtatgtccaaaaatatgaattttgctcaagagtaaaatacgtttatttttcacaatatatattgaaaattgttattatgaaaattatttagaattaaaaactatgttccagtatgtaattacatccttctaattgaaatattctgaactataaaggtactttacttttgatataaatttatcttttttgacatacctcgtataaaattgattaaatttgatataggatggttgtagtttgggtttcagaccatccagaactttttattgataatcacttttttcgtaatttattaatgaaagagttatcagaattgaaaaattaatcataanaacgttttccatatgggatacacttacagggacatactgtataacactttatgcagtattaaatgtctaaagttttaatggtatacatgtacatgtt

SEQ ID NO: 16051 - DNA, 75 bp, Diabrotica virgifera
  misc_feature (51)..(65): n is a, c, g, or t
gcgcccgtcgtgatcgctgatctagtctattctttttgaagtatgtgatannnnnnnnnnnnnnnaaatcttaga

SEQ ID NO: 16052 - DNA, 595 bp, Diabrotica virgifera
  misc_feature (416)..(433): n is a, c, g, or t
  misc_feature (568)..(587): n is a, c, g, or t
cggccccttcgcgcccgcgcctcggataccccaaaagacagacccttttcgggcagcaccgcagaagagaaaacaaggacagcagacagggaacgggaaacaaaagccgagagagaacattttaaaaccaagacgacccgagcgcaccgctcgcacgccgggaaccaggaagcataaaacaataattatcgaatcaacaagagcgaaccgaacctagccaataacggagaatatagactgagaaaacaagatcccacacgacttgctagaaaaagccaaagtgaagcaaagatccagctaccaaaacagctttcaattatgcgatcgacacgggctcacccccaagtgtgcacacgagcagccggagacttcccaacacgagatatgtgcgaagctcaacgcaaaaaacctaaatnnnnnnnnnnnnnnnnnngaaaaaaagaggcagaacctcagcgtactcaacaagaacacggacacccaccgacccacacctatcaacacgaccaccctccaaacccgcccaccacagcagcacccccccgaccccccagcacacgccgcgcannnnnnnnnnnnnnnnnnnncacccgcc

SEQ ID NO: 16053 - DNA, 468 bp, Diabrotica virgifera
  misc_feature (92)..(92): n is a, c, g, or t
cccgaacccaaaagaggccaaaacaaccaaaagagccaaccgcaaaaaaaaaacgccaaacaacccccccgcaaggaaaggccacccgcgcncaaacacaccgaaccgcgcaagaaacaaaccaaacccacccaccaccaacacacccacaaccaaagacccccacaccaacaacaccaaacacgcccagggacgagcccaaaaacaaaaccccaccacaacgcaaccgccaaacaagaaccaggaccaaaaaccgccacaccccaaaacaagacagcacccaccgccacacacgaccacccccaccccccagaaacccagcacgaaaacacaaacccaaacgacgccaagccaggaacgcacgacaacacccgcccgccccaaccgcacaggcaggcccccgcccccccgcccacgacagcccccccgcccacacacaccccccccgcccaccaaaaacaccgcccc

SEQ ID NO: 16054 - DNA, 943 bp, Diabrotica virgifera
  misc_feature (773)..(791): n is a, c, g, or t
caaaaatgtgatttccataaactttaattataatctacgcagttattaatcaaaattcggagttggcgcaattatatatatcgactcgtaattttgagacgaatctaatgtaaaatttgttgagtttgagtgacattatattttccataagatgtgtgtggtgtcctttgtgaagatttttttacaaatacattaaaacagagacacaacaagccaaatgctttgaaagctgcttttccctaaattatcaatttaaataaaatgatttccaaatacctttacttgtgaatatattcttcctggttgtcgtcacatgttttcattcaaatgatggtaactaccgaaaagttgaaatacactcaaagcctttacaaaacattcttaaaaactgccattttggacgtttatttatgtttacgttccaatttacacgtttcatccatttaataccaaaacttttgtagatttttgccacacgcgtacgttgtgacagatttaataattgcgacaatcatttttgtaataaaattgtttttacgtaattttccacgtgacttttactaaatggcggtctgtactctttataaaaaactatgagtagaaaaatcatactgtatactgtggtgctatccacccaaaaaatagctgaaaaacaatattatagatctaacagtttcgttcaaagtattttataaatgtgtatattgtaaattgtgtacatagaagaataatttaaattaaataacattattaagtttgtaaaatattgaagnnnnnnnnnnnnnnnnnnngttaagaaagccggctgttgtaaaaaaaaactgttgttgaaagagctcattcccacccccctgttcgaaataaatagggggaacaaggagtcctcccaaaggttaaataagtggcacaaggctaaacccattcctccagaatctggacaaat

SEQ ID NO: 16055 - DNA, 349 bp, Diabrotica virgifera
  misc_feature (157)..(269): n is a, c, g, or t
tcttgcctcaaacaatactgtaattattagtaagtcatgtttgaggcaagaataacaaaggacagtattgttcagacagaaaaatctaaattcttagtattaggattgtgtaacaatattttataccaaattttgaattaaaataaaattgttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcaaaagaaccaaggtttacgaccgggggttgggaacgcataattttttttaaagggcccccaaatttcatttcctg

SEQ ID NO: 16056 - DNA, 398 bp, Diabrotica virgifera
  misc_feature (356)..(375): n is a, c, g, or t
cccatttttattgagaaaattgttcagaacttttctgagaagtagtcgaaaaattcattgtttaataccctatattttgcgctaagagaaaagataatggttaaaaatgaactatttaattgcactgaggcttgagttccggacaagaaaatgaaggagtccttggataatcaatgcctgacagataccacctcaaatcataccaagtttaattaggaatgctccacgtccaaaaatactgtcaaatgacttggtagaaattgtttagactccattagatgagtataacagaatacctcagatagaaggttagtactgggagatctccggattttgcgacgtatctattatacgtnnnnnnnnnnnnnnnnnnnnaatgtttattctaatactgactc

SEQ ID NO: 16057 - DNA, 913 bp, Diabrotica virgifera
  misc_feature (822)..(822): n is a, c, g, or t
  misc_feature (911)..(911): n is a, c, g, or t
aagttttgtgaattataaaacgagaagaagtaaatttttacattgttttggtctacatttacgcttttaacacgtacagggaggctgaggtcaacatcggaaaaatggatttttatttttacattccgtttgcgattgcgatattatatttaatatatggaatactcaaacacaaatcatacgttggtatttccgcaaaaacgcagttactgtacactttagcggttgttgcagttggtgacatttccctattatacctattattgatagtacttccctcaattgtggccctgactttagtttttaagatgagagatacttatgaaaaggaagccgacagtttgggcagaaattctacttacagcagctttcattttatccattttcctttttcctgatttcttctccttctctgaaaagatggacgtctcctttgggatactatctgattttggcggttacctagaatctgtggcctttattcctcagctatatatgatctggaacagcaaaaaactacgaaacacatgaaagtatatatctactttttattcttgtataagttactgaacctattatggttaatatatttatactggttcagttgttgtgaatacagaataagatattcggtagttgtgattcttagtttcttaatcctgtccgttgctgtactaactgtacgctctaaaaggattatattacactgccaagaagaaaagatggatacaaaagctcaaaatatctgcgtcgtcacttctggactagcaccacccattacaattcccaaacctaatgcggttcctgatgccgcagatgaangtattaagccatcgttggtatatatgtaaatttagtgtttatacaattttgtacttacatactaaataaaagtaaagactgcgaatggntg

SEQ ID NO: 16058 - DNA, 821 bp, Diabrotica virgifera
  misc_feature (538)..(584): n is a, c, g, or t
  misc_feature (627)..(627): n is a, c, g, or t
aaaaaagccttataggcacccgtacataaaaagtacaaaataaaatgttattttaaaagtcaaaggagtgaacacagctgtaccgagatgactcaatgggcgaagaagtacttgcaggattattggataaaacacgtgctgttaatactagcaatgtaactatacctgaccaggacatgtccactccaaatatttttactgaagaagaggaggacgatgtttatttacgtagaacaatgaacatttttactttaacagaaaaaattggtgcattacctatggaattgttaaacagcatggagaaaaaagacaagaaaacctttgttgatgaaataaagaaattcaaaatttatcgaccagatcctgccgatcctgaaaatcttcaaaaagggtttatcgatatggaaaaacttagtacgttcaaaaatgcacttaagtcatattcaagataactgaatgaacttaatttatattcaatataataatatagtttaataattctgtacatctaggtatcgttaagttgtcgtataggagnnnnnnnnnnnnnnnnnnnnnnnnnnnnnnnnnnnnnnnnnnnnnnngttaataatagaccgtgatagtcgtgacgtcaaaacgtaaaanaaagttttccagacacgttgtgtctagctacacgttgaaatgtacgcaaataaaaaagttaaacttcatcaagctagtgactatttagcgtgggcagtgactggatatttttgtaccccgtatcttgatatgttaggggttggttgaaaaaaacatatttgctatgcccattcaattccactaattttttttta

SEQ ID NO: 16059 - DNA, 784 bp, Diabrotica virgifera
  misc_feature (23)..(66): n is a, c, g, or t
  misc_feature (80)..(111): n is a, c, g, or t
  misc_feature (121)..(164): n is a, c, g, or t
  misc_feature (192)..(218): n is a, c, g, or t
  misc_feature (281)..(299): n is a, c, g, or t
  misc_feature (321)..(353): n is a, c, g, or t
  misc_feature (368)..(398): n is a, c, g, or t
  misc_feature (431)..(445): n is a, c, g, or t
  misc_feature (447)..(464): n is a, c, g, or t
gagaaaggaaagaaggagagagnnnnnnnnnnnnnnnnnnnnnnnnnnnnnnnnnnnnnnnnnnnncaagggtaaaaggnnnnnnnnnnnnnnnnnnnnnnnnnnnnnnnnggcgaatgtnnnnnnnnnnnnnnnnnnnnnnnnnnnnnnnnnnnnnnnnnnnntgaaagaagtgaaaggtaaagaaacgtnnnnnnnnnnnnnnnnnnnnnnnnnnngaaagaaataaaagaaagagatagaataacaatatatgtagaaataaagatttttagaatagnnnnnnnnnnnnnnnnnnngaaagagattaaaaagaaaagnnnnnnnnnnnnnnnnnnnnnnnnnnnnnnnnngattaaaaatggtcnnnnnnnnnnnnnnnnnnnnnnnnnnnnnnngataatattatgatgtaaaatacaaaaatatgnnnnnnnnnnnnnnncnnnnnnnnnnnnnnnnnngtaaagaagataagatgagcaataaaaaaaagcatagttagcaaaaaaaaataggatcaaaaaaggaaaacgggaacaaaatatggagcgggttataaaaacaagactttatgcatgaaaaaaaaaggctcgaacgacaaagaaaaaagagaaggggcgggagatattgaccgggcaaagaagaaaacgatgagatattaagagaaagaggcatggaaggaaagaatggaaaaaaaaatggccgacaaaaaccgcaaagaatagcaacaagaaaaaaaaaaggacaaaaaacactaaaaaaaaccaaaaggcctaacaag

SEQ ID NO: 16060 - DNA, 139 bp, Diabrotica virgifera
  misc_feature (2)..(43): n is a, c, g, or t
  misc_feature (45)..(63): n is a, c, g, or t
  misc_feature (89)..(107): n is a, c, g, or t
cnnnnnnnnnnnnnnnnnnnnnnnnnnnnnnnnnnnnnnnnnncnnnnnnnnnnnnnnnnnnncacgagaaaaacctattagaagttcnnnnnnnnnnnnnnnnnnngttcttttaagtcataaattttatcaaaataa

SEQ ID NO: 16061 - DNA, 142 bp, Diabrotica virgifera
  misc_feature (2)..(15): n is a, c, g, or t
  misc_feature (17)..(56): n is a, c, g, or t
cnnnnnnnnnnnnnntnnnnnnnnnnnnnnnnnnnnnnnnnnnnnnnnnnnnnnnngcgaaaggaccgctgcgagtgaccacacatctgttttaactaccttataatatattttcaactattcagcccccacctccaacctc

SEQ ID NO: 16062 - DNA, 884 bp, Diabrotica virgifera
  misc_feature (229)..(246): n is a, c, g, or t
  misc_feature (812)..(812): n is a, c, g, or t
  misc_feature (832)..(832): n is a, c, g, or t
cctgtgttaaacggcacggaaataacattaaacctttctcgatcttttttctgcacagaaaatttgctttttgtccctgatttcttaatcatgagagccttgtatgacaacaatctcttctacttacacctggtaatcaatcgaggaacatggtataggtatactgcctctcattgtttggccaaagtagctaacttttcttaaccaccactacatcccaaatgcctcnnnnnnnnnnnnnnnnnngaccgtatcgtctatgtttcgtaactataaagcaaaataaaccacacataacatttgagtgttcttactctcgtttcagtagttaggtttatgttgatggaagtgcaggtttccattttagcctttacttatttgtcgcatgtgatttcattgtttggccaacttcacaaatatttaaagtattatactaattcaatagtatgccccaatcattattggtgtttgtgtaatacgaattttatctacggccatcaattttgtttgttagaacataatatatggatatatttcgttatcgagaagctttaccaattcagcaggaattttatctgatccgaattcattttatattgatacttcatatcaataattaatttttctctttacttattacccataataaccataaagcaaacatggagtgcaatcaatagaacaagagaatgctgtagatttttaggttttgaaatgttcagtcagttatgctcaaagctcttgttaaccacactatttaactaaaatagattccacactggaatatatgtatactgatttgtttatgattnggataaactaatgtttacgngtagttctttctcttaaaaattgcagatattaaaataagtgaatgtacagat

SEQ ID NO: 16063 - DNA, 68 bp, Diabrotica virgifera
  misc_feature (2)..(61): n is a, c, g, or t
cnnnnnnnnnnnnnnnnnnnnnnnnnnnnnnnnnnnnnnnnnnnnnnnnnnnnnnnnnnnngtacctc

SEQ ID NO: 16064 - DNA, 129 bp, Diabrotica virgifera
  misc_feature (2)..(106): n is a, c, g, or t
  misc_feature (108)..(127): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnca

SEQ ID NO: 16065 - DNA, 708 bp, Diabrotica virgifera
  misc_feature (108)..(137): n is a, c, g, or t
  misc_feature (341)..(364): n is a, c, g, or t
attcggacatatatttttcacccccaaaaggtgtgtctcccttcatgtctagaacacctaggtttgctaaccaatattcggaaggtttagattgtgatagttttccannnnnnnnnnnnnnnnnnnnnnnnnnnnnngtgtcataacttgatgtccttgtgttttgtacattttttattaatgtttgttattttcatgttcctagtttgtatgattaaattttttaaatctactgtaggttaggttataaatctcctgtgattaatgtttatactgtatatatagtgtatatatagtgattaatgtttatactgtattttaattgggtgattgcccgttgnnnnnnnnnnnnnnnnnnnnnnnnactaggttcaaaggtacataatatactgctgtgctaagcccaaaggcggtaactgcttttttatcaaaaatgagataaatgagctaataaattttattcaaaagcatcctacctatacaagattaacctctcgaatatatttttctaaattctaattgtacttttttagtgatgtcggagttattgtttgagtgttatgaagtacctgggatatcgtatggtgtcgatgctctttttttcttatcactatacccaaccagagcctttaagagatgcgttattagtaaatctaggatatcggacatgtcatattattccagtgataaacaactaccctgtttttg

SEQ ID NO: 16066 - DNA, 730 bp, Diabrotica virgifera
  misc_feature (2)..(39): n is a, c, g, or t
  misc_feature (50)..(72): n is a, c, g, or t
  misc_feature (263)..(336): n is a, c, g, or t
  misc_feature (341)..(406): n is a, c, g, or t
  misc_feature (424)..(442): n is a, c, g, or t
  misc_feature (451)..(465): n is a, c, g, or t
  misc_feature (467)..(483): n is a, c, g, or t
  misc_feature (486)..(504): n is a, c, g, or t
  misc_feature (519)..(539): n is a, c, g, or t
  misc_feature (677)..(726): n is a, c, g, or t
tnnnnnnnnnnnnnnnnnnnnnnnnnnnnnnnnnnnnnntcctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 16067 - DNA, 852 bp, Diabrotica virgifera
ccacttccattctcgttgtgatgtaaacaattatcaagacgcgacgaatattagaaagtgttggctcagtggattaccagatttagatcagattcatgattttgtccgtaaaaaaattgttgaatacttaaaccatttggtagatctgggagtcgccggatttagagtagatgctgccaaacatatgtggcccacggatctgaaagctatttatagcagcgttaaagacctgacaggacccggtttgagcggaagacctttcttctaccaagaagttatagatttaggaggagaggccgtaaggaaaactgaatacaacagctttggagcggtgctcgaattcaaatatggtgccgaattgggtaatgccttccaaggccataatgatctccactggctaaagagctggggtacagaatggggtttattagcagggactgatgcagttgcatttattgataaccatgacaatcaaagaggtggatctccagctattcttacgtacaaaagccctaagccttataaaatggccatagcttttatgttggcccatccatatggtactacgaggataatgtcaagctttgcttttgataactttgaccaaggtccacctatccaacaacctggttttaacgctgatgacacgtgtacaaatggttgggtctgcgaacatagatggcgtcaaatctacaatatggtcggcttcagaaacgctgtagctggcacaggtatcaataattggtggagcaacgggaaaaacaaaattgcttttggaagaggagataaaggttttatcgctttcactttagaaggcgacatcgatcaaaaccttcagacttctttaccggc

SEQ ID NO: 16068 - DNA, 293 bp, Diabrotica virgifera
ccttttcgggtccgctcaccttgaattcaagacatcccctcaccttaaagggcagccaagaaaaaatggagaaaagggcagaaaagaaagagggagggagaaaaaagaacaactatttttttaaaaagttagtgaccgggtcgtgagcaccggaggggaaggaaaaagaggcagagataaataatagtcgaaccgataagagctcaaacagtaaaaagtttaattggaaagaaagaacgaccaaaaatagtgtcaaaaggcatggtagtgagtttctgcacggcagagatcaa

SEQ ID NO: 16069 - DNA, 775 bp, Diabrotica virgifera
  misc_feature (633)..(667): n is a, c, g, or t
cccacgcgtgccgtaaaaccatgcctaagacaccgacgtagtccccgatgcgttacaattgtcatgaaaatagaatggacctgatagctgcaactgttctaaccaaatgtctcaaaacatgtctcacctgaattccatactgatacccatacccctacgaaagacccccaatgagatctcctatggatcggacacaagctgtcaaacaaactggcgtacaaaaatggctacacgtaaagcactgcaaagaacaacgtgaagagactcatgtacagatttatgctcgaatgtgtacacgaatgactagacgacaattacgacagactttccttgagactttcaccgaatcatctaccttgtcatctcacttgtatactcgagtttatacctccgactattgctcccgaactttttctctgacatttgcttttttatatgaccttttatttcttccaccatctcgtcctccttcttgatatcttgtatattagtatgcaatctgagattcagtctgaattggtggaaatcttgcttgaaattatacttaatacattcctattactacgtttattacttgccttcttttttgactgcatttgttaatgttatcggactgctttcatgtctgtttcnnnnnnnnnnnnnnnnnnnnnnnnnnnnnnnnnnncataaatctgtaacacattatctgtagcatactatgagttatactaatataatatcggtagttatatcagtagatatatgtattaattatgtgatatcattggtatga

SEQ ID NO: 16070 - DNA, 82 bp, Diabrotica virgifera
  misc_feature (6)..(25): n is a, c, g, or t
tcgtannnnnnnnnnnnnnnnnnnnaaagatagaaaccaccctggctcacaccggttaaactcagatcatgtaaaatttaaa

SEQ ID NO: 16071 - DNA, 906 bp, Diabrotica virgifera
  misc_feature (29)..(45): n is a, c, g, or t
  misc_feature (292)..(313): n is a, c, g, or t
  misc_feature (595)..(615): n is a, c, g, or t
  misc_feature (669)..(695): n is a, c, g, or t
ttcatttttcaactaaataaccacgtttnnnnnnnnnnnnnnnnnataactcaaaaagtgagtattttgtcgaaaaaaacgttcttagtaaaagtatagtttgtaaaaaagtgagaggaaaatggtgcatattaagtctgtagacccggtcgaaggaaggttgtagttaatgaaaagtaggttcttattcaacaaattccaaatcgaatatttcatcgagaaatggccaaggaacggaacacttttcggggaacgctcattgcaacttttttaaagtgtttagaataggttnnnnnnnnnnnnnnnnnnnnnnttctgagcattaaaagtaagttatgctcaaaatattgttggttccttttattttttggtaaaaagaatcacgaaaagcaccccctaattagcatatcaaatagaattaatcgttgccgcttcgcgggttgctttgcttatttattctttatacgatctgtgagtctcagcggttcaaagtgcttaattttaaaaaggctgttaaaatggcttgaacgagtcactaatcccgagtgtatgcaaacttcgaacagccatagcataaccaatttttgtataagannnnnnnnnnnnnnnnnnnnnattcagaaaagcaaaacgtacattttattactctttgagatttttggtgttacnnnnnnnnnnnnnnnnnnnnnnnnnnnggcatttttttcccaaaataagcacgtcgtatcgatgaaacttgcagatcgtataaacacaacataagtgaagcaacttgggaagcggtagcgattgcttctggttggagtggatattaaggaggggtttttccccaattttattggggccaaatcaaaaagaagaccaatggtttttggagcggaactttgccttacattttgtcgctac

SEQ ID NO: 16072 - DNA, 170 bp, Diabrotica virgifera
  misc_feature (2)..(129): n is a, c, g, or t
  misc_feature (135)..(163): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcggnnnnnnnnnnnnnnnnnnnnnnnnnnnnnatatttt

SEQ ID NO: 16073 - DNA, 87 bp, Diabrotica virgifera
  misc_feature (2)..(36): n is a, c, g, or t
  misc_feature (60)..(85): n is a, c, g, or t
gnnnnnnnnnnnnnnnnnnnnnnnnnnnnnnnnnnncttattaaaaagatggtttttttnnnnnnnnnnnnnnnnnnnnnnnnnncc

SEQ ID NO: 16074 - DNA, 842 bp, Diabrotica virgifera
  misc_feature (13)..(37): n is a, c, g, or t
  misc_feature (131)..(151): n is a, c, g, or t
  misc_feature (237)..(255): n is a, c, g, or t
  misc_feature (624)..(624): n is a, c, g, or t
  misc_feature (805)..(805): n is a, c, g, or t
atcgattgtaagnnnnnnnnnnnnnnnnnnnnnnnnngaaaatacgtatttagttaaaatttttcgtcaacaattattgttcagaagtcatttctttgtttcatttttcaatgtgtttgcgtgtgttttannnnnnnnnnnnnnnnnnnnngggtattgttttaatcagtggcggttggtatataagtgctgcggagctgcagaaccaccaaaataatccaaacaaaattactttgnnnnnnnnnnnnnnnnnnncactacttataaaatctaaattcatttagatggttttcgtgcatggccgcctttattttaatctgtcgtccgtcgcatctcatggcgatagcaagtcccacttatttgaccggaccggtgctactccgagctgtgaactgttaaagatatccccgataacacccgctcaaccctcgcctacacttttcaggcgacgactgaaagcaatatttgagctgcatttgtcgcagttcgaactagtgtgtagaaacctacgtttattgtaattttaaataatcggtgatcgcgacgcgacgactgttaaaataagttgtcctgcacgtaattcggtatttatattaagtatatgagaataaaagtgctgttcangatggatgttatttataatttgattaatgttaagagattctttaaatattcttatgacgaaaaactagaattaaaatgcaaaggacgtcctttgccggatattaaaatcgaaaaagaaggatcaagccgagggaaaaattacaaacgacaatttaattgcgatatttatacgagaaatagntggatatgtggctgcaacagaaaaaacgctcttttct

SEQ ID NO: 16075 - DNA, 699 bp, Diabrotica virgifera
  misc_feature (17)..(17): n is a, c, g, or t
  misc_feature (20)..(20): n is a, c, g, or t
  misc_feature (22)..(22): n is a, c, g, or t
  misc_feature (49)..(86): n is a, c, g, or t
  misc_feature (107)..(107): n is a, c, g, or t
  misc_feature (610)..(680): n is a, c, g, or t
ccatccagggggggagnagngnaagaggagaaggaaagaaatccttagnnnnnnnnnnnnnnnnnnnnnnnnnnnnnnnnnnnnnngagaaaggagaaagaggagangagaagaatctcgaaaccaacaccaaaacccccagaaagaaacaccgaacccaagaaaccgacgacaaccgcaaaaccaagaaaacccccacgaacgagagcacacgacgagacggcagccaaacaggacgagaaaagcacgacgccggcggagagaacgacgccccagaagcagaagcccacaccgacaacgccgacaccgacgagcccaacaccgaagacgaccacgtttttttttataagaacgacaagcacccccccaagaaggtggggagaccttagcgtattcggcgacttagaccccaccgacgagtttgttgtgagaacgcgtgcaagatgcggaggttacatgtaatgatacccattcaatccatgcttgaccgaacaacaatataaagaaatgcaacaaaatgttaccagcaatctctctggcgttgaaggtgaacttaaaggaacattctactcattgactggtatgagcaaagaagtacaacaaaagttgnnnnnnnnnnnnnnnnnnnnnnnnnnnnnnnnnnnnnnnnnnnnnnnnnnnnnnnnnnnnnnnnnnnnnnncctctgttcggggaatcta

SEQ ID NO: 16076 - DNA, 758 bp, Diabrotica virgifera
  misc_feature (430)..(452): n is a, c, g, or t
  misc_feature (644)..(661): n is a, c, g, or t
ggaaccgaatagcgttccgtatgtgcgtttggggcctcgccgcctgttgtttgaaatgtgaccgcgtgctgcagcgaaccagtggaaaactcctaggttccaaatacatgtacggaatgtttggatgcgtacgggagatgagcaggatgtcaagcttctcgttttttatacttatactttactgccacttcgcggatttattaatgaccgttgttggtaagttaagaatggttcgtatttcggttagcttgaacatcatttcttctaacttacatacgttattttgatttgttggctggagaggtatatattgagcatttagttaggggactgagtttacatttgtgttttgggtattttttgatttaaccagatcagaggcttgtgcatagcttacaccttgtctcacccttgatttgtcccttgttgnnnnnnnnnnnnnnnnnnnnnnngggcagcgatggggacatgaagcgtcagtaaaataatgagtttattgaatcgatatcctacgttattggtctgtgcttatttttcattttgaaggtcacgtttataatatacgtttacaactaataacatatttcatacctctcatataaattatttgcttttggtttttatatattaatcacgagttacannnnnnnnnnnnnnnnnntatgcttaatattgttaggaagtttatttttgatttgtttcagaacaaagatttgatgtgtcttcactttaaaattaaagaattcccttgtcccatc

SEQ ID NO: 16077 - DNA, 271 bp, Diabrotica virgifera
cgtggatgcgaatgagagatgactgatcctggcgttgttattattttgaggaggatatgtggcaaagaaacaaaaatgtaagtggaagaacttcgtatgggcgggacatgtgttgcaagttttttccagatcggaggattttacttaatcatatgaactatcactatgtagaaagtggtttccaatgcaagctttgcttcaagccgattcgtatcaaagtctgatttgcaagtctgaacgtgatcgcacacaggagagggaccttatagat

SEQ ID NO: 16078 - DNA, 834 bp, Diabrotica virgifera
  misc_feature (16)..(697): n is a, c, g, or t
  misc_feature (704)..(733): n is a, c, g, or t
  misc_feature (735)..(765): n is a, c, g, or t
  misc_feature (767)..(781): n is a, c, g, or t
  misc_feature (787)..(825): n is a, c, g, or t
ctcctttacgtgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattannnnnnnnnnnnnnnnnnnnnnnnnnnnnnannnnnnnnnnnnnnnnnnnnnnnnnnnnnnncnnnnnnnnnnnnnnncttatnnnnnnnnnnnnnnnnnnnnnnnnnnnnnnnnnnnnnnnattaaattt

SEQ ID NO: 16079 - DNA, 913 bp, Diabrotica virgifera
  misc_feature (851)..(851): n is a, c, g, or t
cttgaatttttgaaataatttgctgcagcagaaagaaagcagcataaaattgttttagctgaaatatgctagatgttctaaaatgcatctaacgtctttaatgcacactgtcttatatagaggatcttttagaatttgtacaaaatcgataatgacaacaccaagaaaccttcaagaggtagtggatgacttaaaaggtaatccctattatgacaagtatgctgaaaaaatagcaaaattacataaagaagacccaaatgaattcaaagcccgcattgaaaaagctaaccagaagacgaagaaatttgatcctcccaagcaaccagaacggcagtattcccaattgttgacaccaaaagaaaagttagcagaaacaggtcaatttaaacaagaatcgttagacaagattatgaaaacaaatttaataaaggacaaaaacgcagaagaaattaagtcaatttgggaagaataccataaacataaagaatattgtatagcagccactattccttcaggggactttgtaaaattaaatgaaaattccaaaaagtatccaacttttctctttgcccttcctcgcacccagggctatgagtttattatgtgtcaatttgcccaaaacactgttcacttcacacccttactgtactatcaagttcataaagaaaatgcacccgaatgtctacacatcacccactatgacgaatttgaaggtgacaaagggattgtgcttatgagaggagaatatgataagaatgttatgaatgcacaggaggcacaatgtttggcaaatcaactacaaatgtattatgtacaagaagattcagaaaagaagaagcttctggaacagntcaccaatgagccagataagtttaagcatggagatcttatcaagcagattgaaaattttgac

SEQ ID NO: 16080 - DNA, 695 bp, Diabrotica virgifera
  misc_feature (51)..(109): n is a, c, g, or t
  misc_feature (137)..(199): n is a, c, g, or t
  misc_feature (604)..(622): n is a, c, g, or t
tggatacatgtgctaattgttataactaccacttctaccattgatagtgcnnnnnnnnnnnnnnnnnnnnnnnnnnnnnnnnnnnnnnnnnnnnnnnnnnnnnnnnnnnagaaactgtatagtagtgataaagtgtnnnnnnnnnnnnnnnnnnnnnnnnnnnnnnnnnnnnnnnnnnnnnnnnnnnnnnnnnnnnnnngacgaattcctgccaggatagaattgaaaggatccctcctagctcggaagaacttttcgaaaatatcccttggatgaatatcatggctgatctgactgttaaatctgctatagctgaatatgagtttaaacgtatgctgaataagaagctgtctcatttctccgattctaaaaaatctgttattcaaatatcattatatatctgctccactttcctagacatatcatatattaattgtatctaccctcccatcttgatgaattacctgagctactccctataccctctcaatgaaaagatcgagtccgagtaccgaattctaccatggctcataaatcaagtattaatcgaatgtctatttagtcaaaccaatacttttatcgtatgagaaagtcatcttatacnnnnnnnnnnnnnnnnnnncaaacatgtcatttttgtattaagtataaagcctccccccgccactgaatactcagtttgcccctccctattt

SEQ ID NO: 16081 - DNA, 170 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (159)..(159): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagtttaaaccggtgtgagccaggttggnttctatcttta

SEQ ID NO: 16082 - DNA, 943 bp, Diabrotica virgifera
  misc_feature (36)..(59): n is a, c, g, or t
  misc_feature (644)..(663): n is a, c, g, or t
  misc_feature (759)..(759): n is a, c, g, or t
  misc_feature (837)..(837): n is a, c, g, or t
  misc_feature (877)..(897): n is a, c, g, or t
cccacgcgtccgaaaaagcatgttgggctttaaagnnnnnnnnnnnnnnnnnnnnnnnngaatattgtgagtttaattcttgatatgacagaaatacggccttgatactctactattctaaggaatctccaatgtatactttttctttatgtaccttatgtacatacttttcacgtgattttctaaacctggataatggattgtgtacaaagaagagagtgatatgacaaactgatgtacttagaaatatttgaagcattttcgaaaacctaaaagtctatgaagtaacattaaggttaatgttgatagaaatcatggtccagtttttaagaatagataaacaacatatacagtgtatctacgtaacttggaaccatatggcaaattttttccaaaatgtgcgtccaaaaagtatgcctcaccctgtctttcagaaatttttgtttattaattgtacaagaaaaagctttgtatggtgtaaaacttaaaacctgcagccatcggatatgaaattttatcaatcttgtacgaggtgtgtcaagaaatgtgactttcactcaatagtaaggtgcatttatatttcccaacattgaaaattgtttggaattaaaaattatgttttaatatgaaactacttccttctnnnnnnnnnnnnnnnnnnnncaaatttttctcatgattttatttattgaaaatatgataactcttccattccgataaaaaatgataggcaaattttcacaaaataaaatatattanaaatctaacgaacgttgaagagttcatagcctttttttctatcggaacaaaagaataatcatatttataataaataanaattatgttcagtatcagtaatttgagaaatcagtcattnnnnnnnnnnnnnnnnnnnnngatgaaattgcatattaaaatatggtttttaattcccaacgtcttt

SEQ ID NO: 16083 - DNA, 738 bp, Diabrotica virgifera
  misc_feature (63)..(77): n is a, c, g, or t
aaattaacaaaaaatcatataataataaacaaacattaaactcattgacctatatattaaacnnnnnnnnnnnnnnncaagttgtccgaaacctctaggaaaacaacaggaacttcactaagaaaacaacttcatgtaaaagaaagattgtgttgcaaatgtggttttaaaaccagatttcgatactatatggattcccatagagattttgtacatggtaatggtcccaccagcaaaggagctggcaatattataaaagatgatgaaaacatagttctgcttcattatgtgcgcaaactacaattatataaatattatgaatctgtggacactattcaaaaagaattaactaataaattgatggatgtgatgagaatatttaaaaaagaaggctgtaataggggatctgtagagttagaaaaattcttcctaaacatgagatatgactccatgtggagatttaaaagttattacattcaaaaaagcgcggcgagacccacaaaagaagattatatacttgcaaatttatttcccaagttttatgagagtgtaggtttcgatatgagtcaattgatggccgatgctaaaacatattcaacggaaatagtggaatatttaggccccgtcgaagatcaagaacgcccttctatattggaggatacatcatccttatgtcatttaaacgacgtagagcctcaaccaaatttaaagagaccttgttccgaggaagacgaaagg

SEQ ID NO: 16084 - DNA, 73 bp, Diabrotica virgifera
  misc_feature (26)..(26): n is a, c, g, or t
taacagcgtaatttttattggagagntcaaatcgataataaagattgcgacctcgatggtggattaaagttta

SEQ ID NO: 16085 - DNA, 864 bp, Diabrotica virgifera
  misc_feature (16)..(664): n is a, c, g, or t
  misc_feature (671)..(708): n is a, c, g, or t
  misc_feature (728)..(741): n is a, c, g, or t
  misc_feature (744)..(766): n is a, c, g, or t
  misc_feature (774)..(795): n is a, c, g, or t
  misc_feature (825)..(856): n is a, c, g, or t
gtcgccttaccgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttggttnnnnnnnnnnnnnnnnnnnnnnnnnnnnnnnngaaaggaa

SEQ ID NO: 16086 - DNA, 873 bp, Diabrotica virgifera
  misc_feature (60)..(61): n is a, c, g, or t
  misc_feature (64)..(65): n is a, c, g, or t
  misc_feature (69)..(69): n is a, c, g, or t
  misc_feature (145)..(246): n is a, c, g, or t
  misc_feature (249)..(269): n is a, c, g, or t
  misc_feature (271)..(298): n is a, c, g, or t
  misc_feature (347)..(367): n is a, c, g, or t
  misc_feature (384)..(399): n is a, c, g, or t
  misc_feature (401)..(417): n is a, c, g, or t
  misc_feature (447)..(464): n is a, c, g, or t
  misc_feature (542)..(571): n is a, c, g, or t
  misc_feature (652)..(675): n is a, c, g, or t
  misc_feature (770)..(788): n is a, c, g, or t
gttgaaaaacaggtccgtttttttgtatttttatgttattgtagtaactaaaggagaagnnaannaagnaagggaaagaaaagagcaagaaagagaaaaagtattagaagaaaaaatttcttttaaagggaacaagaggccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctnnnnnnnnnnnnnnnnnnnnntnnnnnnnnnnnnnnnnnnnnnnnnnnnngaaaaagatgagaggaaataaaaggaaaacggaaagaaagaaagggagnnnnnnnnnnnnnnnnnnnnngagaattgtaatatatnnnnnnnnnnnnnnnngnnnnnnnnnnnnnnnnngagaggtaaaagaataaaaaagataataannnnnnnnnnnnnnnnnngtagatgaaaagagtaatagggattaaggagaatgataaaagtatcaaaaaataagagataaaaaatagaataaagannnnnnnnnnnnnnnnnnnnnnnnnnnnnngagaaaattattatgcagatgtaaggaaggaggaaagaatgattagtatagtaaaaagtgaagagtgaaattaatttaagnnnnnnnnnnnnnnnnnnnnnnnngagtttatttgaaaaaagtagaaaaattgacgaatgcaggagaaggggaagatgtaaggatgttttattagaggaaataaaggtagtctaaaagnnnnnnnnnnnnnnnnnnnagagaggataaaaagaaaagagaaagtaaagaacaacagaaattatgccattattttaataaagcataaaactctaaataaattt

SEQ ID NO: 16087 - DNA, 865 bp, Diabrotica virgifera
  misc_feature (8)..(856): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttttt

SEQ ID NO: 16088 - DNA, 863 bp, Diabrotica virgifera
  misc_feature (163)..(183): n is a, c, g, or t
  misc_feature (245)..(259): n is a, c, g, or t
  misc_feature (807)..(807): n is a, c, g, or t
cggacgcgtgggattcttagctaataatttacctcaagatcctcaaatcaacaaggacttacaaccttggaaagaagaagtagataagcaaggaaataaagtgttgggatcgactctggttgacttatcttttgaaggatgttatacccacgaatgtactttnnnnnnnnnnnnnnnnnnnnnaagtgttttcgcttttacaaaatcaccaccagaaggagcatggacagaagcttctattggannnnnnnnnnnnnnnggtcttaggactactattagaacaggaaatataacttacgccgatataaaaacatctcaaccatttagcaataccatcgattttggtcaactttatggaaaatatttaaaagaaacatttgaacgttgtacgttagaatatcatgcaggtcgaacagaagccagtacaactctgcttcaagtatcaggtataatagtagaatacgacttcgcaaaaccagaaggtgaaagggtcatttccctaaaagcgagatgtcacaattgtactgttcctgtatacgaagacgttgagatggacaaactgtacaacttggctatgaactcatatatggctgaaggtggtgatggtttcgatatcataggaaaaaatttgattaataaaaagaaaggactagtagatgtagatgtatttgtagactatattgctcatagatcaccaattttcgaagaagaagggggcagaattattttacataatgccgaaaattcatacgttattcggagataattttgttgtttgaaaaattgtagtttaaaaatgataaatanataaatgacatgctgccaaaaaatagccttagaacacaattattaagttaatagat

SEQ ID NO: 16089 - DNA, 369 bp, Diabrotica virgifera
  misc_feature (13)..(14): n is a, c, g, or t
  misc_feature (29)..(29): n is a, c, g, or t
  misc_feature (31)..(31): n is a, c, g, or t
  misc_feature (208)..(232): n is a, c, g, or t
acttaacaggggnngagttaagtgagttnantgtttaaatgcctttaaaagtggaaaaggaaaaatcgcattattatcagtatcaaacaaactaggccttgttgagttcggttttctttagaaagtcttggattcacattggttgatggaggagggacagaagaaagtcttagaaatgaagattttaaaatattagttgatatagttnnnnnnnnnnnnnnnnnnnnnnnnnggcaagaaaagctatagaagagaggaaaggttaataatagataattaaaggagaataaaataaggataaatattgaagtaataatagtagtatgaaagttataaatgtatataggataaaatattgaggagttattg

SEQ ID NO: 16090 - DNA, 877 bp, Diabrotica virgifera
  misc_feature (3)..(3): n is a, c, g, or t
  misc_feature (40)..(40): n is a, c, g, or t
  misc_feature (44)..(44): n is a, c, g, or t
  misc_feature (60)..(125): n is a, c, g, or t
  misc_feature (127)..(251): n is a, c, g, or t
  misc_feature (267)..(338): n is a, c, g, or t
  misc_feature (343)..(391): n is a, c, g, or t
  misc_feature (418)..(441): n is a, c, g, or t
  misc_feature (481)..(518): n is a, c, g, or t
  misc_feature (613)..(631): n is a, c, g, or t
  misc_feature (710)..(733): n is a, c, g, or t
  misc_feature (752)..(773): n is a, c, g, or t
  misc_feature (780)..(804): n is a, c, g, or t
  misc_feature (807)..(876): n is a, c, g, or t
gtngatcaataggtccgaagaaacttttctcctttccgtntctnccataaaaaagaacannnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggagaaaagaannnnnnnnnnnnnnnnnnnnnnnnnnnnnnnnnnnnnnnnnnnnnnnnnnnnnnnnnnnnnnnnnnnnnnnncgaannnnnnnnnnnnnnnnnnnnnnnnnnnnnnnnnnnnnnnnnnnnnnnnngagagaaaaaaaagtaaagaaggaatnnnnnnnnnnnnnnnnnnnnnnnngcaagcaggtaaggagataaggaagatataggagaaaggnnnnnnnnnnnnnnnnnnnnnnnnnnnnnnnnnnnnnncacgagtggcaaaaaataaagagagagcagagagttagacaagaaaaagaaatataacaaaagagaaaaagaaaacaaaagaaagatgagggacnnnnnnnnnnnnnnnnnnncgaatatagaaaataaaaaggaaacaaaaagaggagagagaaagaataaataacgaattggaaaaaagggacttaagannnnnnnnnnnnnnnnnnnnnnnntgcgtaagaatagaagcgnnnnnnnnnnnnnnnnnnnnnntgagcannnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnc

SEQ ID NO: 16091 - DNA, 735 bp, Diabrotica virgifera
  misc_feature (2)..(44): n is a, c, g, or t
  misc_feature (52)..(165): n is a, c, g, or t
  misc_feature (174)..(727): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagc

SEQ ID NO: 16092 - DNA, 782 bp, Diabrotica virgifera
  misc_feature (23)..(103): n is a, c, g, or t
  misc_feature (128)..(151): n is a, c, g, or t
  misc_feature (153)..(277): n is a, c, g, or t
  misc_feature (286)..(333): n is a, c, g, or t
  misc_feature (344)..(344): n is a, c, g, or t
  misc_feature (347)..(388): n is a, c, g, or t
  misc_feature (486)..(515): n is a, c, g, or t
  misc_feature (520)..(547): n is a, c, g, or t
  misc_feature (549)..(614): n is a, c, g, or t
  misc_feature (632)..(680): n is a, c, g, or t
  misc_feature (720)..(777): n is a, c, g, or t
cccccccccccccgggaaaaagnnnnnnnnnnnnnnnnnnnnnnnnnnnnnnnnnnnnnnnnnnnnnnnnnnnnnnnnnnnnnnnnnnnnnnnnnnnnnnnnncccacccccggggggcggcggccgnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccagcnnnnnnnnnnnnnnnnnnnnnnnnnnnnnnnnnnnnnnnnnnnnnnnncaccgacgccnggnnnnnnnnnnnnnnnnnnnnnnnnnnnnnnnnnnnnnnnnnngtcgggggcggggcgcggaggggaggagggaccgcacaccgcaccctcatctaccacttactcccttaggcactctaccaccaaccctcccacgacgnnnnnnnnnnnnnnnnnnnnnnnnnnnnnnaggcnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnccttcagcactaccaccnnnnnnnnnnnnnnnnnnnnnnnnnnnnnnnnnnnnnnnnnnnnnnnnnccataccaccaactactggaagaattacaactaatcactnnnnnnnnnnnnnnnnnnnnnnnnnnnnnnnnnnnnnnnnnnnnnnnnnnnnnnnnnncccta

SEQ ID NO: 16093 - DNA, 913 bp, Diabrotica virgifera
  misc_feature (375)..(392): n is a, c, g, or t
  misc_feature (861)..(861): n is a, c, g, or t
  misc_feature (868)..(868): n is a, c, g, or t
atacagtcgctattcgtgataggactaagtagttcttagtacattctttgacatattatcgatagtttgtacatcgtttcatacaataataattaatcaatgacctttttgtgttttataactactgtaccgatggggtggatgattcgttgctcttcgtgattgtaacgttttatcgaatctttaaaaattcgcaagttgacatttcacttcatgaacgaaattctacgttttagttgaatttaaaccagaggtcaccatgaaaacagtattaatcgcaatagtaatctgttgttggctttttaatgaggctttatgtggagttgaagatgattggaatgattttaaaatcaagtacaaaaaaacctatgagtnnnnnnnnnnnnnnnnnngatttagcgacttcaaagataacttaaaggaaatccgccatcacaacaatcgctatgagaagggtttagaatcgtacaagaaaggcattactgtgtttgcagatttaagtagaatagagtttgagagcaaatatcagctggatagacctatgatgatgactagatattcacaaagctggaaaaatcgttatatagataaaaatttaaccaaggtagatgtagattggagaaaagaaggtgcggttactccagtgaagaatcaaggaatatgtggttcatgttggatatttagtgcggtcggcgttttagagagctaccacttcagaaaaaccggaaagctaatatccctcagcgaacaaaatggtcgtcgattgtttttctagcaactcgtgtttgggaggacttccagaagacgcccttactttcatacaaaaaaatggtgtaagtacggaagctgaatatccctatnaagatanacagatggcttgtaaccctcatctaataaaacacgcatcgatttt

SEQ ID NO: 16094 - DNA, 482 bp, Diabrotica virgifera
  misc_feature (375)..(404): n is a, c, g, or t
cactgtataaaatattcaataaagtagataataaaaacaaatatgaagtgtcaacaccgcaactgtcaaataagtgttaccaatttatgccaaaatatcaccttcgctcgatcacagttgtgatccggacaaatatgcttcgtaatccacttatacagattaaatgaaacaagttatggtgcatttctttaagtttacattaatagaaattttcaaatattatatttacgcctatatgaggcgcttagagcaacagtggactaagccacaaattgagaatttttagattaatatatcaataagtgcttgacacattaagtgctcgtttgttcaaaagataagcaagaatttaattatattgagacaatatattgnnnnnnnnnnnnnnnnnnnnnnnnnnnnnnagcacagacgtctagcaggtttttaggtcatagtagttcactgaaagtgttcagattttaaatatatagaataccaaa

SEQ ID NO: 16095 - DNA, 730 bp, Diabrotica virgifera
  misc_feature (7)..(52): n is a, c, g, or t
  misc_feature (54)..(96): n is a, c, g, or t
  misc_feature (104)..(659): n is a, c, g, or t
  misc_feature (661)..(694): n is a, c, g, or t
  misc_feature (696)..(713): n is a, c, g, or t
cccctcnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnngnnnnnnnnnnnnnnnnnngatgaagggctggatgg

SEQ ID NO: 16096 - DNA, 387 bp, Diabrotica virgifera
  misc_feature (9)..(25): n is a, c, g, or t
  misc_feature (27)..(51): n is a, c, g, or t
  misc_feature (65)..(95): n is a, c, g, or t
cgccccagnnnnnnnnnnnnnnnnncnnnnnnnnnnnnnnnnnnnnnnnnncattattttattgnnnnnnnnnnnnnnnnnnnnnnnnnnnnnnnccttatttatatgagcggattattattgaagagtacctatctatataatataatgctacctcatagttgtttgatccattatttttgatgatacaaatatattatcatagctgtaccacttttattattttaggtgagctcgaatcaatccgaaagagtgcagcctcgatgctatcttaaagttaataatagatgttacaactatagtatcaaatctgtacgacatttattatattacgtgatctgttattaaaccgaaagagagacaaaaatgaattctatcttgaccgca

SEQ ID NO: 16097 - DNA, 838 bp, Diabrotica virgifera
taaaatgatcaaaaaatgttttgaattattacagaatcaaaataatataaagcagataataagaacaacacgaactcaacccgtttcaagtgaaaaatgggatttatttgctgcagtatgcctagaacgaaaaccagtaataacaccaccactaaatgatttacaaaaggactataaacaattaatgagtgatatagaatttgaaagaagtttaaaatctaattttgaactaaggcatgaaactgatgttaagaatttagaaatattgaagaaaggtggagaaatagcagacatagatgttaatctaaaacagactgcccaagatttaaaagatatgtggacagcagaagccgcacagtttaagtttgctgatacagtgacagaggcagataagaaaaatgaccaaaaatctttaaatcgaaggttggataaacatttaatatatgttttaaatcagaaagtgggcgataagaaattctatctattaccacaagctattaggcaagatggagaaactttaaggcagagtgctgaaagaattcttaaagaaagtatagggccagatgtgaaagctcaaatttacagcaatgctccatggtggattttataaatacaaatatccagctaacataagaaatgataaaaatatagttggagccaaggtatttatctactttgcaagatatttaaaaggccaaccaccagcgaagggattggattttaaatggttggatcgaaatgaattacgcaaagcattacctccacaatataatgatagtgttaaacagtttttaatagatgaataatttaagtttataaaaatatagttttgttacct

SEQ ID NO: 16098 - DNA, 961 bp, Diabrotica virgifera
  misc_feature (116)..(139): n is a, c, g, or t
  misc_feature (152)..(169): n is a, c, g, or t
  misc_feature (203)..(225): n is a, c, g, or t
  misc_feature (451)..(471): n is a, c, g, or t
  misc_feature (550)..(569): n is a, c, g, or t
  misc_feature (634)..(682): n is a, c, g, or t
  misc_feature (822)..(842): n is a, c, g, or t
  misc_feature (874)..(874): n is a, c, g, or t
atccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagataangacctttaagaataacttcttcaattgaatgactacaatttaaccctccagctgaacacagatattctggattgccattatatcatc

SEQ ID NO: 16099 - DNA, 898 bp, Diabrotica virgifera
  misc_feature (406)..(422): n is a, c, g, or t
  misc_feature (697)..(697): n is a, c, g, or t
  misc_feature (819)..(819): n is a, c, g, or t
ttgaaacaataaatattgtggctgtgtcataatttcaaactcattatgttgcagtcttttccagttgataaaattgcaattcaaaaacttttaggtagatttgcactgtatggatggcacaggaagagaaacaagagtacaagaacatgaaacatcctattataaatgtatatgtatgtgatcctcaaaaaattattttacaaaacaagatagagaaagagctttaaaatcccaaggatcctgcaaaatgtttatttggtgtactagtcgaataatagtatctaaaaatattgaaactattttatgggcatgaggatgatatagagcacttacataaataccaaaatcagataaatatctcttcaaagtttattttgagactttcttcaaaaatgtaagtaaaatnnnnnnnnnnnnnnnnnggaaaggcagcacttcgtaactgaaaaatttttataacgtgggttgcttcacttttcgctttggaataagtgtatcggcagctattggacagcgattacagctgggaaagtttccggaaggcttccaaaaggctttcccagctctaaaagctgtttaatgggtgctgatacacttattctggagcgaaaaccgaagtagctcattttatacaaatttttcagttatagtcggttcgctgaactcagacccaactggctagatattttagtcgatnaatttttttgttctttgccaattttgcagaactttgcaaaattactaactatttagtgattattaactatttagtaattattttttggcaatcttactacaattggcaaaattaccgattanaatatctagaaagttgcgtctgagtttagcgaacagactatattatgaggtcctgcctttctgccatcgatatacacaa

SEQ ID NO: 16100 - DNA, 744 bp, Diabrotica virgifera
  misc_feature (15)..(43): n is a, c, g, or t
  misc_feature (45)..(545): n is a, c, g, or t
  misc_feature (552)..(589): n is a, c, g, or t
  misc_feature (609)..(622): n is a, c, g, or t
  misc_feature (625)..(647): n is a, c, g, or t
  misc_feature (655)..(677): n is a, c, g, or t
  misc_feature (707)..(738): n is a, c, g, or t
ctcctcggcgtccgnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16101 - DNA, 324 bp, Diabrotica virgifera
  misc_feature (2)..(15): n is a, c, g, or t
  misc_feature (32)..(47): n is a, c, g, or t
  misc_feature (49)..(66): n is a, c, g, or t
  misc_feature (81)..(101): n is a, c, g, or t
  misc_feature (171)..(203): n is a, c, g, or t
gnnnnnnnnnnnnnngaaccttgagaaaaagnnnnnnnnnnnnnnnngnnnnnnnnnnnnnnnnnncgaataaataaaagnnnnnnnnnnnnnnnnnnnnnggaaattaaaaattgtaaataaaaaataagttaagaaatgtcagtcggggttggggagatcaaaattacnnnnnnnnnnnnnnnnnnnnnnnnnnnnnnnnngagtgaaaaaaaggaattgggaaattatttatattccgggtattaagaggaggggttattaggaatagggtgaaagggttggggggctaaagaaaaattagggaggcaaagcttcatagcc

SEQ ID NO: 16102 - DNA, 583 bp, Diabrotica virgifera
  misc_feature (10)..(81): n is a, c, g, or t
  misc_feature (132)..(181): n is a, c, g, or t
  misc_feature (218)..(255): n is a, c, g, or t
  misc_feature (288)..(312): n is a, c, g, or t
  misc_feature (338)..(358): n is a, c, g, or t
  misc_feature (474)..(494): n is a, c, g, or t
cggacgcgannnnnnnnnnnnnnnnnnnnnnnnnnnnnnnnnnnnnnnnnnnnnnnnnnnnnnnnnnnnnnnnnnnnnnnnttgatgatatagtatgtaaatgtaatgtatggtaatgactgagcggtggcnnnnnnnnnnnnnnnnnnnnnnnnnnnnnnnnnnnnnnnnnnnnnnnnnngagaagaaccccccccccgcccccacagggggagaannnnnnnnnnnnnnnnnnnnnnnnnnnnnnnnnnnnnnccaaaaagacacaaaaaaacgggagggagacannnnnnnnnnnnnnnnnnnnnnnnngacagggcaggcgggagggggaacannnnnnnnnnnnnnnnnnnnncaagaaggaaaaaagagcgacaaaaaggcaaccaagccaacagcgcgaaaggaggaggaagaaaacggacgggcgcaccggcaccacaagaaaaacagaacgaaagaaacaaggannnnnnnnnnnnnnnnnnnnnggggaagaagggaaaaagagagcctcagagaaaaaagacaacagggggagaaaggaaggagaacacgagaaaacaggagagcgcaggag

SEQ ID NO: 16103 - DNA, 961 bp, Diabrotica virgifera
  misc_feature (923)..(940): n is a, c, g, or t
cggacgcgtgggcagcgatgttttctgtaaacattttagaaatcgttcttcattactgtccgcttcagaatcgattagctgttgcctttttttatgtttctcatattctttagtgagcattaagaatatgtcatcatctggactactatgagaggcatcattggagggttcgcttgtaacattttcagttcgatgttcctttggtgccatatctatttctttagatatgctatttttggtactagtgtatatttttttaagacacgcatttttcaatagattacttagtggttccgattttctggcagttgttgacttttcagaaggaataccttctttgttgccagaacttctttgtgtagcatttagggtgcgaggcaagtttatataggtctgattagggttttcaactgttgcatgcagaatatgctctgcatctgataattgtttgacgtctgtagtttcaatgtttttactcttaaattctatcacacacgattcaatttgagagggaagaaaaactgaaggctcctcgtaatgtttaacagtggtttcaaagtttttgattttataatcttcaacaacgtccgctctttgttttaaatcatcataattattttgatgtaaaagtgtcttaagctttaatgaattatatcctataacactattagatttttcattgtccttggtcattttttgatcaacaaatacttttggcgactgcgatttcggtatatcttggagaattgtattattttggaacacatatgaaaattctggagttttaaattcggcacttttattgttttctgaatcctcatgcttataatcgtccaaaaccggcctgcttttttgtttaaatcatcataattattttgatggaaaaggggcttaaactttatggaattatgtggtatggcacnnnnnnnnnnnnnnnnnnggccttgggacattttttgat

SEQ ID NO: 16104 - DNA, 673 bp, Diabrotica virgifera
cttgctttttgcgcacaatggaccatccactacactacagaaggcgccaggcttacaacacataactctgaagcagcggcgttggccgcaatccctcgtggatatttctcaaatactctaatacctagaaaagagccttttatctccccacaagctattcaagtgaaaattttttcaaatcttttctccctgccctgtccccttctggccccgagtgggcgaatcacccaggatagaaatgagacaatactcggactatccatgcctcttttcgatcttttaccattgctctaggttcctccatcgcagagcagaagattcacccggaatatcttatggcacaacaaatcgaactatccccatctaacctatagaatgaaataaatgctattgtcttatctgacatattatagaacttaaacatgagaacttttggtagcaccatctaccacatccttgcttacgacacgcgagagctgatgcacgtagatcgttcatcatggcacccaaacttcatctcactgaacaccatcttacaaagacgagaatgataaaacccagtagatgcccatcttagtcttgttatgttacatccccccttcgccggatgcataaaaagaatggaagaccacgcctgtcgcgcttcccaacaggtgtctttgcaggatgaccg

SEQ ID NO: 16105 - DNA, 1120 bp, Diabrotica virgifera
  misc_feature (64)..(77): n is a, c, g, or t
  misc_feature (79)..(91): n is a, c, g, or t
  misc_feature (769)..(787): n is a, c, g, or t
  misc_feature (802)..(826): n is a, c, g, or t
  misc_feature (866)..(910): n is a, c, g, or t
  misc_feature (1042)..(1076): n is a, c, g, or t
  misc_feature (1093)..(1111): n is a, c, g, or t
aatagaagcaactgcttaaaaatcacacatattccttcggtgttttagtgtttgttcttaaacnnnnnnnnnnnnnngnnnnnnnnnnnnncaatcatgtcagcaggggatgcactagcccccggtgcgggggcggcgggtagcggcggcgacgatggcattgtgggcggtccgcgaacgccacaacaaatcgcggcccaacgacggcttcaacaaacacaggcgcaagtcgacgaagtcgtggatatcatgaaaacgaatgtagaaaaagtattggaaagagatcagaaactatcagaattagatgatagagcagatgctttacaacaaggtgcttcacaatttgaacagcaagcgggaaaactaaagagaaaattttggttacagaatttaaagatgatgataataatgggtgttattggtcttgtaatcttaataatcatagtcatgaacttcatgtaactcatgggccaaaaattcgttcgaataattggcatatacagaaaacctacaattattgaatacaacacaccaatacaaaaaatcaatattaaagtaatttaatctataggttggattgaaatagacgattaggcaagttggttgaaaaaaatataatcagttgttaaaggttcaataaatggacactggtgtttcaccaagtaattgtaattcaataataataagcctctggaaacaccattattttattatcacggtaaaatacgagtgtctagctgtcaaaaatgttaaaattgtgtatttaacnnnnnnnnnnnnnnnnnnnaggtgaacagaacgnnnnnnnnnnnnnnnnnnnnnnnnngtagtaagcgaacactttgttattttttttaaggtttaannnnnnnnnnnnnnnnnnnnnnnnnnnnnnnnnnnnnnnnnnnnncaattaaagaagatttaatttaattggttggttaaaaaaaagtattctttttacaatcctggaaaaaatctttgtaagtttcgataaaaaaggcttgttcaaatccaccgccctcccccccaacccgaatannnnnnnnnnnnnnnnnnnnnnnnnnnnnnnnnnnataggtttatctgggtnnnnnnnnnnnnnnnnnnncccccccag

SEQ ID NO: 16106 - DNA, 799 bp, Diabrotica virgifera
  misc_feature (15)..(600): n is a, c, g, or t
  misc_feature (607)..(644): n is a, c, g, or t
  misc_feature (664)..(677): n is a, c, g, or t
  misc_feature (680)..(702): n is a, c, g, or t
  misc_feature (716)..(716): n is a, c, g, or t
  misc_feature (762)..(793): n is a, c, g, or t
cttcctagcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttaaaccggtgtgagccaggttggttnnnnnnnnnnnnnnnnnnnnnnnnnnnnnnnngaaagg

SEQ ID NO: 16107 - DNA, 902 bp, Diabrotica virgifera
  misc_feature (618)..(646): n is a, c, g, or t
  misc_feature (798)..(855): n is a, c, g, or t
atcttttgagtcctttggctgcctggattaagacaagagaaattattaaatgaaaatttctctgtcttttcttcttcagtgaccacttttttataaatttcttcatttggtaattttgcgcaataaataccggtttgcttacttacttcttacttctctaaatcttggcttataaaaatgttaagtttctatggattgatatgtcgattagttttcattcgttaagaagtttctagttaatattctgcagtgttgtcaggaaggttgcaaatctttgaatatttatcttgggtatttttgtgcgttttttgtgtgttgttgattgatcttgtattacctatgtaatgaaacatgcatacttttggcactttaagtttttgttaagcaaatctaagtgtccctgcaggcggggattgtagtcaccgccagtccccctactttcatcatgtgtagggggattttatatttcaatggttttccacatttccactcaagtccgttcagtataattacgtccactaaagtaaaactagctaagaatttaggagaccccacttctggctgccagtaccagccggtactaccgtctccatctacagggcacataaagaaataaannnnnnnnnnnnnnnnnnnnnnnnnnnnnatatgttaaacttaatttgttatagagaattatctaggaaaattctaattgaggctgcgaaagctggtcttttgtacaaacgtaatagccttctttcgttagaatgttccttaaaggtcattacaaattaagtagtataatgtatatatagnnnnnnnnnnnnnnnnnnnnnnnnnnnnnnnnnnnnnnnnnnnnnnnnnnnnnnnnnngtgatagttccctgtgatacataaggataaaacaaatagggttttcc

SEQ ID NO: 16108 - DNA, 920 bp, Diabrotica virgifera
  misc_feature (173)..(192): n is a, c, g, or t
  misc_feature (263)..(281): n is a, c, g, or t
  misc_feature (385)..(404): n is a, c, g, or t
  misc_feature (440)..(538): n is a, c, g, or t
  misc_feature (545)..(571): n is a, c, g, or t
  misc_feature (582)..(603): n is a, c, g, or t
  misc_feature (605)..(658): n is a, c, g, or t
  misc_feature (780)..(797): n is a, c, g, or t
  misc_feature (802)..(829): n is a, c, g, or t
aaatcgaataccgatcaatcaaagaattactttcaatgtctaaaatatagatgaacaaaagagctcgtccacagatttttcgtaatcaaataaatgcttttttctcttggctcgaatttcattttcacctggaaattcggaacttctagatattaagattttccccaatttcnnnnnnnnnnnnnnnnnnnnggtcattagccatattgtctgtaacttttcattttttctatagtttctgacaacatttttacacaatctgnnnnnnnnnnnnnnnnnnntgattatgccagccccacatgtgtagtctactgtttttacagtatcagtataacatatttttaggattaagagttaaacctaaatgtgttatgaaaattaaacnnnnnnnnnnnnnnnnnnnnaataatttttcatattttagaatatgatattattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattggnnnnnnnnnnnnnnnnnnnnnnnnnnngaataggatannnnnnnnnnnnnnnnnnnnnngnnnnnnnnnnnnnnnnnnnnnnnnnnnnnnnnnnnnnnnnnnnnnnnnnnnnnncaatttgaatgaacggggtattttgaccgaggtaaagtagcgtaaccattagtgtttttatggaaagctggaaaggaaggtttgtatgataaaaaaaatgtgccgtttatttaattaacaannnnnnnnnnnnnnnnnnaatannnnnnnnnnnnnnnnnnnnnnnnnnnnaaaaaccctatagcgcctttataaaagattaaaaaaagtttttacaagatttaattttatttctactaagaaatttatttaaactggggac

SEQ ID NO: 16109 - DNA, 719 bp, Diabrotica virgifera
  misc_feature (3)..(47): n is a, c, g, or t
  misc_feature (49)..(91): n is a, c, g, or t
  misc_feature (99)..(212): n is a, c, g, or t
  misc_feature (222)..(499): n is a, c, g, or t
  misc_feature (501)..(684): n is a, c, g, or t
  misc_feature (690)..(714): n is a, c, g, or t
ccnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcnnnnnnnnnnnnnnnnnnnnnnnnngatgg

SEQ ID NO: 16110 - DNA, 280 bp, Diabrotica virgifera
  misc_feature (7)..(7): n is a, c, g, or t
  misc_feature (35)..(54): n is a, c, g, or t
ttttacnagtccggtgcttaaatacaaataatacnnnnnnnnnnnnnnnnnnnnaccaagcgagaacaagaccaagcaaagagaagcacgaaacagagtgggaaaagaatctaatttttttcaatataattgtaccttgtgtaccatgcgtgctgacagaatcctttattaattatatattcatgatttacgaaattacaagagccataatttgaagatcttactgtaacatacataggttaaaggtttgggtgaaagcgatttgttatgatttttaaaa

SEQ ID NO: 16111 - DNA, 833 bp, Diabrotica virgifera
  misc_feature (33)..(50): n is a, c, g, or t
aataaaaaagctgttcaacatcaccggacaccnnnnnnnnnnnnnnnnnngaaaagtcttgaggttgaatgcgatctgtaatattgctacataatgaatgtgtttagatatggtattttttattgaataatctatacaggcccaactaaatgaatgtatacatatattgcagaaagtgcatttaatggagcagcaagtttttttgtgtttcaatgaggtattcagttttttcttttagtatatacacattatcttgtaaaatagcaagctaatacagttcgatatctagacattatagagctttcaacaggtttaccttttttaagctttataattctttcgacagttttatttcttaaataaacaataaccaccgatttttcaatggccatattattggtattaattccataaaccgtcctataacaatagtcccattgttggaagttattgcagtagttctgctggaaatacttaccaaagttgtatgtatctgcatcattcatcagaaatttcattaagatttacttgccacggccctctctatgtaccagggacataacagtctagtaggaacagaaaacattacgttcaggcattgtaaaaagtgttatgttatgtctgacatgaaaatatttgactatataataccagaacgctcatgtattttttcaaaaaaagtgggtaaataaaagtatcttttctatttgaacataagaaaacaatgggaaattcatactgtcataagttcaaattgataggaaatgagcccatgagttccataaattgcgatttaccaaacttaattaatatttccttttgcacagcattca

SEQ ID NO: 16112 - DNA, 854 bp, Diabrotica virgifera
  misc_feature (35)..(54): n is a, c, g, or t
  misc_feature (57)..(76): n is a, c, g, or t
  misc_feature (85)..(100): n is a, c, g, or t
  misc_feature (102)..(121): n is a, c, g, or t
  misc_feature (123)..(144): n is a, c, g, or t
  misc_feature (152)..(184): n is a, c, g, or t
  misc_feature (186)..(262): n is a, c, g, or t
  misc_feature (275)..(806): n is a, c, g, or t
  misc_feature (815)..(815): n is a, c, g, or t
  misc_feature (823)..(824): n is a, c, g, or t
  misc_feature (829)..(829): n is a, c, g, or t
  misc_feature (846)..(846): n is a, c, g, or t
caggacgcgtggggtttatattttcctcccattcnnnnnnnnnnnnnnnnnnnnccnnnnnnnnnnnnnnnnnnnncatttaacnnnnnnnnnnnnnnnncnnnnnnnnnnnnnnnnnnnncnnnnnnnnnnnnnnnnnnnnnngtacctcnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagaattntatttttnnagtanaagcttaaattttttanaagacgag

SEQ ID NO: 16113 - DNA, 148 bp, Diabrotica virgifera
tgtacacgtcttttgtattatgtaatacttataccaattttaaatccaaattgaagagttttcttacatattactgattacttcttacaaatagtattttataattcaatatttttaaaccgtgttctagtatttgtattgattcgga

SEQ ID NO: 16114 - DNA, 671 bp, Diabrotica virgifera
  misc_feature (26)..(26): n is a, c, g, or t
  misc_feature (298)..(320): n is a, c, g, or t
  misc_feature (330)..(348): n is a, c, g, or t
ttcctctaggggcggtgatatagatnggagaaagggggggagtctttttaaagatatagttgttatgaaaatgttgtttgagattgtatgggttagtatatttagagtggtgtgttcccttggaatatggggttgttgtagaaaaggaaaagggtattaataatttaaggatgtatatattttattatgtaggtgtttaatgtaagatttataggattatttggggatggagaaatggtttttttagattattatttggatgatgttttaaattatataagtaaatttaatggtttgnnnnnnnnnnnnnnnnnnnnnnngattattggnnnnnnnnnnnnnnnnnnngaaggcgcagatagagtctcggttcttgctgcctccccatctattagaagtacatttatacaaaatggtttaaaatttgttatgatcataattgtgatgcactaggtatcgattgataatatccagcttatagttgggtgatacgtatctgacaagtgaaacttcataactctactaaaataaagctatgcagtttttgaagttaatgttctattactataagttgctgttgccgctggttctgcatctgtggtattatcgtatgatattcctcgtatatcctaatatgtctgaatgattatcgtaatgatatacgatttata

SEQ ID NO: 16115 - DNA, 769 bp, Diabrotica virgifera
  misc_feature (3)..(16): n is a, c, g, or t
  misc_feature (21)..(570): n is a, c, g, or t
  misc_feature (577)..(614): n is a, c, g, or t
  misc_feature (634)..(647): n is a, c, g, or t
  misc_feature (650)..(672): n is a, c, g, or t
  misc_feature (680)..(702): n is a, c, g, or t
  misc_feature (732)..(763): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16116 - DNA, 805 bp, Diabrotica virgifera
  misc_feature (13)..(79): n is a, c, g, or t
  misc_feature (83)..(606): n is a, c, g, or t
  misc_feature (613)..(650): n is a, c, g, or t
  misc_feature (670)..(683): n is a, c, g, or t
  misc_feature (686)..(708): n is a, c, g, or t
  misc_feature (716)..(738): n is a, c, g, or t
  misc_feature (768)..(799): n is a, c, g, or t
tttaagcgtccgnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16117 - DNA, 871 bp, Diabrotica virgifera
  misc_feature (50)..(71): n is a, c, g, or t
  misc_feature (791)..(792): n is a, c, g, or t
  misc_feature (849)..(866): n is a, c, g, or t
tacaaatctcgcagttattttaatcgagataaaaatattatttttctagnnnnnnnnnnnnnnnnnnnnnncttaacggcttcgtggcctaaaaaagcatttctcggaggcaataaatcctttaattcaacgtagaagatttagagggaaaaataaatcgtccaaaaaccaaaacctccccacttcgaaaaagctaaattctcagctttaaccaaaccacggtttcattagtccttataaagataaaacctcggccgaactctcgtaaatttaacgttaaagttaataaagatcgaagaagaattcaatccatcccagaagatttacgcaaaagaaataatacgatagacctccaccctccaaactaatcgttctccctcaccttcattcttcgaaagccgacgaagaattcaaattcttcgccacgtataagaaaacagggaacggaattcaagaagtacggaaaaaaattgattcaaggctcaccgtaaaaggaacattttctcgagaatcttttcagattttccacgttactcaacacaacatcgagttatttccgtccagaaagccgaaattcagtaaaggtttcggaaaattcaatacggaaaacgcccttcaacttcgttttcgttcggctcgcaattttcggaaaaacagggctcgattcagcaaagatggacctcggtaaaggtacaagtaaagttttccaaaatatcagaaaacaggcttcaaggcaagaaacttcggtttcaaaactcacggaatcagaaacggggaaacttcaactacanntcagcgattctaaaacggcacattcaaaactacaccttcagttttctcgatttaagnnnnnnnnnnnnnnnnnncaggt

SEQ ID NO: 16118 - DNA, 111 bp, Diabrotica virgifera
  misc_feature (20)..(40): n is a, c, g, or t
  misc_feature (74)..(105): n is a, c, g, or t
attttagtacgaaaggaccnnnnnnnnnnnnnnnnnnnnngatagaaaccaacctggctcacaccggttggttnnnnnnnnnnnnnnnnnnnnnnnnnnnnnnnngaaagg

SEQ ID NO: 16119 - DNA, 765 bp, Diabrotica virgifera
  misc_feature (439)..(458): n is a, c, g, or t
  misc_feature (460)..(472): n is a, c, g, or t
  misc_feature (641)..(641): n is a, c, g, or t
  misc_feature (688)..(689): n is a, c, g, or t
  misc_feature (735)..(735): n is a, c, g, or t
gcacagaggcccttgtcttttgatctagccagtaccaaaaaaacatcgccatcgtgaacgcgatcgcgtcgagatcgcgttggtatgttatccgcttaactcaaaaagtaatataccgatctttgtgaaattttgcacacttcttttttagatattttactaggtagtgaagtcgagtttttgcttattttaacatttttttatattaccatttttctctttaccgaacacactttttttttcgattttttcactttaaagttgtaccatgaatttaaaaatcgatataatcataaaaactcgacgtcactacctcaagaaactcttaactaaaataatctttttggtttgtatgtttcggatgattctgtccgaagatatagtgtacaccgcaaatcatcttttttttgggtcgtctacttaaaaatgacgccaccannnnnnnnnnnnnnnnnnnncnnnnnnnnnnnnnctgaataatcctcaagtgttgttctttaagatagccttttacccatttaacttaaccccaccactttcaagggaaaacgttttaaaattatgcataaaaaacgcagaattaactatacccccccttaatccgtcttgtatctttacattctttaggatcactctcatcngaaaaaacaacggcggtgtgatcagaggatatgcctgctcctcctgnnatagttttggatgatattatagaatttctatatcttctgtgatatnagcgatattataatctatttgatttctgac

SEQ ID NO: 16120 - DNA, 678 bp, Diabrotica virgifera
  misc_feature (11)..(28): n is a, c, g, or t
  misc_feature (106)..(106): n is a, c, g, or t
  misc_feature (114)..(141): n is a, c, g, or t
  misc_feature (149)..(234): n is a, c, g, or t
  misc_feature (236)..(266): n is a, c, g, or t
  misc_feature (268)..(310): n is a, c, g, or t
  misc_feature (312)..(413): n is a, c, g, or t
  misc_feature (415)..(431): n is a, c, g, or t
  misc_feature (433)..(456): n is a, c, g, or t
  misc_feature (458)..(545): n is a, c, g, or t
  misc_feature (607)..(633): n is a, c, g, or t
  misc_feature (642)..(659): n is a, c, g, or t
cttcattgggnnnnnnnnnnnnnnnnnngtttgattagttctcctctgtaggaggaaagagaaagagaaggaaaggctagaaaaggaagagggagagagaagaaangatagagnnnnnnnnnnnnnnnnnnnnnnnnnnnngtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnannnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnngnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattagaattaatcacctgtatatttagtacaaatatattggtttaataatggagttccnnnnnnnnnnnnnnnnnnnnnnnnnnncaacatgcnnnnnnnnnnnnnnnnnncagacctccctgcccactg

SEQ ID NO: 16121 - DNA, 663 bp, Diabrotica virgifera
agtaaatgtatgaatgttaacagtttgtgtatcaagttatagcacagttacagttgaaccatgactgccaaaatttctgatgatttagaaacattgacttatatacctgaatcagaaaatggtgaaggaaatgtgaaactgaaaccggatcttgcagctagaggatctgaaactttattcctatttcaacatgtaacaaaagaaactgcacctacaactttcgaagaagctgccaaactaataggatttggcaagttcaacattttgctgatcagtctaacagtttttggtatattctcccacatgtttgaggctggttcagtgtcgtatatacttgcagcagctcaatgtgacttaaatttatctttacaacaaaagggatatctaaattctatcatttttgcaggaatgatatccggttgtttcttttggggtttccttttagatgtttacggacgacagaagttgatgacgataggttatctacttgccgcaggtttcaattttttaggcagtctttctcaaagctttgatatgcttttattctgcaaattttttggaggatttattatttcatgtccctttggtgccatgtctgcatattgtaaagaattccattcctctgattacagaaacaaggatcaattaatcaatgctacttta

SEQ ID NO: 16122 - DNA, 834 bp, Diabrotica virgifera
  misc_feature (6)..(43): n is a, c, g, or t
  misc_feature (45)..(817): n is a, c, g, or t
  misc_feature (829)..(829): n is a, c, g, or t
cctctnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttaaattnttttt

SEQ ID NO: 16123 - DNA, 132 bp, Diabrotica virgifera
  misc_feature (14)..(14): n is a, c, g, or t
  misc_feature (40)..(40): n is a, c, g, or t
  misc_feature (69)..(69): n is a, c, g, or t
  misc_feature (79)..(102): n is a, c, g, or t
  misc_feature (111)..(131): n is a, c, g, or t
taacagcgtaattntatcggagagttcaaatcgataatanagattgcgacctcgatgttggattaaagnttataattgnnnnnnnnnnnnnnnnnnnnnnnntggtcgacnnnnnnnnnnnnnnnnnnnnna

SEQ ID NO: 16124 - DNA, 809 bp, Diabrotica virgifera
  misc_feature (2)..(44): n is a, c, g, or t
  misc_feature (52)..(669): n is a, c, g, or t
  misc_feature (673)..(799): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtataaattt

SEQ ID NO: 16125 - DNA, 587 bp, Diabrotica virgifera
  misc_feature (2)..(32): n is a, c, g, or t
  misc_feature (41)..(388): n is a, c, g, or t
  misc_feature (395)..(432): n is a, c, g, or t
  misc_feature (452)..(465): n is a, c, g, or t
  misc_feature (468)..(490): n is a, c, g, or t
  misc_feature (498)..(520): n is a, c, g, or t
  misc_feature (550)..(581): n is a, c, g, or t
cnnnnnnnnnnnnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16126 - DNA, 948 bp, Diabrotica virgifera
  misc_feature (17)..(819): n is a, c, g, or t
  misc_feature (821)..(821): n is a, c, g, or t
  misc_feature (825)..(825): n is a, c, g, or t
  misc_feature (841)..(841): n is a, c, g, or t
  misc_feature (849)..(872): n is a, c, g, or t
  misc_feature (892)..(893): n is a, c, g, or t
  misc_feature (929)..(929): n is a, c, g, or t
cggacgcgtggggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnatanttttttgatccaattntttttgannnnnnnnnnnnnnnnnnnnnnnntaacagcgtaattttattgnnagagtcaaatcgataataaagattgcgacctcgatngttggataaagtttataat

SEQ ID NO: 16127 - DNA, 895 bp, Diabrotica virgifera
gtcctttcccagcgtccgaaatgtttgagttcggtatcgttaggagactttaaaagtgataagaaatcaaatagagcctttgtgcattgagtaacagtatgtctactgcccaagtacagatgttaaatcccccggccgtgaaaacgggccataagaatccagtaaaacctcccaatcccagtaatcaaaacaaacgaaaaaacaagcatgacagaagcagcagaaagaggtcgaagagtttttctgggtgcggcattatcatcaaccagaagcctgttttaccttcaaaatttttacttggaggaaatattaaggatccccttaatttgaacagcctacaagatgaggaaataaacagagccatgaatgctgtaacaccaaaatcgtcgccggttcccactccacccaggaagaagggccaactcgaagtgataatcccaaaaaatattcatgaccctttgaatctcatagactgtgatgacgatgctgaatatgaacaacaattatgctcgccgattaaaaagtctaagaaaaagcgtttgaaaaaacgtcgtactatgtccggtaccatggatgtgtctgacgttacagctgacattagttcaacaacagaagcgaaaacaccagaatcctcagcagattctgccaaaatacctgaaatacctgagcctgaagaacaggtgatgccaagtctcgaagtcccatctatatctaaccctaacccagatgtacctgtagatataccaatttctgatccatgtgttggtacttcaactatgttgtctaccatagtacccgcgccaataaagaaagacaaaagcaagcgcaagttagaggatgctcatcaccttgtgaaaaaattgaaaaataattccgatggatcagtttgtgagtc

SEQ ID NO: 16128 - DNA, 191 bp, Diabrotica virgifera
  misc_feature (2)..(17): n is a, c, g, or t
  misc_feature (19)..(63): n is a, c, g, or t
  misc_feature (70)..(182): n is a, c, g, or t
cnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgt

SEQ ID NO: 16129 - DNA, 733 bp, Diabrotica virgifera
  misc_feature (118)..(131): n is a, c, g, or t
  misc_feature (133)..(150): n is a, c, g, or t
  misc_feature (161)..(195): n is a, c, g, or t
  misc_feature (323)..(347): n is a, c, g, or t
  misc_feature (354)..(373): n is a, c, g, or t
  misc_feature (393)..(407): n is a, c, g, or t
  misc_feature (410)..(424): n is a, c, g, or t
  misc_feature (465)..(487): n is a, c, g, or t
  misc_feature (490)..(612): n is a, c, g, or t
  misc_feature (629)..(675): n is a, c, g, or t
  misc_feature (677)..(729): n is a, c, g, or t
attttctcggtaaaaagtaatagaaaaatctttcatcttaatcgataagttcaattcagtatccgtcgagagaatcttttcatttctctaaaagaaaaattcattttccgtacctccnnnnnnnnnnnnnncnnnnnnnnnnnnnnnnnncattttcttcnnnnnnnnnnnnnnnnnnnnnnnnnnnnnnnnnnncttctaaataaatacttcaaaattttttctaacaaacttactcgttttcaatatactaatttttcagaaataaattaaatttctctctctaaacaatatcacttctcaattaaaatatcttttctcannnnnnnnnnnnnnnnnnnnnnnnngggatcnnnnnnnnnnnnnnnnnnnncactaaaatttcaatttttnnnnnnnnnnnnnnnggnnnnnnnnnnnnnnnatcatttcaaaatatgttattcattcattttcatatatcannnnnnnnnnnnnnnnnnnnnnntcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttataaaaacaggtcnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnaagt

SEQ ID NO: 16130 - DNA, 804 bp, Diabrotica virgifera
  misc_feature (2)..(24): n is a, c, g, or t
  misc_feature (69)..(91): n is a, c, g, or t
  misc_feature (154)..(186): n is a, c, g, or t
  misc_feature (190)..(213): n is a, c, g, or t
  misc_feature (261)..(282): n is a, c, g, or t
  misc_feature (300)..(319): n is a, c, g, or t
  misc_feature (344)..(369): n is a, c, g, or t
  misc_feature (373)..(416): n is a, c, g, or t
  misc_feature (492)..(507): n is a, c, g, or t
  misc_feature (509)..(526): n is a, c, g, or t
  misc_feature (644)..(683): n is a, c, g, or t
  misc_feature (727)..(727): n is a, c, g, or t
  misc_feature (799)..(799): n is a, c, g, or t
cnnnnnnnnnnnnnnnnnnnnnnncccaacgatagttaattcgtatccgtgagagaatatctttctctnnnnnnnnnnnnnnnnnnnnnnncccgtacctccgtgtatccagggattcatccaattcaataattcacatatttctccaccctcnnnnnnnnnnnnnnnnnnnnnnnnnnnnnnnnntccnnnnnnnnnnnnnnnnnnnnnnnnctctccgtaatcgaaacgttactcgtttctaaataatatctaatttcnnnnnnnnnnnnnnnnnnnnnncctactaacaatatatcnnnnnnnnnnnnnnnnnnnncactattaatactaaatatccttcnnnnnnnnnnnnnnnnnnnnnnnnnncacnnnnnnnnnnnnnnnnnnnnnnnnnnnnnnnnnnnnnnnnnnnncatcttttcaaaatatcggttattcatttcacttttcacatattaatcatttttcttttttcataaattttttcannnnnnnnnnnnnnnncnnnnnnnnnnnnnnnnnngtaatggatgataataattagtattcaaaaaattggtatattttaagtaaaaatcatatctaggtttaaataaaaggaattctcggcaacatttttctttcacctggtttattcaaannnnnnnnnnnnnnnnnnnnnnnnnnnnnnnnnnnnnnnngcccactggattaattttgaatagggccgcggtatttttgaccngtgcttaaggtagcataaatcattcagttttttctatttgaaagcttggaattggaaagggttggattgaanaaaaa

SEQ ID NO: 16131 - DNA, 96 bp, Diabrotica virgifera
  misc_feature (11)..(11): n is a, c, g, or t
  misc_feature (19)..(19): n is a, c, g, or t
  misc_feature (22)..(23): n is a, c, g, or t
  misc_feature (26)..(26): n is a, c, g, or t
  misc_feature (29)..(29): n is a, c, g, or t
  misc_feature (32)..(48): n is a, c, g, or t
  misc_feature (50)..(88): n is a, c, g, or t
atttattatantataattnatnntantgnggnnnnnnnnnnnnnnnnncnnnnnnnnnnnnnnnnnnnnnnnnnnnnnnnnnnnnnnnttttttga

SEQ ID NO: 16132 - DNA, 458 bp, Diabrotica virgifera
  misc_feature (7)..(41): n is a, c, g, or t
  misc_feature (77)..(94): n is a, c, g, or t
  misc_feature (128)..(148): n is a, c, g, or t
  misc_feature (318)..(339): n is a, c, g, or t
cgccccnnnnnnnnnnnnnnnnnnnnnnnnnnnnnnnnnnnctataaaaacttattaataatgtttttagtattatnnnnnnnnnnnnnnnnnncctatttaattgcagcgattatataatgaatagnnnnnnnnnnnnnnnnnnnnngtaaccactaagtttttgatccgatttttttggttgtaagaataatttaccttagggagaacagcgtatttttattgcagggttcgaatcgataacagagatgtgcgacctcgatgtcgatctaaagtttataattggagtagcggctatatgattaagtctgatcgacnnnnnnnnnnnnnnnnnnnnnnagattaaaccggggtgagccaggtagagttctatctttaacttattaatatatgttacgacgaaaggcccctatatagaaaacaatttttatatctatgatacgacaaaatacaaaggc

SEQ ID NO: 16133 - DNA, 825 bp, Diabrotica virgifera
  misc_feature (2)..(17): n is a, c, g, or t
  misc_feature (28)..(62): n is a, c, g, or t
  misc_feature (70)..(182): n is a, c, g, or t
  misc_feature (191)..(822): n is a, c, g, or t
cnnnnnnnnnnnnnnnncgtgagagaannnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntta

SEQ ID NO: 16134 - DNA, 239 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnatt

SEQ ID NO: 16135 - DNA, 952 bp, Diabrotica virgifera
  misc_feature (500)..(521): n is a, c, g, or t
  misc_feature (799)..(799): n is a, c, g, or t
  misc_feature (921)..(921): n is a, c, g, or t
aaaatatttattagttttctcaggattcgaaaaaaaagaatacaattaaaacacattgagaatttcgacatgcgtcaaaattttgcattaacttaatgtaaaattctgaactgttgaattccagcttccctaataattattgtacatcaaaggacattagaaactatttgtggaggattgaaatctgtattggaaataactgttaaaattggtctaagtaattaaacatattacaaaattttgtaaaaatgtaatacattttagttttcagcccaaacttaggccacacacaagcaataatattcacattttttaactgtcaatatttttattttatcatttattgtttaaaaacaatacagttgataagataccctcagttgcggagaaaggattaataataaagatttttttattcagtcaatggtgtgagcactgtcagttaaatcgtaacgtgtggccttacttttacacgcataccaattgtggcaaatgtatcnnnnnnnnnnnnnnnnnnnnnngcatttaaatcgtagaacaattttaacttttgattttaatacagatcttaattctctacaagtgttatctcatgacttttgatgtgaaataattagggaagcaggaattcaacagtttagaattttacatcgagtttcctatggccctttttacgattcaccacccggtataagataaaatgtgtactatttgtctaattatttcataataacacaaataatacacatatatacacaataacacacattcaatgatcgaaaatcatttaaaaatatgngaatgtaaactcttgtgacgtaaagtcaaaaatataagtctcccaccaccgtcggacaagacaaccgtaaataagtctaataacccgtgtcaccacccggtatacgctctgagcttcgctgntgtcgctcctagcgggtactaattcaacttt

SEQ ID NO: 16136 - DNA, 944 bp, Diabrotica virgifera
  misc_feature (119)..(138): n is a, c, g, or t
  misc_feature (348)..(368): n is a, c, g, or t
  misc_feature (492)..(512): n is a, c, g, or t
  misc_feature (838)..(838): n is a, c, g, or t
ctccgaaaataaccaggaaggagtaaatacaaaatgaccttgagccgggaaggaggtcgcaaatggcgaccagatgtcagatttgctttccatctccagtgacgtacctttgaaagagnnnnnnnnnnnnnnnnnnnncgattttattacatctttgatgttaaacatgatgtttattttatattctaaggcatataccaatgatacaaaccaaggacgtgtgacgtagatctattaggccttttcgcgctgtataacctgaacgtggccagagggagagcgcctgcgcattacaaaattggactttcaataagatcgaatatttccctgcgaaaacgtaatgcgcannnnnnnnnnnnnnnnnnnnnttcaggataagtgcagggcatgctccacgaataagttaattatgtgacacatgagaggggctcgaagcgaatggcaatcgatgaaaagccccattcaacgccaaaagtctctacagacatgaannnnnnnnnnnnnnnnnnnnntgcattcagcagaaaactgcgatgactaatcgattacttagcgatgtgtaatcgctaacgattcttctgaatggtatacttttatgtgtatacgacaactgtcacatttttcaaaatgatttgcaaatacgtgaaagacaccccaagaacagaaatgaaaattattatgaaatggtaatttataaataaccccatttaattcatacatagtttcaaattcttgaatttcttgcgacataggtaaacctaataggtacatacgaataatccaacaaagcagctcagatatttatcagcgtgatttatatgcctttagccttccttgnctttcattcatgtttttttttaagatacataacttaaaatatacgtgttagacacacgtcatacgtcaatcttatttttgatttgctagtaatcatatttcaaaac

SEQ ID NO: 16137 - DNA, 981 bp, Diabrotica virgifera
  misc_feature (569)..(593): n is a, c, g, or t
  misc_feature (804)..(805): n is a, c, g, or t
  misc_feature (815)..(815): n is a, c, g, or t
  misc_feature (862)..(862): n is a, c, g, or t
  misc_feature (910)..(910): n is a, c, g, or t
  misc_feature (925)..(925): n is a, c, g, or t
ggatatgaagtcggtaggctcattctactacgaaaattttgcattccccgggatggtcccctacaagcggacggcgggcgacaaaagcggcgtccccgtgtaccaaccggcttcagcgacgtaccagcagctcctccagccgttcgtaccggtatcatgtgagtaccgctcatcttctgctgccttcaccggcgttgctctcaacaaagtgattccacaataccaacctattaccaccacggccagttacccgcctaacgtggccacctacccgtccgccgcttctcccttccaattccaagtccgaccacccccgcaaatcccgcagactcccctcatctcggacctcattgccgcccagtaccccagtacacccgtcaacaataacaatgaagacgaattgcaaccgtacaaaaagatgaaaactacttaaaaatttcgactactccccgcgcagttcctaatcagaacgtccaatattacttggaaaaatgatttgtatagaaacctttttctttcctagccggttcccctcagatcggcaaatttttctgttatttgtttttgcnnnnnnnnnnnnnnnnnnnnnnnnnctgtttcaattaagatttttatgataaggtgagttaccgtgaagaggggggccggaaatataaatgcattttggatgtgtttagctagattattgggtggttccgttcttttgcgaagttgagcatgtctacctttgtattatcccctcttgttgcctatcgtggtttgttgttgttgccatttctagcttcactcattgttttttattgnnacttttttgntaagttttgcttttggagataaataaataaacttatttattcattgnagacaccgcctctacattaacagcacagaaaccggaaatacgctcgangtctttcgaatgatngactaatgtgaatcttcattttacatgacgaccgattcgtacttttaaatatctct

SEQ ID NO: 16138 - DNA, 948 bp, Diabrotica virgifera
  misc_feature (12)..(38): n is a, c, g, or t
  misc_feature (554)..(569): n is a, c, g, or t
  misc_feature (890)..(891): n is a, c, g, or t
ggacagttttcnnnnnnnnnnnnnnnnnnnnnnnnnnncatttttgcgttgctcaataaatatatcttcaaaggtatatagggaaagaagaaataaacttaaagtttttggaaactgtccatgtatacgcattgacatagctttttctctcttttacctgtttgttaaacagagttgagaaagcacgaaggtattgatacttatataggaatctttttctaggtgttttagaataattaaggaaacttaaaaagtttccgaaatattttctgtccatttatcgatatttatcaaagtatattatatataaatgtttctcttaagatgttctaaaatttgtctcgacatctgcgcaccctaagttaaggttttttgaagtggaagatatccaaaactttcgattttcttgaattattaatcatatttattgaattaaacaggtattggaaaatatgcggaaacattcataaagtacaactaaagacatttgctttgtagttttttgtctgcgaatgctctaatttaattgtccgtgaattcttaaggaaatattnnnnnnnnnnnnnnnnacaacgaaattcaatataaaaataaagtcaaactttatttcagtgtgttaagccatttctaatgacgtttaaacattaataatgcagatggcgaaagtatagtcattcaaattttccatttgacgtttccatggttgcataaaccaatgacgtttatatgggcctattcatcgccgccatttagtttgtataattggacgggtgacgtacaatatacgtcatatgtcacgtgtacgagaaaatggcggcgatgatagctctatcatacgtcattggtgtaactaagatatcagaaacatactttggacatgacataatggnnttgaccgtagagtggactataaaatattataagcatatattgatacttataaaatat

SEQ ID NO: 16139 - DNA, 79 bp, Diabrotica virgifera
aaatgcctgttaatgcagttctatattgaaatgacaataaattttttatgagttcttgaaaacgcatggaacttatctc

SEQ ID NO: 16140 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16141 - DNA, 366 bp, Diabrotica virgifera
  misc_feature (2)..(53): n is a, c, g, or t
  misc_feature (60)..(89): n is a, c, g, or t
  misc_feature (91)..(238): n is a, c, g, or t
  misc_feature (260)..(347): n is a, c, g, or t
  misc_feature (350)..(350): n is a, c, g, or t
annnnnnnnnnnnnnnnnnnnnnnnnnnnnnnnnnnnnnnnnnnnnnnnnnnntaatatnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgagagacccttatagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnctntttttttatatatata

SEQ ID NO: 16142 - DNA, 749 bp, Diabrotica virgifera
  misc_feature (138)..(167): n is a, c, g, or t
  misc_feature (232)..(376): n is a, c, g, or t
aagggatgattgtttgcttggaacgtgactagcagaacgcaggttgaggatgtgtcaatgtacatttcattcaatgacgtttccttgactgaagaactgatgttcttgtaaatgggactgtactacacacgaatttannnnnnnnnnnnnnnnnnnnnnnnnnnnnntacttgataggatcggctgatcaaaccccggacatggattccgtggatgtatccatgaccccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaccatcatctactgagcggtgataaaaactttgaaaaaaaattgtactgcatttactacagcatctgacaaaagatactcacagcgcatcaaaactagacacgactccctcatgctgaggattgccactacacgatcattgactcacgtactggatgtgctgctgcacatttgcgatacctatttcctgactagcgttctgctggtatgatagaattattacgataattagtaatacctgccctcatcctctatgatgagttgtctgaacaagccgaagactatcgtgagatgtctctgttgcttcttagaactcctaggcgtgactcctatgctgtcgatgaattctagcgtcactctcgtcttttct

SEQ ID NO: 16143 - DNA, 752 bp, Diabrotica virgifera
  misc_feature (2)..(61): n is a, c, g, or t
  misc_feature (69)..(181): n is a, c, g, or t
  misc_feature (191)..(368): n is a, c, g, or t
  misc_feature (370)..(750): n is a, c, g, or t
cnnnnnnnnnnnnnnnnnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 16144 - DNA, 563 bp, Diabrotica virgifera
  misc_feature (7)..(79): n is a, c, g, or t
  misc_feature (81)..(138): n is a, c, g, or t
  misc_feature (140)..(153): n is a, c, g, or t
  misc_feature (155)..(197): n is a, c, g, or t
  misc_feature (199)..(221): n is a, c, g, or t
  misc_feature (250)..(283): n is a, c, g, or t
ccccttnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnnnnnnnnnnnnnnngnnnnnnnnnnnnnnnnnnnnnnnctttaaatcatttacatttagttaccgcnnnnnnnnnnnnnnnnnnnnnnnnnnnnnnnnnntagaagatatagatttaataaaggacttccgcaacactttttttcaccaggatattaaacacatgcctttttggattaactctatagactcgcctggccactgatgaaatcgtctgcaggagtcacttcgaccgcgctatggatgcctaaccatgattatcttatatcgaaagatgataggaacgtttggatcaataacaaaaggtctttatttagttatggaagatcttattgctaacctaacacggtgccctgtctctggtacttcagattctccacg

SEQ ID NO: 16145 - DNA, 747 bp, Diabrotica virgifera
  misc_feature (598)..(598): n is a, c, g, or t
  misc_feature (679)..(679): n is a, c, g, or t
  misc_feature (705)..(706): n is a, c, g, or t
  misc_feature (726)..(726): n is a, c, g, or t
gttttagatgaaaaaaccaaaaatgatatattttcgtacatcgaaagaactgtggaagatgcaaattttttcgaatataaaatagattttaaagtattgccaaatttgtacagatttgaaggtgaacggcttatagtttcgacacatataaagggagttgattatctgaagaacaagttatgtctggatttaactcttaaaataagtgaaaaatgtgaaagtgacaacgttttaaggcaattttttaaaagggagcaataccttttctaacacataacacgctttttaatgcaattatttaggaaaaggaaagtaagatatcctgcctttccttttcccatgtgttttaagatgttttctacagatgacagggatgtgttagtttataataatttgttttcaatgggattccaaccgattcatagtagatcattttcacccattacaattaacgtaattttacgacaattggccgaatttcatgccctttccttttctgcatttgatcagtgcaccgaagagtttcaagaacttttatcaaagtggttaccagatattaaatctttacttgcatccttaaatcttgaagataacttanaaacaggtctacaagttgttgcagatatgttgatggaagaaaaaagatttgatctgaaggagaaaatggagaaggatttanaagatggctttctcgctattgctaanncaagtgtgtcagaagtcccntgagaaagctgtataattcac

SEQ ID NO: 16146 - DNA, 67 bp, Diabrotica virgifera
  misc_feature (4)..(56): n is a, c, g, or t
  misc_feature (61)..(61): n is a, c, g, or t
attnnnnnnnnnnnnnnnnnnnnnnnnnnnnnnnnnnnnnnnnnnnnnnnnnnnnnttggnggtgat

SEQ ID NO: 16147 - DNA, 940 bp, Diabrotica virgifera
  misc_feature (357)..(385): n is a, c, g, or t
  misc_feature (882)..(882): n is a, c, g, or t
  misc_feature (923)..(923): n is a, c, g, or t
ggtgcgcatgccgtatgcacacgtggcaccaacgtaatggatacgtaccttaatactgccagtattaaagacacatgtataaagaaaccagcaaaggaagtagtcagcccatgtttctttgtgaatatgtttcgtttttattagttcgttaatatcttttctttgtcttctaaatcgaaaaaatctaaaaagttaccgatatttggacatctgatgacttcccaaaaaaggtgcaagaagaaagaaaaatactgctaccatatctcagagaagcaagagaaaacggaaaacgagcatatctcagacaaactaaattaattataaatgacaagagctatacagtggaaaactttaatnnnnnnnnnnnnnnnnnnnnnnnnnnnnnctacaaacgctctacaagtgaacgatccccagagagtgataggctaaatgaacaacaaaggaaatttactaaaacagatccaaaaaactagcaagtgatggtcaaagaatggatgtacaggataatggccaggcgtggatacggaaaacgaataagagagcaccgaaaagtaatagaaataggaaattgagaggtataataaatataggaacgtggaatataaaaactatgctagccatgagcaaaatggaagaagtagcaaaagaaatgagtgattataatatagacataatagcattgcaagaattaacatggaaggaagaaggcaggatcgacaaacaaaattacacaatgtactactgaggggaaaatacacaaggtagaaatggtacaggcttcatgataagtagaacatggagagaatatgtattagaatttaaaaaagtaaatggaagaatatcttatttaaggataaataatagagctgctaatatctncatgataaatatctatgcacccacagaacaagccgatgatncagagaaggatgatttt

SEQ ID NO: 16148 - DNA, 73 bp, Diabrotica virgifera
  misc_feature (3)..(63): n is a, c, g, or t
gcnnnnnnnnnnnnnnnnnnnnnnnnnnnnnnnnnnnnnnnnnnnnnnnnnnnnnnnnnnnnncccaattttt

SEQ ID NO: 16149 - DNA, 628 bp, Diabrotica virgifera
  misc_feature (2)..(156): n is a, c, g, or t
  misc_feature (161)..(247): n is a, c, g, or t
  misc_feature (249)..(296): n is a, c, g, or t
  misc_feature (316)..(333): n is a, c, g, or t
  misc_feature (340)..(357): n is a, c, g, or t
  misc_feature (400)..(417): n is a, c, g, or t
  misc_feature (421)..(466): n is a, c, g, or t
  misc_feature (470)..(491): n is a, c, g, or t
  misc_feature (498)..(498): n is a, c, g, or t
  misc_feature (506)..(506): n is a, c, g, or t
  misc_feature (508)..(508): n is a, c, g, or t
  misc_feature (519)..(519): n is a, c, g, or t
  misc_feature (521)..(616): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnngttaatataggaatttcggnnnnnnnnnnnnnnnnnngtatttnnnnnnnnnnnnnnnnnngttaatatatagtctcgccctggcactgagtaatttggatggnnnnnnnnnnnnnnnnnngctnnnnnnnnnnnnnnnnnnnnnnnnnnnnnnnnnnnnnnnnnnnnnngtgnnnnnnnnnnnnnnnnnnnnnntattaantttattangnaatttattttnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaatttatt

SEQ ID NO: 16150 - DNA, 52 bp, Diabrotica virgifera
ccatacagtctcacgtgtgaataatacctaacagacacgtcaaactgtgcag

SEQ ID NO: 16151 - DNA, 608 bp, Diabrotica virgifera
  misc_feature (14)..(14): n is a, c, g, or t
  misc_feature (20)..(20): n is a, c, g, or t
  misc_feature (563)..(584): n is a, c, g, or t
  misc_feature (586)..(598): n is a, c, g, or t
tgtttttgttgtantatttnagtatgtcccataagagggaaagaaagtataagaggctagtcaatgagaactagtgcgcgaatatattatgtttaaaatatacctctctagtgtcccgccacctagagtatcagggaccattaacgacaaaacacccacctattctcctccaatccaaaagagctccccaatgaaaatttttcttgtcaaacaaccatcctaaaccgccctgctgtccggaaacgcaatcccccctcccacaacagcccactcctcaaccaaacccatcaacctcactcaccaacaacacacctataatcacacacccttctactactaacaggaacgagtctcagacatgagctcaaaaacacaattctatccacactcaacgtcgaaacaaacatcacgcccaccgagtcgcacccaccacccaatgcccaccccccccaccacacctcagcaccacccccccacctagacgcacacacgagcacccttccccgccaccacgcgccgcactgaccaccaccagcgaccgaaccacactacgcgaccgccannnnnnnnnnnnnnnnnnnnnntnnnnnnnnnnnnnagcctccccc

SEQ ID NO: 16152 - DNA, 618 bp, Diabrotica virgifera
  misc_feature (2)..(123): n is a, c, g, or t
  misc_feature (180)..(201): n is a, c, g, or t
  misc_feature (203)..(220): n is a, c, g, or t
  misc_feature (240)..(261): n is a, c, g, or t
  misc_feature (272)..(292): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtcccgatattcgttattcttatatccaaatttttaggacataaaattattacnnnnnnnnnnnnnnnnnnnnnngnnnnnnnnnnnnnnnnnncaccccatataaatttgtannnnnnnnnnnnnnnnnnnnnnctatattaacnnnnnnnnnnnnnnnnnnnnntctatagggtcttctcgtcatttaaaaatatgtaagttttttaacttatggataaaaatctttataaattagataaagatagttttattttcatccaacccttcattcaagcattcatttgaaaactaaggattatgctaccgttagtatgttaaagatagcgtgcccattcattttaatctgtgggccggctgagaatttaatattcattacccaaaaaaccgtttctaacaaacacgtcgaaaacaaagttggccgaattccctccattacccccacatcttctaaaaaattaaaccatttcttgacaaccaatcaccatcctc

SEQ ID NO: 16153 - DNA, 447 bp, Diabrotica virgifera
  misc_feature (50)..(50): n is a, c, g, or t
ctcctcgcgtccgctagaactagtcgtttgttttccgtcgacttaggagngaatgttcccaagttttccaccgattttttgatataaaaagtgaaaaatgtcccaagtgaggcagaatttccacaaggactgtgaggatgctattaacaaacaaatcaacgtagaactgagtgctagttatgtctatatgaccatggcctatcacttccatagagatgacgtagctttgatgggattccacaagtacttcaaagaatgttcagaggaagaacgcgagcatgcctaccgcttaatggagtacatgtacaagcgaggaggaaaaattatcttgagcgaaatcaaagctccagaaaagcaggagaggacctcgccaggcgaagcgatggcccctgctcttaatctagaacagggagtcaacgagagcctattacaccaccccaaagtttg

SEQ ID NO: 16154 - DNA, 110 bp, Diabrotica virgifera
  misc_feature (2)..(33): n is a, c, g, or t
gnnnnnnnnnnnnnnnnnnnnnnnnnnnnnnnnaacccccaatgagttttataacaactattaataagcttttttctgaattcaattctatttaattaaataaacttttt

SEQ ID NO: 16155 - DNA, 838 bp, Diabrotica virgifera
  misc_feature (3)..(3): n is a, c, g, or t
  misc_feature (12)..(12): n is a, c, g, or t
  misc_feature (474)..(492): n is a, c, g, or t
  misc_feature (684)..(720): n is a, c, g, or t
  misc_feature (806)..(829): n is a, c, g, or t
tgnatatttcanataatttgaattaaaaccccctcacccggttgcgagccaatggggaggagattccgcatcaggacaaaatcgccatgctaccgaacttaccctcttcagagccaaacgcaaggagcgcgagacaagaaagaacacaccccacacaaacaagcgaccccgggaaacgaagacacacaagagaaaacaccggcaccgacaaagaaacacccaaaaaacgcaaggcaagcggacaagcgcacgcccaaaccaaaaacgaccccacgcaaagacacccacgaccgccaaccaccacaggaccgcggagcagaccgccaagcttttttctcgacaaccgacaccccaccaaacgagcgcccaacagaccccccccttcccatcccacccaccaccaacaaccagcacccccaagcaccccagcgcacccccccacaccccacagcacggacacatacgacacaccgnnnnnnnnnnnnnnnnnnnacgccagccccccccccccccagcccgcccgagcaccacccagacccgaccagacagaggagaccaacgcggcgccacaaagaccaagccccccggccggcacccccccgccccgccccccccaccacaccccccccagacccaacacccgcgccccccccacaccgccacccccaccccccccaccgccannnnnnnnnnnnnnnnnnnnnnnnnnnnnnnnnnnnngccccccccctggacacgaaccaaacgccccggccccaccaccaccccccccccgtccctccaaccacagcccgaacccaccacannnnnnnnnnnnnnnnnnnnnnnnaccgcccca

SEQ ID NO: 16156 - DNA, 691 bp, Diabrotica virgifera
  misc_feature (2)..(578): n is a, c, g, or t
  misc_feature (580)..(607): n is a, c, g, or t
  misc_feature (609)..(642): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnngnnnnnnnnnnnnnnnnnnnnnnnnnnnnnnnnnnccattatgaacgtgctagggtagaataatcattagtgtgctttattgaa

SEQ ID NO: 16157 - DNA, 481 bp, Diabrotica virgifera
  misc_feature (5)..(73): n is a, c, g, or t
  misc_feature (77)..(235): n is a, c, g, or t
  misc_feature (237)..(272): n is a, c, g, or t
  misc_feature (276)..(302): n is a, c, g, or t
  misc_feature (338)..(356): n is a, c, g, or t
ctccnnnnnnnnnnnnnnnnnnnnnnnnnnnnnnnnnnnnnnnnnnnnnnnnnnnnnnnnnnnnnnnnnnnnntttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnttgnnnnnnnnnnnnnnnnnnnnnnnnnnnagtgatcaaaaaaaaaatttgcctagattcataacnnnnnnnnnnnnnnnnnnnactcgagcgaaatgtcttcatagtatcataagatgagcctaaaaagattcctgctacttcagtcaaaaagaaagcaccaccgggacccacaccagtctacaacaaattgctcaaaagaaagaaag

SEQ ID NO: 16158 - DNA, 836 bp, Diabrotica virgifera
  misc_feature (51)..(73): n is a, c, g, or t
  misc_feature (106)..(139): n is a, c, g, or t
  misc_feature (185)..(205): n is a, c, g, or t
  misc_feature (239)..(264): n is a, c, g, or t
  misc_feature (335)..(353): n is a, c, g, or t
  misc_feature (383)..(430): n is a, c, g, or t
  misc_feature (438)..(452): n is a, c, g, or t
  misc_feature (454)..(477): n is a, c, g, or t
  misc_feature (494)..(516): n is a, c, g, or t
  misc_feature (701)..(724): n is a, c, g, or t
  misc_feature (757)..(775): n is a, c, g, or t
  misc_feature (778)..(790): n is a, c, g, or t
  misc_feature (799)..(834): n is a, c, g, or t
gtagcaaattgaattaaatatatgatttatagtaaatagtactgtgaaggnnnnnnnnnnnnnnnnnnnnnnntagctaatttgggcttaccttttgtatcagggnnnnnnnnnnnnnnnnnnnnnnnnnnnnnnnnnnccgaaattttaagatatataataaaattacatttaatgttttaagnnnnnnnnnnnnnnnnnnnnngtgaatatattttattcaattaaaaatatctggnnnnnnnnnnnnnnnnnnnnnnnnnngattattttaagtgaaatattatattttgttataatcttcaattttctaggataagctagattatttttcnnnnnnnnnnnnnnnnnnngaatttaaggtaggtttaataatatccatnnnnnnnnnnnnnnnnnnnnnnnnnnnnnnnnnnnnnnnnnnnnnnnngttttagnnnnnnnnnnnnnnncnnnnnnnnnnnnnnnnnnnnnnnnaattatgataaaattannnnnnnnnnnnnnnnnnnnnnngtaattcggcaaatgttattttcgcctgtttaacaaaaacatggtcttttgtttatataaaagatctaacctgccctatgatttattttaaatggctgcagtattttgactgtacaaaggtagcataatcatttgtcttttaattgaaggctggtatgaatggttggatgaaaaatatactttcnnnnnnnnnnnnnnnnnnnnnnnntttttagtcaaaaggctaagattttattgtagnnnnnnnnnnnnnnnnnnnacnnnnnnnnnnnnntatataacnnnnnnnnnnnnnnnnnnnnnnnnnnnnnnnnnnnnat

SEQ ID NO: 16159 - DNA, 836 bp, Diabrotica virgifera
  misc_feature (5)..(26): n is a, c, g, or t
  misc_feature (131)..(153): n is a, c, g, or t
  misc_feature (207)..(228): n is a, c, g, or t
  misc_feature (250)..(269): n is a, c, g, or t
tctcnnnnnnnnnnnnnnnnnnnnnnattggaatgtttcttactaaccattccacataataagacggtatttacttaatataaaattggaacaaggaaggagaagggagttcgtctttgaccccaaattcnnnnnnnnnnnnnnnnnnnnnnntatagggaattttttttattccaagatataaggagatctagaatgatattaaannnnnnnnnnnnnnnnnnnnnntgaaaattgaaaatatttctgnnnnnnnnnnnnnnnnnnnnacgttgtggcccaaatttacccccttggacatccgaaggttaaaaacatagtttaattaaatttcatttgtttatacttatgtaaggattctttaaagacaatcgtaataaaagtccgtgtgatgtttaacagttttaattaataaaatagataactaaattattgatactattaaattgatgaaatgtaaaagtgtttgtgtaattgcgactaaaattttacgagttcttgttcttacaaaaagaaatgtatttagagataagtaattgcgtctaaacaatattataacttgcttgtcataatataagcacgtcttaaagggtctttttacgtcttatccccaagaacccgactgtcgccgttctcatcttaaaatcgactgccacactaactaactaagcagaacagtctcctgtcttcccctcttcatgcttaaaatccgaaactattaaaattctactgccataaatttcgatccctattaagaataaaaattgattcacagaggcgaatgttattctttacttataaaggttaaaagaagcccgctaccgtcgcgccgaaat

SEQ ID NO: 16160 - DNA, 75 bp, Diabrotica virgifera
  misc_feature (11)..(39): n is a, c, g, or t
ggtatcagggnnnnnnnnnnnnnnnnnnnnnnnnnnnnnttttcttaatatataatagtgtaaaaaagaatatac

SEQ ID NO: 16161 - DNA, 60 bp, Diabrotica virgifera
  misc_feature (2)..(19): n is a, c, g, or t
  misc_feature (21)..(34): n is a, c, g, or t
cnnnnnnnnnnnnnnnnnncnnnnnnnnnnnnnnctttcttattgccagctggaaggcag

SEQ ID NO: 16162 - DNA, 450 bp, Diabrotica virgifera
aagttgagatagacatgcccatcgctatagttcattttagtacccatcatataagacaaaatcctatgaatattttttggcgattagatattatacataatcgtttcttaagagggaatctattcgaactttgtgaaaagaagatcatttctataatgtagacaatatttatacaaaaatcaaataaaagtatatcttgctgctaatattgttatcattaactttaatgaaagagcatacaatataaaaagaacttaaaactactcctacaagtcgagaagaatgagtgccgatgattatgctgtactgtgattagcgctaatacagactgagctaagactcgtactgattaattagagggacttccttagtcgagagcaagatcagccaacaaagacactgatatgaaaacgtgagcaggtattcatgaaattgaaggcgcactatcca

SEQ ID NO: 16163 - DNA, 885 bp, Diabrotica virgifera
  misc_feature (2)..(46): n is a, c, g, or t
  misc_feature (53)..(744): n is a, c, g, or t
  misc_feature (746)..(763): n is a, c, g, or t
  misc_feature (806)..(826): n is a, c, g, or t
  misc_feature (839)..(879): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnntttacattttttttaaaagacggagaagacccctataagaggnnnnnnnnnnnnnnnnnnnnnggtttttttaagnnnnnnnnnnnnnnnnnnnnnnnnnnnnnnnnnnnnnnnnnggggga

SEQ ID NO: 16164 - DNA, 107 bp, Diabrotica virgifera
  misc_feature (3)..(85): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnnnnnntaataaagcctaaattttttta

SEQ ID NO: 16165 - DNA, 563 bp, Diabrotica virgifera
  misc_feature (10)..(28): n is a, c, g, or t
  misc_feature (59)..(59): n is a, c, g, or t
  misc_feature (76)..(76): n is a, c, g, or t
cctcctaggnnnnnnnnnnnnnnnnnnncggagaggagccagcgtatgtgtggtagagnggaggaggagagagaangttttttgaggatgtaggaggggagaaaaggaagatttttcttttagaaaagtggaacctacgaaacgggagaagagaaggtccaaacgatgtacgaaatgcgaagcgatggggacagctatgaggcagaaacaaaaaaagcagcgatagcaggagcagaaaacggaaaagaataccggaaagggacgtatgaaactacacctaacaaggatgaatccaaaagagcagagaacaatgtagaaaaaaccagagagaagtagatttttttttcaatagggctaacatcgatgtgttgagaagcgggaaaagaccaaaagaaattacataatacatgaaaacgtcgacaagcagaggaagaacaagccccgtgtaaaacgacgatatcgaatagacccaggtgcgaagacaaccgaaatctaacagcgtatttcagctaaaacgaaagaaatgggttgcagatcaaccgacaatgaaaaaccacagcaga

SEQ ID NO: 16166 - DNA, 576 bp, Diabrotica virgifera
  misc_feature (255)..(275): n is a, c, g, or t
  misc_feature (413)..(439): n is a, c, g, or t
aaaatttggtaacaccaatacgcggtttcagagccatcgttcccgcaaaattttcagagacgatccagtcaaagatcctactatcgttgccactcacagaagtggtaaacggcgcggcgcacggtaagggcacagtataataaatatggaacctctttatactgtgcaaccgattttacataaactcgctgatattttcgtgcgtctagttggctattttactgaattaggtagatactattaacaaatatttcnnnnnnnnnnnnnnnnnnnnngaattatttcatagtagtcataaaatatttatttacaaattttaactgttaccaatggtaacaatggttacatggacgcttcgccagtgcttaggtaccatccgtattcatattcatttcagataagtccatgtcgcnnnnnnnnnnnnnnnnnnnnnnnnnnntggcggtgagtcacgcgtcccaagaaaactgtacgccgatgacaaacgttcccaagcgagacctgcgaacgaatgaactgatagtatgatgcgcagaactgtctacgcagttcgccggtgcaggttgcgactcgctt

SEQ ID NO: 16167 - DNA, 396 bp, Diabrotica virgifera
  misc_feature (20)..(20): n is a, c, g, or t
ctctccgcggccgggagggncgcacggagaggagcgggaaccttttccggcaccgacgcgacgccagggacgaccagaagggaggccggcacccgggaggaacccccagccaaacgtaaccacagcagggacagccgagcaaggggacgaggggggccccggccccacgacaggcaccgcacaggaaccgacgaccaggcaaaaacgaaaaaagacacaccagcagagccaggaacgcccacaaacaaagcgggaggacacaaagaggggacggcaacagacaaacgcagcgccacagccagcagaaaggcgaagaaagaagacgacaaagaaaaactttgagcaagaagccaaaagaaacgggacgagaacaccaggaagagcaaaggggccgaa

SEQ ID NO: 16168 - DNA, 1014 bp, Diabrotica virgifera
  misc_feature (2)..(795): n is a, c, g, or t
  misc_feature (815)..(852): n is a, c, g, or t
  misc_feature (977)..(999): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaccttagggataacagnnnnnnnnnnnnnnnnnnnnnnnnnnnnnnnnnnnnnntgcgacctccgatgtggattaagtttataattgtgtagcagctatataattaagtctgtccgacttttaaaattttacttgatcgggagttaaaacccgggtggagccagggtgggttccaattnnnnnnnnnnnnnnnnnnnnnnncagaaccaaaggccc

SEQ ID NO: 16169 - DNA, 386 bp, Diabrotica virgifera
gaacatttaatgcggagtttgatcagtgcagtgttcttgaacattgaacacgtgtttctcaatttaagggtgtcaccctggattattttgaattcactaagactgcacattttgtattgtggctttataagtttgataggttccgctgtggaggtgcatgattgttttgtgcaagttgtcaaaaccttttggtctattaaatgctttagatttgtaacttaccgtttgtgacgcatgaggagggtgagtgacgcggtacttacatgcaaataggattagacaaactttacgtctcttttaatgtacctcccctacctccctcacacactgtcttaaacatccgctccttgactcgtgacgtgcatgcgcgacacatataacatact

SEQ ID NO: 16170 - DNA, 683 bp, Diabrotica virgifera
  misc_feature (2)..(18): n is a, c, g, or t
  misc_feature (21)..(33): n is a, c, g, or t
gnnnnnnnnnnnnnnnnncannnnnnnnnnnnncattcactattttcctattactatcataaacttttaccagctgtacgctctctagtcccataaatactgttaatatcgcccttataaacaatcttcaagacgataccttgggacaacacatagaaatcggtatagaaagtgtattaacagaaccaatctcttgctcaaaacaacatagactgtcagcatcggctgacgacccgtgctaatactaacaggccgagtattaaccatacttgtagatacaagtcctgtgaatactgagaaaattgatgttatgcccaaacattgacctaaacgactcgtttattcttgaacagacttaccatgacagtccaaactttggaataaccattccaatcttatttaaagacctttaacacgccttcaccgttaaaacatcctgagaccttccattttctaaatttgtagtcacatgtctttcttcccttatatacaaaacaagatttttaccactttttgtgctaacgggtccatatggccctgctgccacctaccttctgcacaccacccccaccccctttaccctctgctttccttgccacttcctttctcttctaccaaaccgaaacctccccaaggcactcccaacctccccctttctttatcccattctttattttccaacc

SEQ ID NO: 16171 - DNA, 413 bp, Diabrotica virgifera
  misc_feature (2)..(21): n is a, c, g, or t
  misc_feature (31)..(50): n is a, c, g, or t
gnnnnnnnnnnnnnnnnnnnnatgaggaacnnnnnnnnnnnnnnnnnnnngtaggaacaaataacgtaaaaaattattgtaagggaacgtgtgcaaatcttatcgtaaaaaatgaatttaaaggagtagttgacattgatgaaaaatctaaatataattagattgatgcacgaatctggtaaacatgatgttttgagatgcctcagtagatcaaaaggacttactaatacatgaaaacgttaagaagctgattaagaacaactcccattgtaatgaaattagtgaataaacccaggtgcgaagatccgcagaaatgcgatagaatatttcaactaacatacagacgactgagttgtcgatcaacttaattggaaattctcatagagaactgaagttcaaagacagtatacatg

SEQ ID NO: 16172 - DNA, 880 bp, Diabrotica virgifera
  misc_feature (496)..(508): n is a, c, g, or t
  misc_feature (511)..(523): n is a, c, g, or t
ctcctcagcgtccgacattttgtaaaatctaaagatgtcatgtatatatttttcattattacacaagacagttaaaaataataattgtgtagctattctattaagaaattattcaagaaaagtcggaagtggaaataacagtgaaagtccatacaaatatgttaaatcaaaacaacctatagaagattcttgtaatttggtttggcgtgacccaagttttgaattattggctgcaaatgagtttcccttgtttttgagaggtaatattggaattgcttggtatgatactcaaacaactgtcagatctcaacatgagttgataatggaacaaatagatgacagttcttgtgaacaaggagatatggtagtcagaattcagacatgtccaaccttacttagacaaatagcaaaagatttattcccttatagaactttacaagataatggagaattatctgtgattacagttgctttgaaaccaaatattaaggatttnnnnnnnnnnnnngannnnnnnnnnnnnagattagctcagacatttttaattgctgccaaaagtatttgtgataaattaagaaatgttggttattgggcagattttataaacccattttccggacgtccttattttgctccttcggcgttacgggaactttaccaaaacgatgagaaattcagatgtttagattttcagatagtcgaaaataaagattgcaaagtgatatcgaacgaagacagtggtaaaaaacattttataggtagtttattcacaaatgcacccctcaataaagataaccctcattccattttttgtatgaaatgcgtttttaattttttgatgttgattgtgttgaattcataaaattatttttccttgttc

SEQ ID NO: 16173 - DNA, 871 bp, Diabrotica virgifera
  misc_feature (297)..(319): n is a, c, g, or t
  misc_feature (837)..(856): n is a, c, g, or t
cccacgcgtccgggccaacgaaaagattgataaagaagaaattaggaaaaaattgactcctctgcagtatcatgttacacaggaaaaaggaacagaaagacccttcactgtaggtgcaaaccttttactcctcattacccaaccagggagaatcagaaccgaggtgacctgcgcagaatgtggcgcccatttgggccatgtcttcggggatggtcccccaccgaccaggaagagattctgcatcaattccgcatcattgaactttataccccacgagaagaaagacgaaagctgaannnnnnnnnnnnnnnnnnnnnnncgttgacctaatctgtaaactgcgtaactccataattttctgaaaatctgccatctgtttcaaaaggtccctattatcgtctaaaaaaggtagcacatatgcatatttttaccagatgagtaaatagcgacctcttcgtatacaccgtatctcccttatcgccaaatttagtacgaaaaattcgtaactctctagtttgtcatcccacacgacaagaaaaagttggtggtaatattaaatacttatacttatatacaatatacaaaatgttagtaatatgtgcgtatctataaaatatttccgttttaccatcctatcttttaaaatgggagatacgtagtattcgcattagtctttggagagatagttttttgcgactcctgtaaaattttgataatggagttaaacagtttacagatttggtcgacgaaatgctaactctactttaagcgattttcgaacttaactattttgtgaccagtcttaaataaattatgtgtaagattataaaggtttcnnnnnnnnnnnnnnnnnnnnagagatgtttttacg

SEQ ID NO: 16174 - DNA, 736 bp, Diabrotica virgifera
  misc_feature (20)..(38): n is a, c, g, or t
  misc_feature (642)..(701): n is a, c, g, or t
gttgtcggacgtcggacgtnnnnnnnnnnnnnnnnnnnacaatatgaaaatacattcattaatgtaatttaatttatttgtgattaaagaatcataaaatcaacaagatgtccgttgtaattgtaacaactttgggagatattacagtcgatctgtacctgaatgataggcccagagcctgcctgaattttctgaagctatgcaagttgaagtattacaattataacttattccatactataagtcgtggatttatagctcaaactggtgatcccactgggtctagaagtggtggatcctctatgtatggactactagatggcccaaataaaagatattttgaagctgaagatgaaccaagaattaaacatacaaagatgggacttatttcttttgttggaaatgaagatcacatgattggatcccagtttttcttcactttgggcgaagacttaatatatcttgatcagaaacattgtgtctttggagaagtagttgaaggaatgagtgttttagaagaaatcaatgaggttatttgtgataatgatgattgcccttatcaagatgtaaggatcactcacacagttattctaagtgatcctttcccagacccaaagagacttgtagtaccatccagatcannnnnnnnnnnnnnnnnnnnnnnnnnnnnnnnnnnnnnnnnnnnnnnnnnnnnnnnnnnnagaaacagaagggaagacagttcaacaattgctga

SEQ ID NO: 16175 - DNA, 996 bp, Diabrotica virgifera
  misc_feature (429)..(449): n is a, c, g, or t
  misc_feature (568)..(594): n is a, c, g, or t
  misc_feature (671)..(688): n is a, c, g, or t
  misc_feature (842)..(858): n is a, c, g, or t
gtaagtttgtgcgggagaatcgagtcggaatgatttcgctatcgggggtgacgattagtgatgttgaaaaagtaactattcgttacaaagtactcgttacttacgaataccgaaagtaacgattactatacagagaggtaactcgttactttgattactttgattactctgattacttcgtaccaatcgtatcagagcgagtacccattttgattttgagtattgtatctattcggttgatatcggagtcggaccggtattccacgagtgttcggtatcagtacagttaactaaaattttatctatgaagggcgaaggctatgaagagttttataggattacagggcgctgagaagtagctgaaacagagggaggtgtatcatttaacaaagcatgtttaaaaagttggactgcattaaaataaatggnnnnnnnnnnnnnnnnnnnnntcaaattgtggagctcatttttggattttcttgaggatcttccttttcctccatgtaatttgaaaaagataagagatacgaaaaacaaataccacacaaaaatgtaggacttttttggnnnnnnnnnnnnnnnnnnnnnnnnnnnactgtatctcttatcattttcaagttacatggaggaaggggaggatttttaagaagatttgaaaatgcgctctatannnnnnnnnnnnnnnnnnaaagccattcattttaaacccctccaacttttttaacatagaaataacactataataaaagggattgtggaagaaaaagatgcatttacatttttggtggatgggggttaaaattatttctcatttttcttaaatacattacttatcaattttnnnnnnnnnnnnnnnnngttagttttaaggtaatggggctttaatatagttcattttaaaggaatttttcaagcactacaaaagggattgggaggattaatccacctaaaatccaacgggttttctgttatttaagggtgaaaaaaggaaatttg

SEQ ID NO: 16176 - DNA, 752 bp, Diabrotica virgifera
  misc_feature (289)..(307): n is a, c, g, or t
cttcgttcgaggtacgcgcacgaaatttcgaggattctccgggaggtccacattttaaagacctccaatttatttaccgttgacgttttaaggctccacgtctcaaccgcatagaaaagactcgaccagacgtagcattttgataaacgtagttgaatttcgagttttattcgagaatcgcagtcttttgatttgttcgaaatattttctcttctattcttaatctttctggattctcaatatttctggaccaggatttaggttgctctcgattcaacatcccaggtannnnnnnnnnnnnnnnnnnctaaaatgggtccgtttattgtgcaaggttgaggtacattttggattttacgaattaactttggttttcttaatgttgattttcataccaaattgctcacataggtcctgtcgatgagtcgttgtagacttagtccgaatcaacaattttaatacaataattaattggcagtaaattgtttagtggtcgacaggctaggaaaaaagcttcattgcttctctttgtgagtgtactgcattatagtccgtccgctataacttttcccatgcggtgcgattggttttcaatcaaattgactcaaaacagaaagtgaaacgtacgccgatgtgtgtagtatatagtatacagtatacaaaatgtatacacacatcgacgttcgtttcaatttatgttttgacttggtttgattgaagatggattgtggcgcatgagaggggttatgccg

SEQ ID NO: 16177 - DNA, 89 bp, Diabrotica virgifera
gaaaaaaattacccttaaggaaaacccccgaaaatttttttgggaggggtcccaatccgaaaaaaaaagatggcgccccccccccgggg

SEQ ID NO: 16178 - DNA, 988 bp, Diabrotica virgifera
  misc_feature (62)..(82): n is a, c, g, or t
  misc_feature (150)..(210): n is a, c, g, or t
  misc_feature (888)..(909): n is a, c, g, or t
  misc_feature (911)..(924): n is a, c, g, or t
gaacattgtgggacttaatagcagtagctgtagcaatagccttggtagttcagagtagattnnnnnnnnnnnnnnnnnnnnncaccattaaaaaatcaattaagcttagacaagtcaatacaaaacataaacacacctaatctgtatttnnnnnnnnnnnnnnnnnnnnnnnnnnnnnnnnnnnnnnnnnnnnnnnnnnnnnnnnnnnnnatctgttgagtgtcaacaataaacaaaagtaattactttgactagggacaagaaagattttacccactggcaaaatcaaagtacaatttttataaagttgtgtacaaaataattacatttcataactactaactcattagtttaaaagtttactctaaatggtaagtccaatggtttgaacctctttaacctacgctgttcttgggaattgtctaggaggttaagtgcaaactggttttcatgatcctccaacttggcaatgtaagcagcgctacgttttgtgatgacttcttgtaccgtatcagttttaaggtctcgatgaataattctgttgttgatgtaccaaggtgcattagtgatggttctgagggtttttgattggaagcgttggatgatttcgatgttggagtgactggctgttccccatagttccaacccatatgtccagattggcataagtattgccttatagagcagcaatttattatccagagatagtcttgatgaacggcccattaaccaatacacatttctgaattggagacctagttgctttctcttggtccagatatgtttcctccatgtgagacttctgtccaaatgaataccaagatattttacctcaattaccgcatattactcgaacgcaaacttttccaattacttattagcccaaannnnnnnnnnnnnnnnnnnnnngnnnnnnnnnnnnnngtttatttccgtcggcaagaattacaaaaaggttaaggttggggtggaaaaaaataaacggaac

SEQ ID NO: 16179 - DNA, 244 bp, Diabrotica virgifera
  misc_feature (2)..(3): n is a, c, g, or t
  misc_feature (30)..(30): n is a, c, g, or t
cnntcccctaagcgcccggaggcatcatgncgcagagatcggaaccccctttaaacggaacgaagaaaaacgcagagagagaaaacaagaagtatctacgatggttttccctcacagaatgccttcagagggatccgcacgttgaccctatcgtacaataaagaatgaaacgctcgctagtgagctacctcattaatccaaatgcttagagaaagttcggccgattgacggcttcctcacgacg

SEQ ID NO: 16180 - DNA, 816 bp, Diabrotica virgifera
  misc_feature (635)..(635): n is a, c, g, or t
tttagaagatgtgggagaagacctagaacaagttgaagttatgcagaagaaattcgacgatttccaaacagatttgaaagcaaacgaagttagattggcagaaatgaacgaaatagcgatgcagcttgtctcgcttgatcagaccgaagctgctatgaagattcgaactcaaatagacgatttgaataccaagtggacagacttgcaaaagttgacatctgaaagagccaaccagttgggatcagctcacgaggtccagagattccacagagacgttgacgaaaccaaagattggatcactgaaaaagacgaggcgttgaataacgacgatcttggtaaagatttgagaagtgtacaaaccttgcaaagaaaacatgaaggattggaaagagatctagctgccttaggcgacaagatcaaacaattggacgacaccgccaaccgtctggtaaactcccaccccgaaagcgccgaacaaacgagactcaaacaagaggaaatcaccgaactatggacccaattgaccgcgaaagcaaacagccgtaaggaaaaactgctagactcctacgatctccaacgattcctcaacgaccatcgcgatctgttggcttggatcagctctatgcttgcgttgngtagttccgaagagttgggcaacgacgttacctgccgcagaaacttttgatcgaacgccaccaggaacatcgcacctgaaatagacgcacgcgcaggacccttcctgcacctcgacaattcgctcaacagttgcttaaatcgaattcactatgtatgcccccaaacaccaagaacacttcc

SEQ ID NO: 16181 - DNA, 1001 bp, Diabrotica virgifera
  misc_feature (13)..(884): n is a, c, g, or t
  misc_feature (886)..(929): n is a, c, g, or t
  misc_feature (936)..(956): n is a, c, g, or t
  misc_feature (962)..(982): n is a, c, g, or t
  misc_feature (985)..(1000): n is a, c, g, or t
cctctcgcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnggggcgnnnnnnnnnnnnnnnnnnnnnctttcnnnnnnnnnnnnnnnnnnnnncannnnnnnnnnnnnnnna

SEQ ID NO: 16182 - DNA, 70 bp, Diabrotica virgifera
  misc_feature (18)..(55): n is a, c, g, or t
acctttagggataacagnnnnnnnnnnnnnnnnnnnnnnnnnnnnnnnnnnnnnntgcgacccccacgtt

SEQ ID NO: 16183 - DNA, 399 bp, Diabrotica virgifera
  misc_feature (2)..(98): n is a, c, g, or t
  misc_feature (100)..(132): n is a, c, g, or t
  misc_feature (142)..(232): n is a, c, g, or t
  misc_feature (234)..(251): n is a, c, g, or t
  misc_feature (297)..(327): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnatcatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnncgagagaccctatgagttttataaatattaataggtttttttagcnnnnnnnnnnnnnnnnnnnnnnnnnnnnnnnggtctgttaaaacatacttacctttattaattattctttacccaaaaatttctttcccctaatttttttgat

SEQ ID NO: 16184 - DNA, 1079 bp, Diabrotica virgifera
  misc_feature (2)..(877): n is a, c, g, or t
  misc_feature (879)..(1003): n is a, c, g, or t
  misc_feature (1043)..(1060): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaggaaaaaaggggaattttttttgggaaggtccaannnnnnnnnnnnnnnnnnacccccgagggggggttta

SEQ ID NO: 16185 - DNA, 165 bp, Diabrotica virgifera
  misc_feature (73)..(108): n is a, c, g, or t
gtagttaggattgagagaggagagttatttttataacatgatcattcatgttttggtccctgggccctggggnnnnnnnnnnnnnnnnnnnnnnnnnnnnnnnnnnnncgttaaaaagatagattagtgaaattttgattgttttatggataattacaagatatt

SEQ ID NO: 16186 - DNA, 534 bp, Diabrotica virgifera
  misc_feature (146)..(164): n is a, c, g, or t
cggaaacttaaggtgtctgatacgatacgtgcccgacagtgtgaattgttctatttaaaatcattaaatcgtatttttgggaaactaaacgctacgtactggaatcgctacgtgcatgataatatgcaccaaccttaaatgttaannnnnnnnnnnnnnnnnnncatgataatatacaccgacctttaggtcgaatcgattcgaaattgaccatctgtcttttattttacattaacatttacgattagaaatattaatacccataacaatcaatattcttaccagtcgatttactgtgtgaagttcccattggtaattaataggtgcaacttaatattaatgcatattactgtatatgagtacatgtcatattctttaaaatgttttagtctatcgtatcataacataagcaaccaatccatctaagtttcttacggatttttcaaatacatatatcatggactaattgctaattgttattaaactaggatactttaagcacaaaaactcagtcattgaggtgttactttttat

SEQ ID NO: 16187 - DNA, 732 bp, Diabrotica virgifera
  misc_feature (14)..(42): n is a, c, g, or t
  misc_feature (46)..(533): n is a, c, g, or t
  misc_feature (540)..(577): n is a, c, g, or t
  misc_feature (597)..(610): n is a, c, g, or t
  misc_feature (613)..(635): n is a, c, g, or t
  misc_feature (643)..(665): n is a, c, g, or t
  misc_feature (695)..(726): n is a, c, g, or t
cccttcgcgtccgnnnnnnnnnnnnnnnnnnnnnnnnnnnnncttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16188 - DNA, 460 bp, Diabrotica virgifera
  misc_feature (142)..(178): n is a, c, g, or t
  misc_feature (189)..(355): n is a, c, g, or t
  misc_feature (384)..(407): n is a, c, g, or t
  misc_feature (417)..(438): n is a, c, g, or t
cccctcttcgggcccgcgaacaacaaagacagaaaaaggaaacctttttttacggaccgagagcaaaggaggacagagagagagaaggagacgcgaacaaacgacaaacgaaaaagacgtttcttgtgtatcaggcattagnnnnnnnnnnnnnnnnnnnnnnnnnnnnnnnnnnnnntggagctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgagtttaaaaatagaactctattagnnnnnnnnnnnnnnnnnnnnnnnnccatcaaaannnnnnnnnnnnnnnnnnnnnnctattacttactactatcaatc

SEQ ID NO: 16189 - DNA, 456 bp, Diabrotica virgifera
  misc_feature (309)..(331): n is a, c, g, or t
ccaaagtttaataccttcatgaaatatgcacgagtagaattatcacctcccacaccagcagacattccgcaaatcagagctggcattggccgacttatcacatcagcaagaactggtgcctggaaaaatcaatctgtaaaagaggcttggttgaatacccttgtcggtatcgaagttttatgttggttctatgttggagaatgcattggaaaacgtcacattgttggatatgatgtttaaatcatatttaggtttatttaactttttgtagaatattctttgttcaatagataactaattaatgtctcnnnnnnnnnnnnnnnnnnnnnnnctccttaaatttaaatggattgtttgtaaatgtatcattcttattttttcatatatgcctgtgtaataattcatgactgtatctgatgaattcaataactagagctaattatataattatcattc

SEQ ID NO: 16190 - DNA, 179 bp, Diabrotica virgifera
  misc_feature (3)..(68): n is a, c, g, or t
  misc_feature (74)..(130): n is a, c, g, or t
  misc_feature (138)..(158): n is a, c, g, or t
aannnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnntcccactnnnnnnnnnnnnnnnnnnnnnttcaccctcaagggaaaacac

SEQ ID NO: 16191 - DNA, 865 bp, Diabrotica virgifera
  misc_feature (7)..(811): n is a, c, g, or t
  misc_feature (813)..(863): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnga

SEQ ID NO: 16192 - DNA, 620 bp, Diabrotica virgifera
  misc_feature (2)..(102): n is a, c, g, or t
  misc_feature (104)..(135): n is a, c, g, or t
  misc_feature (227)..(248): n is a, c, g, or t
  misc_feature (254)..(312): n is a, c, g, or t
  misc_feature (334)..(354): n is a, c, g, or t
  misc_feature (360)..(405): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnctattatttaccgctgaaaaaagtactatttttataaaaaaacaaacatactaaataatttttctgtaatagaaatgctattcgtttttacnnnnnnnnnnnnnnnnnnnnnntaaagnnnnnnnnnnnnnnnnnnnnnnnnnnnnnnnnnnnnnnnnnnnnnnnnnnnnnnnnnnncattcttagggatgagctgagnnnnnnnnnnnnnnnnnnnnncaactnnnnnnnnnnnnnnnnnnnnnnnnnnnnnnnnnnnnnnnnnnnnnnagtaatctatttttatatactattatccttcatgttttataaaccagtcatcaccatataagtctcaagtatactaaagcttagtaatgatgataacattaggacgataaaattgcagatttagtaaaaacatcataggctaacaacaggcattcgccaaccgtcttttcacctgtgtatcagaaacacgagcttttcgtacaaaatataacacc

SEQ ID NO: 16193 - DNA, 575 bp, Diabrotica virgifera
  misc_feature (2)..(354): n is a, c, g, or t
  misc_feature (356)..(482): n is a, c, g, or t
  misc_feature (488)..(505): n is a, c, g, or t
  misc_feature (507)..(535): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagnnnnnnnnnnnnnnnnnnannnnnnnnnnnnnnnnnnnnnnnnnnnnnctttatttaaattataaacgaactttatttttaagtgaaa

SEQ ID NO: 16194 - DNA, 835 bp, Diabrotica virgifera
gaaaatttgattactgatcctaataggtcaattgctacactggccattactactcttttgaaaacaggtgccgaatcttctgttgacagactaatgaaacaaatcgctacttttgtatctgaaatcagtgatgaatttaaagtggttgtcattcaggcaattaaggtattagctttgaaatttccaaggaaacatagcacgcttatgaatttcctatccgccatgttaagagatgagggaggtttagaatataaagcatccatagcagataccattataaccctaatcgaagataatcccgaagctaaagaatctggtttggcgcatctttgcgagttcattgaagactgtgaacatgtttctttggctgtgagaatcttgcatttgttaggaaaggaaggacccaagaccaaacaaccatcgagatacatccgttttatctacaatcgcgtcatattggaatgtccttctgtaagagctgctgcagtctccgccatggcacaattcggagcctcttgtcccgatttgttagaaaatatccaaatattactttcgaggtgtcagatggattcagacgatgaagttagggacagagctacatattatagtaatatacttaacaaaaatgataaaagtttatacaacaattacattttggattctttgcaggtttcaattccttcactagaaagatcgcttagagaatacattcaaaatccaactgacgaaccatttgacattaagtccgtacctgtagcagcagtgccaacagcagaagaacgagaagttaaaaacaaatctgaaggactgctagtctctcaaggtccagtccgac

SEQ ID NO: 16195 - DNA, 893 bp, Diabrotica virgifera
  misc_feature (126)..(140): n is a, c, g, or t
  misc_feature (724)..(742): n is a, c, g, or t
  misc_feature (793)..(793): n is a, c, g, or t
  misc_feature (803)..(823): n is a, c, g, or t
aaaaatttatcgaaaaccgacataatgagatcagtaatagttctttttgcaattatttgcgctatatcactagcgacagttattgctcagaatgcagatcctgcagtggatgttgcagatcctgcnnnnnnnnnnnnnnnagcatctgaaccatgtgtaaatgatgatgatgtgtatcctccagacgaaccttttccagacattccagcaaatggtactactcgaaacggaaccgaagtggtaaatcaaaataccacagttcctcaaaacagcgaaccagaagggtcaggaaatggtgaacaggaaattaatggtaatgctgataaccaaactgatgctcctcaaccaaatgatgataatactacagcagaaaatagtacagatggacaaacagatgctccacaaggtaacgaaaatggagctgccgctgaaaacaatgcccaatcagatgcccaaactgatgctgcacaagggaacggcaatgaggcagctgcagataacaatggtagtgctgacgcggcccaaggtaatgacaacagagcagctgcagaaaataatgctaacgcagatgcccaaaccgatgccgcacaaggtagcgccaatgaagccaacgcagaaaacaatgctaatgcagacgctcaaaatgatgctgcacaagctaatgataatgaagctactgcagaaaacagtggtaatgctgaccctgcccaaggtaatgacaatnnnnnnnnnnnnnnnnnnnatggtaatgctaacgcagcccaatctaatgacagcgaagcagctgcagaanataatggaannnnnnnnnnnnnnnnnnnnnccgcacaaggttccgctaatgcagcccacgcagataataatgctaatacagacgctcaaaatggtgctga

SEQ ID NO: 16196 - DNA, 826 bp, Diabrotica virgifera
  misc_feature (727)..(743): n is a, c, g, or t
  misc_feature (746)..(763): n is a, c, g, or t
ggttcgtgttaccggatgtgggtgtacgtagacctaatttatttctatgatttagtattggtgtgaattggtcaataaatcttcctggtcgttcttctttggatatgcttttatgaatctggtgtccactgatagtccgactttggatgtctttgagtgtccggttccacatttattttggttaatgagtttggatacctttggtatgtttattatttgtattatttgatattggtgagaatcgttccataaatcttcctgattgtccttctatggatatgctagtacgaatctggtgtccattgttagttcagttttggattaagtgttcgattcttcacttattttagttattgatttctttggtcttactttagtatatttacttgcgttattgcacgaataggctcacacctttgcctggttgttcgtccttggatatacactttataaagctgatgtccctggatagttcaattttggatttagggcccattcgacatttatttgtcattatgaactttagtaaattatttagtttatctttggcttttagacaaaatgccgaggatatcttaatatcacttcgagtcatctgttgcggttcatgatatctgctgcagtgaccatcctgctttctcctgaggcatgttttgtagttatttgtaatcttgcgaatcgacgagaaataatacactactactactttagtttaatatttagagannnnnnnnnnnnnnnnngannnnnnnnnnnnnnnnnncagtaggaggagaatgtaacgttccgtcacttatctaattaattattagtgggaacaacttat

SEQ ID NO: 16197 - DNA, 369 bp, Diabrotica virgifera
gggaagctggtcgcctgcaggacggccggaatccgggtcctcctcgcgtccgagagaagcagagttagatcgcgcgtacctttacagcgatgtggaatctatctcgaacggagagacttctggtagaaaacagagacctaaaaagtgaaatttaagggaaaaaggggcaaaccaggcgaaaaacctgggaatggtccagttccaaaaattgagaaaggcaatgctcgaagggtggatcccatcagccaaatgcagacgggctgatggcagctagcctaaaggataaaatagacagagagataaacaccgctgttaagagcacaaatatacacgacaagactagaggcgaagatagagataaggacaata

SEQ ID NO: 16198 - DNA, 193 bp, Diabrotica virgifera
  misc_feature (7)..(29): n is a, c, g, or t
  misc_feature (158)..(189): n is a, c, g, or t
taacagnnnnnnnnnnnnnnnnnnnnnnntcgatataaagatgcgacctcgatgttggattaaagttataattggggaagagttatattataaggcttgtcgatttttaaattttcttggtttgggttaaaccggggggggcccggttggttttttcnnnnnnnnnnnnnnnnnnnnnnnnnnnnnnnnggac

SEQ ID NO: 16199 - DNA, 736 bp, Diabrotica virgifera
  misc_feature (2)..(537): n is a, c, g, or t
  misc_feature (544)..(581): n is a, c, g, or t
  misc_feature (601)..(614): n is a, c, g, or t
  misc_feature (617)..(639): n is a, c, g, or t
  misc_feature (647)..(669): n is a, c, g, or t
  misc_feature (699)..(730): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16200 - DNA, 901 bp, Diabrotica virgifera
  misc_feature (665)..(683): n is a, c, g, or t
  misc_feature (749)..(749): n is a, c, g, or t
ccttacgcgtccgcattcgaacttttctataaaaaaataaaacgtttggtggaggacgtgcccctattttagtgttaagtacgaattttaacattttgttaattaactaacgtcactacaattttttttggtgttttaggtcaaaataccaaacgagaatccggtcgaaaagttcagctggaaaacatcaatgccggaaagcaaatcgcggatgtgataaggacatgccttggtcctcaagctatgttaaaaatgcttatggatccaatgggaggtattgtgatgactaatgatggcaatgctattttacgtgaaattacagtacagcatccagctgcaaaaagtatgattgaaattgcaagaacacaagacgaagaagttggagatggtaccacctcagtaattgtcttagcaggagaaatgttagtggcagctgaacagtttttggaacaacatattcatccgacaatcataattcgccagtacagacaagcactcgaagatatgatccagttattggaaggtccattaagtataccagtcgatagaaacgataaaaatgctcttgcccaagtcgtgaaaggctgcattggcacaaaattcataagtaaatggtcagatttggcagtaaatattgctttagatgcagtaaatacagtattatnnnnnnnnnnnnnnnnnnntgaagttgatatcaagaggtatgccaaagtcgagaagattcctggaggatccattgaagaatctanaattttaagaggtgttatgcttaataaagatgtaacccatccccaaatgaaaagatatatacagaatccgagaataatactttttggattgtgcattagaatataaaaaaggggaatctcaaacaaacgtagaaatttcagcagaaacagac

SEQ ID NO: 16201 - DNA, 909 bp, Diabrotica virgifera
agttattggatttttaatatttcctaattttatgagtgttttaattttcaaaatgggtaatgcaggaagtagtggacctacgcgagaacggcaaaaatcaggtgaagtagtccctgcgtcaccaaccaaagaaggacaagcatttacattcgacaagaagcctgaaaataaattgcaaattcaaagttcgcaggacgaagaggagccctattttacaaagcccgcttcgagttatgatcaacctcgacccagagctaatacagtatctgaaggaacccaaccagtgcgaaatgcatctaagacacccactgttttccgatgggaaggaggaggtaaggacgtatgtatctgcggtaccttttccaactgggagactattcccatggtaaaaagttatggagactttgttgccatagtcgacctcccagaaggcgaacaccagtacaaattttatgttgacggagaatggaagaatgatcccggtaataaaattatagaagatgatagcggggctaagaacaatcttattgttgtaaagaaatcagattttgaggtgtttcaagcattagctaaagatagtgaaaatgcaaaagatgattcacagaaagaatttggacaggatataccaccaaacaaaccttgggaaaaaacaagtggtccacctatattaccaccacatcttcttcaggttattctaaataaggacacaccattatcatgtgaacctactcttctcccggaacccaaccacgtcatgttaaatcatttatatgcactatctataaaggacggagtgatggtactaagtgctacgcatagatatagaaaaaaatatgttaccactttgttatacaaacctattttatgggatttaatctattttggacataatgaagatggtattttact

SEQ ID NO: 16202 - DNA, 564 bp, Diabrotica virgifera
cgatttgtggtttgtggaatgtctgttgcagtatgtgcactcaagaaatttagtgagttaaatcgtgtttagtgccttgcatcgcgaataattagtgtttgtttacattattttcttatcaaaatcgcgtgggctgtgagtaaacaaaacaacttcgacaacatgcagtctgtcttggcttgtttactgttttttacgttttggagtttctcatcatgctcgcggtctgggatttatatcgataatggttttgatcaaacggctatagagaggacgatgaccagagatgaaaaaagggaaatggaattggagattttgagtctcttgggcttgcctaagagaccaaggacaataagtaagaatccgctgaagaggtcagctccgaggttcttgttggatatttacaagacgttgatggatgcggacaacgaagatgatcaaagggccaagaggagtgttgatgtttatttgagtggcgaagaacagaaccgaattgatgagagagatatcattatgacttttggaggtgctaatgaccatgtgccgaatgtaagacatgaacga

SEQ ID NO: 16203 - DNA, 167 bp, Diabrotica virgifera
  misc_feature (2)..(34): n is a, c, g, or t
  misc_feature (36)..(62): n is a, c, g, or t
  misc_feature (100)..(119): n is a, c, g, or t
cnnnnnnnnnnnnnnnnnnnnnnnnnnnnnnnnngnnnnnnnnnnnnnnnnnnnnnnnnnnngtgaatgaaaaaaaagctgtctttattgaatttatagnnnnnnnnnnnnnnnnnnnngaaaggttaaatttgtagatgagacgagaatgccctagcagaggttat

SEQ ID NO: 16204 - DNA, 929 bp, Diabrotica virgifera
  misc_feature (18)..(878): n is a, c, g, or t
  misc_feature (882)..(917): n is a, c, g, or t
gtccacttacagcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattnnnnnnnnnnnnnnnnnnnnnnnnnnnnnnnnnnnncataaatttatt

SEQ ID NO: 16205 - DNA, 741 bp, Diabrotica virgifera
aatttatcacttcacctttttacaagcattcattatcgaattccgaaaagattgaaactaaaagatccagcaattaccaagtaagatacgctatttttaaatgtgaaattatgcaattgggcgattacaaacacctcattagcaatataaaccaatacataaaaataatttagtgttgaggcataaacggagaggaaccgtattccatattcagttgcggctttgataataagaaaagtgaccttcataaccttcataacatcaataacatcatacttgactaggttttgctcagtgtcagcaatggtttatagaagatatctgaggattgggtgtgtggtgctatcactattttatcagacaaattgtgaatgccctaaaatatatactcgcaatgaatggagcgctcgaaaagcgttaagtaccagaccgttaagagaagatcctccaccatatgtggttgtccatcattcggccactcgctcatgtttttcacttgaagattgttcaaaacttgtaaaaagcatccaagattaccatatagatcacaatgcatgcaatgatattgtgtacaactttttgattggcggtgatgcaactatataccaaggtagagcatatgctttacgtgatgcgcattctattccataccacgcaagaagcttaggcgattgccttttaggaagttataaagatacgaatcctcctagagtgcaactgagagtgttgtaagactttttg

SEQ ID NO: 16206 - DNA, 224 bp, Diabrotica virgifera
  misc_feature (187)..(204): n is a, c, g, or t
tctcccaggggccgagagaaaaagcgaggaaagaaagaattccttgaagggaccaacacatagatgaacaaaagagcacgaccacagaggccccggaaacaaacaaaggcgatttttttttgactcgaatttcattttcacctgaaaattcggaacttctaaatattaagattctccccacatcgcnnnnnnnnnnnnnnnnnnctgaaaagtagccacacgga

SEQ ID NO: 16207 - DNA, 74 bp, Diabrotica virgifera
  misc_feature (2)..(29): n is a, c, g, or t
annnnnnnnnnnnnnnnnnnnnnnnnnnnaccgcggtattttagacgcgctaaggtagcataagccttagattt

SEQ ID NO: 16208 - DNA, 707 bp, Diabrotica virgifera
  misc_feature (2)..(44): n is a, c, g, or t
  misc_feature (52)..(668): n is a, c, g, or t
  misc_feature (672)..(704): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnaag

SEQ ID NO: 16209 - DNA, 913 bp, Diabrotica virgifera
  misc_feature (44)..(65): n is a, c, g, or t
  misc_feature (794)..(794): n is a, c, g, or t
  misc_feature (866)..(889): n is a, c, g, or t
aaaatataacctaaaatcaagaatcgcaagtttcaagttcaacnnnnnnnnnnnnnnnnnnnnnncttcgtaacataaacatacagcatacagctttattaacagtttgatcatcgataaaaacaaatttatcgtaagttcgtacaaaacgcttaccattttacgattaagaaaatcgcaccggtatcctttacaaatcaccgcaagtaaacaatttccaatcgtacctatttctcaccaaatatcgagaaaaacgatcgattttaattttccatttaaggtaccatcggggcatcatttagtttagttcgcaagtttagtgttttcgtgaagcaggcaggttagatcgagatcgagcaaaggttgtttaaggctcggtcttttcggtttaacccatcgaattagaaaggttcggcaaaacagggtgtagatcttaatagaaggcaccactctcaggttggactccactttttagtagctcactcgttaatcggaagaatatcgaaattcgttgaataccttttcgaaaaatcaagctcgatccgaatctcagtgataactctcggccaatccgaatagaactcggccaatggaaaaaggaatggcattccaattcgaagttttcgatgggcaaggggatggaagagttttcaagttctttaaacaataaggcaacatttcctaggatttaactccattcacattaaggcggttcttcactggataatttgggacatcacaaaactggttaataaaatatgggggccaatcctattcttaacaaatgatatggngacacacgccattgacatatgccaaagatcctgagattaaacatacttggagaaagagatggctggctttgnnnnnnnnnnnnnnnnnnnnnnnntagaagaacgtagaagatatcctc

SEQ ID NO: 16210 - DNA, 818 bp, Diabrotica virgifera
  misc_feature (5)..(26): n is a, c, g, or t
cctcnnnnnnnnnnnnnnnnnnnnnnaaaatatctttactgatatcttgatgtacaattacagaacaattgaggtctagaaggcccatggcttggtttactattctttttcattctttcctgtttactgctttatttttccaatttgagattttaagttatatgtgtttttcaacatcattccgactagttttcggcccacctttcttcttctttcctcttattcctcttgttagtatcatttggatatgtctcaaccatctcagtcttcgtgattttatgatccctacgatattcagttctccatacatatttggttgtatatttggtctttttatccccatttccttccacagctttcctccaaatattttcttggagacatttctttcccacccttggagcatgactttagcacggatttattcatagtccatttcactagtatatagatcttatcagtcttacatattcttatattagcccttttagatatatgtttttacttcttaataacttgtttagagcaaagatacaacgattaccagccataatcctcgcttggatttcttccttcatatttggtctcctgatgaatgtctgtcgtaggtacctttttactttttcgaattgatatatttttctttctgtaattattgtcaagtgttgtccttgtatgtattatcgttctgcccattccacattttggttttttcttcgtttatgtatgtatatccctttccttcttgctttctactctttttagaatttcttttaattcttggttacttctggctatcagtactatcccatcagcga

SEQ ID NO: 16211 - DNA, 225 bp, Diabrotica virgifera
  misc_feature (13)..(30): n is a, c, g, or t
  misc_feature (90)..(103): n is a, c, g, or t
  misc_feature (106)..(128): n is a, c, g, or t
  misc_feature (136)..(158): n is a, c, g, or t
  misc_feature (188)..(219): n is a, c, g, or t
gtttataattggnnnnnnnnnnnnnnnnnnaactttaatccaacatcgaggtcgcaatctttattatcgatttgaactcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16212 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttaaaccggtgtgagcccaggttggttnnnnnnnnnnnnnnnnnnnnnnnnnnnnnnnngaaagg

SEQ ID NO: 16213 - DNA, 109 bp, Diabrotica virgifera
  misc_feature (7)..(44): n is a, c, g, or t
  misc_feature (64)..(77): n is a, c, g, or t
  misc_feature (80)..(102): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcga

SEQ ID NO: 16214 - DNA, 664 bp, Diabrotica virgifera
  misc_feature (61)..(101): n is a, c, g, or t
  misc_feature (104)..(133): n is a, c, g, or t
  misc_feature (150)..(173): n is a, c, g, or t
  misc_feature (176)..(188): n is a, c, g, or t
tctccccccccccgcgattatctattttttaggatgcgtctctttatttttagctcaagtnnnnnnnnnnnnnnnnnnnnnnnnnnnnnnnnnnnnnnnnnagnnnnnnnnnnnnnnnnnnnnnnnnnnnnnntggattatcacataacnnnnnnnnnnnnnnnnnnnnnnnnatnnnnnnnnnnnnncaattacaattcatactggaaaacaaatcttttaaagaaacattttgaaatgaaatgttattcgtctttagacatatccaatcctttaagaaatatattaaatctatttgtctaaaatatatatctactaacatacgtttatacatctaatattatagatattcaaggaagagccgataattataaatttatcacaatttgaaatatcaaaacaaattatcattaccgatattcatattttaagctatgtcattcctcatcctaataccgtaatagttgtattttttatcctccagttactaatatatgattatcatgttaattacactacaataacgaacataagagtactcttaaccaatggtatccttaggattacaaatggacttactgcaggaattctgcaacttgttttcacctgttaattgataccaggcctatctgcattacaaataacgtctcgcctgcgccctgat

SEQ ID NO: 16215 - DNA, 69 bp, Diabrotica virgifera
  misc_feature (2)..(55): n is a, c, g, or t
gnnnnnnnnnnnnnnnnnnnnnnnnnnnnnnnnnnnnnnnnnnnnnnnnnnnnnngctggatgaagggg

SEQ ID NO: 16216 - DNA, 790 bp, Diabrotica virgifera
  misc_feature (740)..(740): n is a, c, g, or t
gcggccggggcgccgggcgctgccgcgcacccgcaccaacagcattcaggcgggaagttcgtcagcgatgacggtagcgaatgtagtagtgttacgagtgatagtataggaaggtacgctagagagggccatgacaaatatactgatgtaaataagaaaattagattagtgcaagaacaattagacaattttagagaaagttttgatattattaagtcgttacagcaagagatacacgacctcaactccgccttacaggaggagaggttcaaaagtgaaaggttggaagagcaaatcaacgacctgacggagctccatcaaaacgaagtggagaacctgaagcaggcgatggctgatatggaggagaaagtgcaatatcagagcgaagagcgactcagagatatacatgagatgctggagcattgccaaaccaaaatccaaaagatggaacatcaagccctccagcaacagcagtatgttaccttggaaggtctcgacaattccaacgccagagcgctcgtcgtcaaactcatcaatgttttgctcacagtacttcaagtggttttattgttagtcgccacgggagcgggcattatcatgccctttcttcgtacaaggttaaggattctttcgacggttgtactagtaataggaatagcttttgtattgcggcagtggccggaggtgagggacatcggatcgcacatgatgcgtcgcctcaaagataccctagatccggncccgtagttgtagccaccgcctggcgccgtttcgacgctgctaatgccga

SEQ ID NO: 16217 - DNA, 875 bp, Diabrotica virgifera
  misc_feature (224)..(278): n is a, c, g, or t
  misc_feature (711)..(734): n is a, c, g, or t
  misc_feature (780)..(780): n is a, c, g, or t
  misc_feature (818)..(818): n is a, c, g, or t
atcaaacaaggttatggaatgactgaaagttcgccggtgacctttatcatgccaaaaatgacaccaccatcaaaaattggcacgataggagtgttgtatcccagtactgaagccaaagtggtgtgtttagtgtcaggaaaaaccttaggcacacatgaatctggagaactgttagtcagaggtccacagattatgatgggctatttgaataacgaggctgctannnnnnnnnnnnnnnnnnnnnnnnnnnnnnnnnnnnnnnnnnnnnnnnnnnnnnntgatgaagatgggtatttctacattgtagacaggtgtaaagagcttataaaagtcaaaggaaatcaagtatcgcccacagaactagaaaatctcataatggaaatagaaggaattgcagatgcagccgtcgtgggagtcccagatactctagcaggagaggtccctagggcatatgtcgtgcgactagccaacgccagcatcaacgaagaagatattcaaagatgggtgaacggcaaagtatctcactacaagaaattagtaggaggtggtgaagtttgtcgacatcatccctagaaatcccagtggaaagattcttagaaatgaattgaaattaaattgaaaggtttaatactaaacctgtagatggatgaatattatgataacgcaaaaaattcatttattgtcgtatagatggcagattgaaaatgtacnnnnnnnnnnnnnnnnnnnnnnnncgtttattcagcaatctgttagttataaaaattctaacaataagcngtctttggggtttgaaataaaaaagagttgacgttagnagaggtcagtccaatgactggacctctaggtcaggacctctaggtaggatttaaaaa

SEQ ID NO: 16218 - DNA, 192 bp, Diabrotica virgifera
  misc_feature (2)..(18): n is a, c, g, or t
  misc_feature (20)..(62): n is a, c, g, or t
  misc_feature (70)..(180): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaatcgt

SEQ ID NO: 16219 - DNA, 752 bp, Diabrotica virgifera
  misc_feature (383)..(405): n is a, c, g, or t
  misc_feature (685)..(685): n is a, c, g, or t
  misc_feature (689)..(689): n is a, c, g, or t
  misc_feature (697)..(698): n is a, c, g, or t
  misc_feature (718)..(718): n is a, c, g, or t
  misc_feature (724)..(724): n is a, c, g, or t
  misc_feature (733)..(733): n is a, c, g, or t
ggatataagggaggcgaaatgtttgtgtgaaaaggtatattaacggttagtcatcagatgactaccggaagtataaacgggagttcagcacagataggtcctctgttaaccgctcactgtttgtccggcaaatacatgaggactggactatgcttactcctgtcatcataagactggactgttagtagtccagtctaaacttaaaggtttgatgcatgctgctaagtatcttagtaacttgtaacaacctattttatccactatattttatgggaagaaaccacaattgtaatcacaaatagtttatttttgatattttgacttacagctgagaaacagaaataaacaaatttatgttctgaaaaagatttctcagttggaannnnnnnnnnnnnnnnnnnnnnnctgataatataattttgatttattcccaaaaaatgtagcagttgaaccccttgtgtaagtgaagggttgaagagtggttttctccactcttcttgacctccatacactggggctagtcaacacattgtggaggtagtgtgaacatgtagacgaaactgtcgagcattccatgtgagtgtccgggagttatcgtcaatatgagagtatgtgtttggtgagccctggcctacacctcccacataagggagatgtcacctggtgacttgttcactttctctanatgngaggatgnnacaacttgttcaccttctantaatgngaggatggnacaacttgttcaccttcta

SEQ ID NO: 16220 - DNA, 90 bp, Diabrotica virgifera
  misc_feature (54)..(89): n is a, c, g, or t
ctctccccgcataaaatgccgaatacccgcagaatttaaattaagaaaatgtgnnnnnnnnnnnnnnnnnnnnnnnnnnnnnnnnnnnnt

SEQ ID NO: 16221 - DNA, 573 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatac

SEQ ID NO: 16222 - DNA, 890 bp, Diabrotica virgifera
  misc_feature (803)..(803): n is a, c, g, or t
taaggagctgtctcatttctccgaatctagcaaatctggcaatcaaatatcggaatatatctgctccactttcctagacaaacaacaagaattggacctaccctcccttcgtgatgaagtccctgagctcctcccaaaacccactcaacgcaaagaacgtgcccgaggaccgcattctaccatgtctcaaatatcaggtgttaatcgtaaaccactttgccacaccaattcttttaccggtgagaagttacctttgcacggcattgaaacaccttacgaagaagaattaggcaaaagtttgattatgatagatcaatggggtatcgatattttccgcatcggagagttaagcaacggaaagcccctaacctgtgtagcttacacgacctttaacaatagagacctcttgaagacaatgaacatcccgccgaagacgtttataacttttatgatgaccctagaagaccattatgtgaaagaaaatcctttccacaattccctgcatgcagcggatgtggctcaaagtacacatgtactgctgaatactcctgcattagaatctgtatttacaccgctagaagtgacagcagctctattcgcagcgtgcattcacgacgtagaccatcctggacttaccaatcaatttctaattaattctagttctgagttagcccttatgtataatgacgaaagcgtactagagaatcatcacttagctgttgcctttaaattactttctaacgacggttgcgatattttctgtaatatgaccaaaaagcagagacaaactcttaggaagatgntcatagacatggttcttagtactgatatgtccaaacatatgactcttttagctgatctaaagactatggtagaaacgaaaaaagtag

SEQ ID NO: 16223 - DNA, 762 bp, Diabrotica virgifera
  misc_feature (5)..(72): n is a, c, g, or t
  misc_feature (82)..(193): n is a, c, g, or t
  misc_feature (195)..(460): n is a, c, g, or t
  misc_feature (462)..(757): n is a, c, g, or t
ctccnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaata

SEQ ID NO: 16224 - DNA, 96 bp, Diabrotica virgifera
ccctcaacgtccgcgtcaccaccctggtaatagatagagaaccttttaaccaactgatatcaaatctagatgagattagaactaaatataaggatg

SEQ ID NO: 16225 - DNA, 663 bp, Diabrotica virgifera
  misc_feature (177)..(194): n is a, c, g, or t
  misc_feature (203)..(223): n is a, c, g, or t
  misc_feature (597)..(614): n is a, c, g, or t
cccacgcgtccgtaagaacagaacaatatttatgctggcgaacaaccacccacaagccagaaaaaatacagagattctgctgacagattaaaacacctcgtctgtaactttgatgttcatggtaacatacttaattacttaagggggattgcacataactttaatttttagtattgnnnnnnnnnnnnnnnnnntattgtacnnnnnnnnnnnnnnnnnnnnncaccctgtattatgtacctaatgctttttggtctcctgcttttcggtctcctactgttcggtctagtgaggtttcggtaaagtgcttttcggtctaatgatttcggcctctttacagtaaaccacttataataagtgaggtaggtgatctataaatactaatgaagtttttgaagattttttttactcttgtactagtctgtaattttgagctcatcagtacctattaagttttttctttgaataattttattaattcaaagaaacataaatctttttgttgaatctaaatcagtgttggattagtactttgcaaccgaaattgatccgagatgtcaaaccatttcgaaaaccaagagtacgggtgaaatgtgnnnnnnnnnnnnnnnnnncacttttaagaatttactgcgagtcgaatttgttattaattttttatga

SEQ ID NO: 16226 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnncgaaagg

SEQ ID NO: 16227 - DNA, 798 bp, Diabrotica virgifera
  misc_feature (3)..(72): n is a, c, g, or t
  misc_feature (74)..(118): n is a, c, g, or t
  misc_feature (125)..(797): n is a, c, g, or t
atnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 16228 - DNA, 807 bp, Diabrotica virgifera
  misc_feature (189)..(219): n is a, c, g, or t
  misc_feature (541)..(560): n is a, c, g, or t
  misc_feature (706)..(706): n is a, c, g, or t
  misc_feature (719)..(719): n is a, c, g, or t
aaaaacgtaacaatactttattaaaaacatctttatatttggtcttataactaccgatttttaactattagatttttttaacattctatatgtattttttgataacaagtaactcagtcctgcagctactgtcgttgtaccagtgatatacctaaaaaattcaaaagaaaagatgaaagtccagatgcnnnnnnnnnnnnnnnnnnnnnnnnnnnnnnnctgaacttttcgtggaactactttctggtgacatcctaaatctctgacttacagtttaagacaagagacgacgaataaagaagacaaaaaagaccctacaatatggagtcacatttcgcttcatccgtctaggaaaagatccgaaagttagttcctagtactcaagtaaagataaaagtgaaagacagtttatgtttcctttcgattcagaggcgacacataatcctccaggcagctgtttctgtctcaacacttcttcagtggggctacctgaacacctctgaatcgaaaagaaaacaaaactgtgtatataagcagaagnnnnnnnnnnnnnnnnnnnntcaacaattcagttaatagaccagtgcagatagctctaaaatggaccaaaaaaataaaaaatcaatagcagggtgagaccaactccaaatgaaagtacacatactaaacaacatgtggaacattcttcaccaaatctggatgaggngaacacgggttgngggagcgcccctaggggtgaaaacggttaattacaattctcggcaaaacggcagatcccatcgaaaaaagttaaatcgcaaagttgca

SEQ ID NO: 16229 - DNA, 793 bp, Diabrotica virgifera
  misc_feature (9)..(52): n is a, c, g, or t
  misc_feature (63)..(99): n is a, c, g, or t
  misc_feature (107)..(218): n is a, c, g, or t
  misc_feature (231)..(408): n is a, c, g, or t
  misc_feature (410)..(717): n is a, c, g, or t
  misc_feature (727)..(783): n is a, c, g, or t
cttttctcnnnnnnnnnnnnnnnnnnnnnnnnnnnnnnnnnnnnnnnnnnnncgtgagagaannnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaaatgnnnnnnnnnnnnnnnnnnnnnnnnnnnnnnnnnnnnnnnnnnnnnnnnnnnnnnnnnagtaaaaagc

SEQ ID NO: 16230 - DNA, 1035 bp, Diabrotica virgifera
  misc_feature (378)..(378): n is a, c, g, or t
  misc_feature (995)..(995): n is a, c, g, or t
ggtccgggaatttcccggaggtcggacccacggcggtccgggaatttcgaaatgagaagagaaagtatacattcctcaagggtggagagttagcgggataaacattcttttcctaccagggcccagaaacattcatcggctcgaatgcgggatgcatacatacataacatgcggccaggaaacaaactctaatgagcaaggtctccaaaaaacaagaatgagaatgtaacttcggcaaactcaatgggtaaactcgggcacatgtaaaaaacgggttctaaacaggtcaaaaaagcagggttatcgggaatttaattcatacaagaaaatcggataacctaaatgaatgaacggtttttcggtggcaccatattcaangccaataaataaaaagaaataaactccgaatgaataggccaggtccggattcaagttggggcggacgggtggaatagtcagtaagaaattctaagcggtatgtcagtatggtggaaatagaggtaaacgagggcgggccaaacgtaaaccgggccctaaacggtggacccagtaatgaggtttcgccttaacgctcgccggaccggaagaatgaggataaccggccagggggtattaacccgatgagggaagaacgggggaacggtcgtgggcgggtaggccggagggcgggcgggaaccggccaatgggaaatgccaaaggtggatgagcgaaattcaaatgggaatcggggggtaacaaattcatgagcgggtggaatgggcggcgccaatgggttgggccaatgggaactcctccaacggttcggttcacggcaaccaaggaacggcggaacgggggagggataattcatacatacacagggggaacctctacatcggcgggaaccggccatgggaggaaattcagaaacaaataacgggaggtacagtctctcccggtgtggtcggtcgaactccccaacggtgggctctttcttccggtcgtatattcattncgtgggatgggtcggcgggcgggcggcaatggaccaacgg

SEQ ID NO: 16231 - DNA, 154 bp, Diabrotica virgifera
  misc_feature (7)..(49): n is a, c, g, or t
gatatgnnnnnnnnnnnnnnnnnnnnnnnnnnnnnnnnnnnnnnnnnnntagttagattataatataaattcaatttattttagtagagatgtgacgattagaatgatattatagcatatttaatttaaagataatatattggttcaggaactc

SEQ ID NO: 16232 - DNA, 740 bp, Diabrotica virgifera
  misc_feature (2)..(44): n is a, c, g, or t
  misc_feature (52)..(659): n is a, c, g, or t
  misc_feature (672)..(724): n is a, c, g, or t
  misc_feature (728)..(728): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggatgagggnnnnnnnnnnnnnnnnnnnnnnnnnnnnnnnnnnnnnnnnnnnnnnnnnnnnngtanaagcttaaattt

SEQ ID NO: 16233 - DNA, 280 bp, Diabrotica virgifera
  misc_feature (25)..(48): n is a, c, g, or t
gagtgtctgtgtccgagaagaaaannnnnnnnnnnnnnnnnnnnnnnngtcaagtcattaagataaaatttgttaatgattgtctataaatctggcattcattgttgaccactttcttatttaaacattgtacaatgtctagagaaatgcagttattccgattatggaaagggaggttagcacaagttcgtcttattcacgttgccgcaacttcaaacgccgctgcagctgaagcaaaacgagccgagaagccagctagaccaaaaacgttgccatttat

SEQ ID NO: 16234 - DNA, 547 bp, Diabrotica virgifera
  misc_feature (8)..(492): n is a, c, g, or t
  misc_feature (494)..(539): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnngcccactg

SEQ ID NO: 16235 - DNA, 964 bp, Diabrotica virgifera
  misc_feature (633)..(652): n is a, c, g, or t
  misc_feature (807)..(807): n is a, c, g, or t
  misc_feature (820)..(820): n is a, c, g, or t
ctcccacggaaaaaattactgaagaagaaccaactgaatccactgaatctactgaatctgctgaatctactcccattggaaaacggccgttaccagatagtgatactgaaacaggagctaagaaaaaactaaaaagatctgaagatgacaccgtgtcagaaaaaagcaaagataaaaaagacaaaacaaaggcgaaaccgggggaagaaaaaaagcgtaaaatcaaaacccttaccgctttcgaaaaatacatgagggaaaagaatttaggagaggaaaccctaaccaggtcggatttagaacaattttgtctacaaaaaatttgtgaagcaattattcataaatcagaggctggagaactacatcaaattatattaagacaagcacaaataatagataacttacgaaaagaggttcaacaaatctctaagcaagccaaagatctcgatatcgttcataagaaactcatgaacgatattcgtgttcatggtaccatgaaaccgttagttcctttgaaaattacacggtcggtaggcttacaggttaaactgaatgtttcggaagacccaaacaagaggaagacgttcacagtacctgtagctactaataaaacagcaactactactacaaatnnnnnnnnnnnnnnnnnnnngtccaagagttgttcaaaaacctaataatgttcaaggagcaaagactactataacccctgcctcaccgagaaaaacatctccagccgcaccgatattatcccaagctctgcaaacacgtccatcacccacccctacttctccagcaaccaaacgngttcctcctttgnagataaaacctagcgaacctcaaaagccatcagctccaggagtaatcgacttaacccgacgagatgaaaaaacagccacagccaaaccagtagctgtaaaaaatatgtacaaaaaaaccgataaataccaaattaggcacatca

SEQ ID NO: 16236 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (136)..(136): n is a, c, g, or t
  misc_feature (155)..(155): n is a, c, g, or t
  misc_feature (171)..(172): n is a, c, g, or t
  misc_feature (180)..(180): n is a, c, g, or t
  misc_feature (186)..(186): n is a, c, g, or t
  misc_feature (195)..(195): n is a, c, g, or t
  misc_feature (201)..(224): n is a, c, g, or t
  misc_feature (234)..(234): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagttnaaaccggtgtgagcccagngtggtttctatctttnnaattatantatatnttagtacgnaaggannnnnnnnnnnnnnnnnnnnnnnnattagataantatt

SEQ ID NO: 16237 - DNA, 878 bp, Diabrotica virgifera
  misc_feature (665)..(681): n is a, c, g, or t
  misc_feature (810)..(810): n is a, c, g, or t
  misc_feature (835)..(836): n is a, c, g, or t
  misc_feature (864)..(864): n is a, c, g, or t
ggtgacctctatttacagttaaagtgtttccgtttcccaatgaaacaccctgtatcacttgctagtggcaattgcaaaggcttttcccagtgtttctctttaaagccaatgccgcactgcaggaggctagatggtggcttggagggtggattttaaaggtggatggtggagggtcgctgcatcctggacgcagtgaaagagtgaaatgaagtcagaagtcagtatccaactgactgctgaggaatcgtttgtttcatttgttacgttacatttggtttgttttttagcatattagaggtaaaactcactcactaaacttttcagaaaatggagaaaaatcgacttaaaggcaaaaattgctttttaaattcacctgacttgaatattggatttttttaatgcaaatgcaaagaataaataaaacagatattttaagccatgtttcgtcacatagtgggtctgctgggtcccaaattgcccttattttatacacagcacttattacgctttcgttcatagcgaggctacccggatggattatcaaacacgactgatatgggtggatagatgcctggcggaccaccgggtgggtagatggtagtgggaggccactgcggctaccgtcgttgtattattcgtggtataagtagctggatggtcgccannnnnnnnnnnnnnnnncaccatcctagcaaacttcctgcactgcggcatcggccctaagggttttcaaagctaaactagacagttcgttacaccagtgaccctcaattaactttcttagatcttaaatttcgatttttttaattntctgatcaatccattctataccagnnaagacgtttttttttctagaactagttngtatgctacatcac

SEQ ID NO: 16238 - DNA, 939 bp, Diabrotica virgifera
  misc_feature (774)..(774): n is a, c, g, or t
acagaacattccataatgttggtcccagtacggacctttgcggtactcctcctgtggtttgcgggtctttaggcttcgccaactggacatacctttcattaaggtagttcttaattatatttactaaatattctgacactcttgacttttccagggctttgacgatgtgaccccaattggctgaattaaattcatttttcacatcgaacatcacgagaacggtccaccttttcctcgtctctttgaccgtgtcagttattacctttattgcatcaattgtggatctggatcttctaaatccgtactgtctatcagaaatacttctgtttctttgcggatcctcctccaggcgattctttattagatattcatagaattttcccaggcaatctaacaggcacattggcctgtatgagttggctatatcggggtctttcaccggtttcaaaataagcgttaatctggcctgtttaatctggttgggaaactcttgcctatggaggagattgttgaaaatcctcctgatcatttcaggatattttcttatgatgatcttaatcgcttctgaagcacaccatcgggaccagctgctttacctacttttatatttaattaccagctgttaccgctatttcctccgccgagaagtttgacggggctttgtgggaaaaagtatgttcgctatttcattccttttttgtgaactaaggctgtacggggtttctgagtatgttcgctatttcattccttttttgtgaacagaggctgtacggngtaccaaacgagctgagctaagctcgagaccatctctagacatttcgtctgcacacgaaaacaaaatagatcaccgaaaataaacgggaacactatctcaaagtttagagaaaaaagccggtctaatggttaaattgcatttttaagatataaagatcaaattaa

SEQ ID NO: 16239 - DNA, 118 bp, Diabrotica virgifera
  misc_feature (3)..(17): n is a, c, g, or t
  misc_feature (19)..(32): n is a, c, g, or t
ttnnnnnnnnnnnnnnncnnnnnnnnnnnnnncataaattttcacattttaaaatatgtaatgatttatttttatatatgacaagatgtatttcttgatgaagctttatatcttcgat

SEQ ID NO: 16240 - DNA, 955 bp, Diabrotica virgifera
  misc_feature (341)..(362): n is a, c, g, or t
  misc_feature (897)..(898): n is a, c, g, or t
aggacgatttttaatttatagtttatcagttatattcttcttcggcccggtggcaaatggatacaacattttatttgtgtttcccatgccagcaaaaagtcactttattttagggactgccatggctaaacaattggttgcggcaggacatgatattaccatggtagcctgttttgaagaaaaaagcccaccattaggaggaacttacacgaatgtggttttggacgatatatactactcaaacaaagattttaactttttggatttacaacatgtttctccagaacttacaatatataatgcataccaatcgggacatatgctatccaaagctatattgnnnnnnnnnnnnnnnnnnnnnntgttagcctccgatcaaaagttcgacgtagttattatcgaacaattttgcaacgatgcattgaaagtattaggttggtattacgatgcacctgtgattgtttttagtacagttggtgcaaattactgggttaaccctttggtgggcagtcctagtccaatatcttacataccagagctacatcttgattacactgaaaatatgacgttattacaaagatttaggaatacgatagcaatcttatcccatatcctaactcaacaaatatcttattatcccgcacaacaagaaatattaagacaaaatttccctgggagtccaagtttagatgaattagtgacaaacgtgtctcttgttttgctgaattcccacgagagtttaaaccaaccagtaccattggtaccaaatatgataaacgttgggggtatgcatatcatgcctaataaagagttacctaaggatttgcaagttatcatgggacatgccaaagaaggcattgtctatttcagtttgggtctaatggtgatccggctaannatgataagagcaattacagcaatattatgctttaggaaactaccgtacaaggtctct

SEQ ID NO: 16241 - DNA, 913 bp, Diabrotica virgifera
  misc_feature (336)..(355): n is a, c, g, or t
cggacgcgtgggttaaaatcaacttgaatttttaaaatgtcaacactaaatacattaaatttttaatgatgtattgttaatttgttttggaatgtatgagatattcattaacaaatgtctgacaaactaatttgacaagatgcacctatcaagaatacctgcggtggcaggtacatacgtaagaagtcccagttttggttccctagtttttaagcagtcctggccggtgaccaattcattaagctatacaatagttagatgtaaacatagaaaatctatctacaagagggaagaggccaaaaaactacgcttttacgttgttacaaaatatgttgnnnnnnnnnnnnnnnnnnnnaaagttctagaaaagaacttccctcaaaccgtacaaacttacagacagtttatagatggaactagagagtttattagagatgccaaagaatacttcaggattattagaatactaaatacacccggaaaaagttttgccaatttactcagaagagaaatggaattgtatcagcagatgccaaaagatatgaagaaagtagccccagtgttaattaccttctctatacccttcggatcttatgtgattttacctttagcgtatatgtttcctcgttacttgctgtgttcccatttttggaatttgaaacaaaagtcagaatatcaaatattaagcttaaaggatagattagttcataatagacctatttttcgacatttacaaagtcagatgtattttttgaaaccacattgcctttacaagcgttggaaggaagtagtaggtaaaataggcagtggtgtgcatcctactggtggcgagattgctgagtgtaacaactctttatgactgagcctaccacatcctttatttaagcagtaaatcacatagtcatcttttaaa

SEQ ID NO: 16242 - DNA, 151 bp, Diabrotica virgifera
  misc_feature (7)..(44): n is a, c, g, or t
  misc_feature (78)..(101): n is a, c, g, or t
  misc_feature (109)..(131): n is a, c, g, or t
taacagnnnnnnnnnnnnnnnnnnnnnnnnnnnnnnnnnnnnnntgcgacctcgatgttggattaagtttataattgnnnnnnnnnnnnnnnnnnnnnnnntggtcgannnnnnnnnnnnnnnnnnnnnnnagtttaaaccggtgtgagcc

SEQ ID NO: 16243 - DNA, 1015 bp, Diabrotica virgifera
  misc_feature (256)..(275): n is a, c, g, or t
  misc_feature (426)..(446): n is a, c, g, or t
  misc_feature (448)..(460): n is a, c, g, or t
  misc_feature (464)..(482): n is a, c, g, or t
  misc_feature (601)..(631): n is a, c, g, or t
  misc_feature (921)..(921): n is a, c, g, or t
  misc_feature (935)..(959): n is a, c, g, or t
  misc_feature (966)..(967): n is a, c, g, or t
ggtggagcagaatctatttcctgaatttcagttatacaattttgatcgcttatggaagatgtttgttgtcctttatatactttcttattttgtacaccaatcctttttctcggcgattccaaattcaattcttgttctgcattacttccaatcattgcaggaagtatttgtattgtacgatgacctgatactaaagatataggaaaagtcaaacaatgaggaatgcacataactttccccttgttgccatattctnnnnnnnnnnnnnnnnnnnnagaatagtcagatttttttgatatgccattcctattacagcaagcatttcattggctagaattagtgacgagtataatatatgatgtcatagtaactgacgtctgtcataatattggaggttacatttataatgtcaaattattgttttcnnnnnnnnnnnnnnnnnnnnngnnnnnnnnnnnnnaacnnnnnnnnnnnnnnnnnnntttactttcccttccgtatccttgattggtcgtttaggttttcttgtatggtaggtttagttaggcattcattttaagaaatgtcgctggctaaatgcgcacagcttccaaaggccacnnnnnnnnnnnnnnnnnnnnnnnnnnnnnnntcttacataaccttctatctaagccttctatactataggaaaacatgactgacactgggtggcgttcggatgaccacagcggctggacagctgagccagcagtagctgtcagacgtcaccgctggaagtcagccgctgagagatttactaagctttccctatcacagctggatacaaccactcagccgatttctgctgacagtcagcggcctatggtcgtccaaacacacccacttatacgctcgaagccttcgctggtggtcgctcctagcggattactaatttcactntcaccagtaatttnnnnnnnnnnnnnnnnnnnnnnnnngcttaanntattacacgcaaaaaagtaattaaattgtaatcgattttttaaaaatt

SEQ ID NO: 16244 - DNA, 67 bp, Diabrotica virgifera
  misc_feature (8)..(8): n is a, c, g, or t
  misc_feature (17)..(34): n is a, c, g, or t
  misc_feature (45)..(45): n is a, c, g, or t
gtaaatanatattttannnnnnnnnnnnnnnnnngaatggtattncgtttttaatatatctattttt

SEQ ID NO: 16245 - DNA, 873 bp, Diabrotica virgifera
  misc_feature (709)..(709): n is a, c, g, or t
  misc_feature (771)..(772): n is a, c, g, or t
cgacgaagtcaccgtgggtaaattctacgcgactttcctcattcaggattacttcaggcggttcaagaagagaaaagagcaggagatgagggacggagataaagatattcagaataccgttacacttcaagctgggttgcgtacgttacatgaggctggtccagaactgaaacgcgccatctcaggcaatctagatgaattaattgatgacaatcccgaaccaatgcatcgtagaaatcattcactcttcggaagtgtatggtcttcaatgagacgaggtcatactttcaatagagcgaaatctctgaagttaaattcaacccaaatcaaaattacaccggcttccagcgtcgactatcttccatacaattctattaagaatgccgtcacagaagggatgaatcacattacttccatgacgaaaaacgttcaaaaccgtgttagcgctagttccttgaacaatcaggataactataaggatgaagaaattcctctgaggtctcttagtaatctgcataatggagatgagaagaataactacacggtcatcgataaatctggcttcctgcaccctaactacaaggttggagcaggtgaggcgaatggtcacgtgggaccagagcgtcttagccattcactgcctggcagtccggccgaccgtagacttgcttccttcgaagtcgtaggctctgcggaaagcctggtaggncgaatcctagccgagcaaggcttaggtaagtactgtgatcaggatttcgtgcgctacacctnncgaagagatgcagaggcattggatatgactcaggaggaaatggatcgcgcagcccaccagattcttttcacagagaaacttatacatcatcctctgcagca

SEQ ID NO: 16246 - DNA, 701 bp, Diabrotica virgifera
  misc_feature (633)..(654): n is a, c, g, or t
tgtcttatgtagaatataaaaatagtttatactacaagaatatacagagaatagttaataaaaaactaagtgttgacatagatatactgaaagtgtcatagtgtaaatatacgccaattagacaattctcctctataatcccatacccattctatctgacttgtatcacaaaatgaattacaggtactaacaaggatttgtgatgtaccgaattagaatacaacaagtggaactctagcgaccagatccaaaaggagccacctacgtcaaacccattagtcttgacctgaatgttttgaaaccggcccttagcttacaagatattgctgcggcaggccaatgaataatttgagtggccttaagattcctaaactcctactgggaacaccaacattcaacatactattattttgtgatcagtttggtcgacccctcacataactgtattcatttagaccccaaaaataactgtattgacgactcaaaactcaaacacttataactccgtggaaaaacttcctctgttttatcatctcatgaataggtctatttacacatgatactcacttatcaaagaaggatacataagtgccgcttgtatcagaaagaactcactgcaattgataatataannnnnnnnnnnnnnnnnnnnnncctatacctttgattattacgaatatattaccttaaaaatggccgcg

SEQ ID NO: 16247 - DNA, 925 bp, Diabrotica virgifera
  misc_feature (100)..(117): n is a, c, g, or t
  misc_feature (692)..(709): n is a, c, g, or t
gatatataggacgagatgaaagaaatggtttaaatctgaaatccgtcaagcgggagacttaagtctataaatataaagaagggtctgtaggaactggacnnnnnnnnnnnnnnnnnngaatacagaatatgatattaaaattttgtaccaccttggctagtaagtggtcctttgcccatcatattctttttgaagttgacgccttttcgaaaacagataataaagcaatatttcctataaatttttgtgctttatatttaatttgacatatggacctacattttatatacgtattattattttaaatcttactttctttaaaacctagtaaaacgaataaactgactttatttgaaacaaaatacgctgagtagcctttatgacattattttgtaaggtttcccttctctaaactcttcacctgcagataccaccttgtaccaaaacgttgcacaaaactgcagtaaataattacaaagaaaataacagcaaggtggattaaaagcagaaaaaattgttttgtaaagtattaatagtctacactgtattaaaaaccagcaagcaaaggaatcagcacatatttaggtcaaacttcatggaataactcaacttataatatactatatactaaatactaccatatactataatacactttacctacgtattgtatacaatattttttctacgannnnnnnnnnnnnnnnnngattggttatagcacatctaacgcaaatatttgctggttcttcgattacctctacagataacttactatatccatagttaagacatagatttgttagaagataggtagcttaattaataaatgtagtaaatgtaaaatagtgctatatttggatgtaaaaatatttatttaacgtgtaccgagggtgctttttagacagaaaaataaggtagacga

SEQ ID NO: 16248 - DNA, 955 bp, Diabrotica virgifera
aatctagatataatataacataattttacaaatttatcttcttccttttctctatacagttttctttatataccatttcaaatcataataatacatatagactaagtagcagtatttctaaaaaaatacttcattgacacgtgatatgcttgacggacaaaaacaagcggtgttttggctgtcatatagggcaaagttgagatttataacaagaatgacagtgagggacaaatttttagaaccgttaaatatataactggcatgttctggattgagacgctgcaatgagctaagtattatgaacataattatattgttacgtctgagttgaagacagtaagtgaaaaacacgagaaaaaccttggcggacaaaatacatgcagcgttttggttgtcagacacgataaatttgtagatttacaacgttgcagtgtccaactggcccctatattttgtccaccaataatattatcatatcttaacgctttttatgaagcattcttggaaaatttttccggaaattcacatattttggatatttgacagttttttaacctaaaatgtttgtctgaaaacattttccgggatttttccacttactatatttcaatcgggcataaaaatatagtgctgtttgtattatcagtagtcattgcctaattgtcgcttttgacagcgtctcattgactaattttctaattttttggccataaaaactttgtccgtcataaaaaatctgtccgtctggactaatttacatctatctgtgtgttctttgattccttatgtttatggactgtagactggtatttacaaaactctaatcaacaaatcagactgataaaaaattgtaaccgcggcagaaaatgtatttctgaagagggtaaacctttaaatatttgtgacgactgatactttcaaataattagtaatatactagctaaattggccagtt

SEQ ID NO: 16249 - DNA, 487 bp, Diabrotica virgifera
gacaatcctaaaataaacgcacatgaacctttacccggcgcgtggctatttttaatctactgagttagttttacttacatgcaagactgagattgatatttgtacaattgcactcgaattgttttaacttctcttttgtgatgttgcttatttggtgatacagttggagatttagaaagggatttattaagactgaaaaatggagcaattcgagcagctattgacatgcgctatttgcttagaccgttacagaaatccaaagcttttaccatgccaacacagcttttgtatggaaccatgcttagaaggcactgtagattacgttagaagacagatcaaatgcccaaaatgccgcgcataacacagaataccatacaatggagtccaaggatttccaacgaacgaaacccttctacgctttttgcaactacactttgaaataaccgcagaactgccctattcatcctattgttattacttgtaacga

SEQ ID NO: 16250 - DNA, 733 bp, Diabrotica virgifera
  misc_feature (2)..(44): n is a, c, g, or t
  misc_feature (53)..(724): n is a, c, g, or t
cnnnnnnnnnnnnnnnnnnnnnnnnnnnnnnnnnnnnnnnnnnngtaccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagc

SEQ ID NO: 16251 - DNA, 81 bp, Diabrotica virgifera
  misc_feature (2)..(71): n is a, c, g, or t
tnnnnnnnnnnnnnnnnnnnnnnnnnnnnnnnnnnnnnnnnnnnnnnnnnnnnnnnnnnnnnnnnnnnnnncatgaaaaat

SEQ ID NO: 16252 - DNA, 126 bp, Diabrotica virgifera
cgacttttaaatatagctgctacaccaattataaactctaatccaacatcgaggtcgcaatctttattatcgatttgaactctccaataaaattacgctgttatccctaaggtaatttattcttat

SEQ ID NO: 16253 - DNA, 726 bp, Diabrotica virgifera
  misc_feature (2)..(31): n is a, c, g, or t
  misc_feature (39)..(715): n is a, c, g, or t
tnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaaattac

SEQ ID NO: 16254 - DNA, 647 bp, Diabrotica virgifera
  misc_feature (2)..(540): n is a, c, g, or t
  misc_feature (547)..(568): n is a, c, g, or t
  misc_feature (583)..(605): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgcnnnnnnnnnnnnnnnnnnnnnntataatcattagtgnnnnnnnnnnnnnnnnnnnnnnntccttgaatgaaaaacaaactgtctttatgtaattcattaag

SEQ ID NO: 16255 - DNA, 568 bp, Diabrotica virgifera
  misc_feature (35)..(62): n is a, c, g, or t
  misc_feature (218)..(240): n is a, c, g, or t
  misc_feature (275)..(302): n is a, c, g, or t
  misc_feature (307)..(326): n is a, c, g, or t
ctctttcattaattattttaccaaccccctctaannnnnnnnnnnnnnnnnnnnnnnnnnnnttattaggactatgtttaggaattcaaattattacaggcctatttttagctatacattactgcccaaatgtagaattagcatttaatagagttgctcatatttgccgagatgtaaattatggttgattactacgaacattacatgcaaatggagcnnnnnnnnnnnnnnnnnnnnnnnacatccatattggtcgaggaatatattatagatcnnnnnnnnnnnnnnnnnnnnnnnnnnnnggagnnnnnnnnnnnnnnnnnnnnatagcaacagcatttctaggatatgtattaccatgaggccaaatatcattttgaggagaaacagtaattattaacttaatatcagctattccatatttaggaaatatattatcccaaagagtttgacttggtgatgcagtacatattgctactacccttgatgtctttacatttcttgttatggtagacttaatgatttgcagatgacagagcacatcgtgattcatatgtcgatgaaatat

SEQ ID NO: 16256 - DNA, 650 bp, Diabrotica virgifera
  misc_feature (16)..(33): n is a, c, g, or t
cccaaccgaggcccgnnnnnnnnnnnnnnnnnntcgcccttcctccaaaaggggcccctcttttttttgaattcggaaaaagggaaagccgagaagaaacgcatgtctaatgttatcttaaaaagaacgaaacaaaatgagcagagcaaatgggacaattgcttcataattacttattttctatgtgagcgcttattaaaaagtatgaattttgagatgtcacgtgtaagaaaaagatcgaatatcatgctgatagcgaactgcagtgatgacgaataaaaagaagaaggggaagaaacgagttgaaattatttaggaaagacatcatatacaaaaattattattataacaagaaatgacaaaggaatagggaggagggtacaaggaaaagttgattattaagggatactctgatacgtggaggaggagaaattgacatatcttacaaaaggagaatagagagctaaatagactatgattagtaaatacgataggcagactactaagagaaaacgtagatcatgtgaagtaagtagtggagacggtagtagaaatagaagagtgtacattaaatagaaatgcaaaagctaccgaaagggcagccactagatgaagcgcaacagcataagaaaagcataacgtgtcatgga

SEQ ID NO: 16257 - DNA, 935 bp, Diabrotica virgifera
  misc_feature (13)..(34): n is a, c, g, or t
  misc_feature (43)..(62): n is a, c, g, or t
  misc_feature (887)..(887): n is a, c, g, or t
accaaacagtacnnnnnnnnnnnnnnnnnnnnnnttatggctnnnnnnnnnnnnnnnnnnnntgttcagtccaagcacattccaaaagacggtcaagtaataatggctataatgaaagaaatggggataacagattatgaacccaaaacaattgtgcagctcacagaatttgtgtacaggtatgcaacatccatactcgaagaggctagaatgtattccaataattcaaaacagaaatttttgggagtggatgatgtccgtctagcgctgcaactaacctgtgaatctactttcacgacacctcctccacgagaagtattgatggaactagcccatgttaagaattattcacatttacctcaagtcaaacgccactgtggcctgagactaccccctgacagatactgcctgtcatcttgcaattacaccctcaagagctccaagaaaggcaaaggaaactttagtatggctggtagtccggccataaaaatgactccaaaagcgaatataaactttttaaagagaaccacacccacaatctcgaaacagactgttacgataccaaaaccaattacaaaagttattacaacacaaccccaattgcaaaagacattacttaaaccaaaaatagagattacacaaaatgtgcagatagcacctccaattaaaactgaaatggatttcgatacttctgggatattgaaacggaaaagagaggatgactctgaaccaatgcaaacatagttaatattttgataaaatctataagcagatatagataacttatattttatatatgatgtgtcagagggaaaaacgatgaatgtcaatttgtggtaattttgagattcttgcacaatctcgtagcttagaaagagtactatcanccctgtgatggccgagaggaaataacgatgagaattgccttaaaaaca

SEQ ID NO: 16258 - DNA, 914 bp, Diabrotica virgifera
  misc_feature (420)..(438): n is a, c, g, or t
  misc_feature (757)..(757): n is a, c, g, or t
acctgggctaccgtgagaatccgctaccgactgaggtacattgacttgctgcacgaaatcgtgcacgtagaggtcgaagaagacaagcaagaacgaaaactcagatctgttcacaaatatacaaggaggaagtatattgttctggagaggaattgcgatccgtcaaaaaactcctttaattttcatccaatcaactttaactgctcacaggtatgttgagaacctgtagttaggctctggagagatgcaacagtagaaaatttaattttcatgcatgataatggacctccacataccattagtgtgactagagacatcattgaagcagaaggcatcccttgtttggagtggactgcttactcacccgagcttaactctatagaatatttgtgggatatgcttaaaagaaaaattagagcnnnnnnnnnnnnnnnnnnnaacaccgcacggctagtataagctgcttttgaagaatggagcaacctaccataacaaaatgttgaaatttgattaggagcgtgcccgcgcaaacttaagcttgcataggactagatgtgataccactgactaccaaaaaaaaaacaatttaaacattagatttacattaatattaatttaaacattattagattaaaacaactagttttaatttgtttgttaaatactgtattgttttatttaattgttacgaatttgttattaaattgcttcaatagttatttatgatatgggtgttagaagtacacgtttagggcgngcatgtgaaagtttgcagaatgagcgatagtgagctctgcaattcacatgagtgccttaaaaatgtacttttttaccacgcatatcatacaatattttttctacaaacgtattaccggacaatatctaccaaaaacttttactttgacttgactgac

SEQ ID NO: 16259 - DNA, 812 bp, Diabrotica virgifera
  misc_feature (2)..(18): n is a, c, g, or t
  misc_feature (20)..(62): n is a, c, g, or t
  misc_feature (70)..(189): n is a, c, g, or t
  misc_feature (193)..(571): n is a, c, g, or t
  misc_feature (573)..(603): n is a, c, g, or t
  misc_feature (605)..(761): n is a, c, g, or t
  misc_feature (765)..(765): n is a, c, g, or t
  misc_feature (771)..(793): n is a, c, g, or t
  misc_feature (796)..(797): n is a, c, g, or t
  misc_feature (802)..(802): n is a, c, g, or t
  misc_feature (810)..(810): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattnttttannnnnnnnnnnnnnnnnnnnnnngtnntatanattattanta

SEQ ID NO: 16260 - DNA, 824 bp, Diabrotica virgifera
  misc_feature (3)..(45): n is a, c, g, or t
  misc_feature (53)..(84): n is a, c, g, or t
  misc_feature (86)..(160): n is a, c, g, or t
  misc_feature (190)..(287): n is a, c, g, or t
  misc_feature (347)..(364): n is a, c, g, or t
  misc_feature (526)..(560): n is a, c, g, or t
  misc_feature (592)..(612): n is a, c, g, or t
  misc_feature (636)..(648): n is a, c, g, or t
  misc_feature (650)..(685): n is a, c, g, or t
  misc_feature (689)..(777): n is a, c, g, or t
  misc_feature (780)..(796): n is a, c, g, or t
ccnnnnnnnnnnnnnnnnnnnnnnnnnnnnnnnnnnnnnnnnnnngtacctcnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnncttcgtaatcgaaatcgttattcgttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggacgagctctcaaaaataaaattttactcaaaatttaatttctcaaatcaaaaattannnnnnnnnnnnnnnnnntctttaaaatatcgttaaccacccaccctctcacaccaccacttctcacttctcacaaattttcttcatcaaatatcaaatttaaattcttttcaaatttcgtaatcgatcgataatatctcgtatctaaaaaaatcgtatctttcagtaaaaatatcatcnnnnnnnnnnnnnnnnnnnnnnnnnnnnnnnnnnncacccggttcataaaaacatcggtctttttcnnnnnnnnnnnnnnnnnnnnncggcccaccgattaatttgaacannnnnnnnnnnnncnnnnnnnnnnnnnnnnnnnnnnnnnnnnnnnnnnnnttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcnnnnnnnnnnnnnnnnntatagagtttcataaattataataagtt

SEQ ID NO: 16261 - DNA, 141 bp, Diabrotica virgifera
gaaaggtggcacgcctgcaggccccggcccgaaatccccggctcccttgcgggcccgggcatgagccaaaaagaagcatacgatctttttgaggtcaaaagaatgataagaagcctcgcgtgcgaataccctattataaga

SEQ ID NO: 16262 - DNA, 643 bp, Diabrotica virgifera
  misc_feature (192)..(209): n is a, c, g, or t
atgattttattggcaattcagaatatctgtgtgcagctggagggttaaattgtaatcattcaattgtataagatatttttataagccatatgttttagcttggaagagataataactgtagaataatataaataaagactaataaccatataaagcgaaaactaccaaagaagatggaaaagcataggtgtnnnnnnnnnnnnnnnnnngtacaagtactatatcagaaccaacgaaatcaggaataacattctttgcgagataaacaggacttgttgaaagacagtccgaaacttatatcgtactttaagagcatccacagatccaaaagaagatgcaggagtaatcagtagaggctgtatgatattaaagtggaacgagcaaccctctcaatatggcatgaactatagtgaagcgaacgctgatcgctaacattattgaagacttgcaccatgcatgacccaaacatcacttgatattgataaatgttttcgaggcctacaccacctcactgcctttactctgatctaatacatagtgaagatgactagaactataatatgcctggtgtcacacagtgaattaaagaagattagagacatgtcatgatgaaggaatcaaggacgtttgctgtgctgtccaa

SEQ ID NO: 16263 - DNA, 941 bp, Diabrotica virgifera
  misc_feature (260)..(318): n is a, c, g, or t
  misc_feature (386)..(403): n is a, c, g, or t
  misc_feature (812)..(812): n is a, c, g, or t
caactttgaagtggaggataagtagaatctaaatccaaattgcctatatatatagcaaatacgtcgtgacgctgataattacactccaaaacagtcatttactgggctattagtgtattcatgcactgtttaggacaacttacatttttcatctttattggtatagaataaaatagaaagaacattaataaacgactacattattacatagtattattctatgagatgatcaactttcttcgtgcactatctactatcannnnnnnnnnnnnnnnnnnnnnnnnnnnnnnnnnnnnnnnnnnnnnnnnnnnnnnnnnntatctatctgatgggcaacttcattttcaatactgcatggcttaaaaaaggttgcgcatgtatgcgcnnnnnnnnnnnnnnnnnncacatttttacatatatttattagacgacaagatggggccccccgcaagcttcgtgctgcgggggcctctgttacgcccctgcttttaacaacattttgttgactgttttttttttcggcaaaaatacgcttcggcttgaaatgctatgggtttgtggacatctggggaagacgatggacgagtattgtagcattctgttaaaaagttggaaattgtgtttaaacttgtttcctgtttcaaaagttgtgcggtgctttttgcgtttagtgtattaacattttcaactagggctacttacctagtcccggtctaaatcacacaaatcattatgtcctcctctacatcagttaacatctccttctcttcattaatccatcagtactagaaaaattatctttaataaactanatattttttctatattctataaattcaggaacagactacttatacttgaaaatgcatacctacatttcaaagtattgttatagttatgtattttggaataaaaaacttttattggatttgtttacttta

SEQ ID NO: 16264 - DNA, 816 bp, Diabrotica virgifera
caatgtgttagctgaaccatatgcgttttcaaagaagtgtatcgtttcttgataattaagaacagtgtgatttttttcgtcttcgaaaaatgctttagttggttccatctgtttctttatatcaagagtctctcttgtttgggtagttttcttcttttttgaacgtgtatctgtagtaggtcgtttaaagcattcaggagtatcaggtggtgttactgtttcggaaaaagatcttttgctctgtatttgtagcgtcggctcttcgttaatttgtgaagtgaacgatgattcattgatttctggtccgggttcattaacgtttatatctttatttgtgggcgggttctcggtttctggctttggtgtgtcgcatttgtttgttatattaaagtctttatttttgtgttgtttagattgactatcttctacaaaatgatttgattcagaatggatttgtgctgaatgtattgtcacatcagatatagtgtctgctgtagttaccgtgttatttattactgaactggagttattgtttttttgaggacagtttgaggctacatgatcaatatttttacaaatataacatgaatgttggtctaaagacatacaaattctgttggttgtattgttattacaaattaataaggattcaggaagtattaggtcgactaaaggtgaaatatatacctgtctgcggaaacttagtatgtgttgaaattcaggacgagatgtgccaattctaaggaatgatatgggagacataagtttaacacctagtttctgtagttctgtttctagaatagtatgtggacttga

SEQ ID NO: 16265 - DNA, 799 bp, Diabrotica virgifera
cggacgcgtgggttggtatatatcagttctttttcccaacattactgataagagatgtaaagctagtcaaacaattaggagtaaaggattttgatcacttttcggatcatcgccctatcctcccggagaaatgtgatcccctatggagtagaaatttgttcgctcttacgggacaaagatggaaggacatgcgtccagttcttagcccatcgttcacaagcagcaaaatgaaaattatgttttcgctgatgtcccaatgtggcgacaatttggtcaaattctttatggaaaatgacaagaatactatagaaattgaaatgaaagacatatttactcgtttcactaatgacgtcatcgccaccacagcttttggagtagaggtcgattctttgaggaaaccagaaaacgaattctatcttatgggaaaggaaacaaccgatttatctggtttctggaaaagtatgaagttttttggatattcgattatgccaaaagtatttgagttattcaaactgaaaatatttgataaccacgttcgaaagttttttactgaattagtttgtgacacgataaaagtcagagaagagaaaggaattcttcgtcctgatttgattcatctactcatggaggcaagaaaaggaatccaccaaaacgaagaaaaggttatggatgctggatttgctgtagtacaagaatcgaatttggcaaaagcagttccgactaacatgaccgacttggatattaccgctcaagcactgattttcttctttgctggctttgatacggattcgacagctat

SEQ ID NO: 16266 - DNA, 822 bp, Diabrotica virgifera
gtatctcctcagcgatctggtttatctcttcctgcattttctctaaataaaccttcatattttcagaaatcgaggaagaagacatgtagtctggcccttcgaataaatgaagaaaagacaaactacacgttcgtaatcaatagagagcggaatatatgcaacacaacattaccaaaatatgcgcatatatatgcattacttttactacaaatatgcaggtatttttttctaaatttgtctaaatatgcaaatgcatattaaaaatactcaaaaataaaacaatatattaagtcgtaagatcttcagaaaagttgccttcaaaaatacgtacaactttcctcaaacaatcgaagccctcatttttttctaaaacagtttttaatttatttctaattgtaatccctgtatttccgggaattttttgacaatgagcagaaaaagtgttaacaagattaaccgaatcacttaattgtaaattcctttgttctaatgactttattagatctggtaaaaaactaaaattaacttttatgaacataagttctttagcaatttgtacgttacttaaagaacaaagtacgttacttaagctgaagaacaaaagcggaattgtctacaatttgatggatttttgtattttgatgcttctctctatgtccgtctttatagaagtaaaagcgaatttgtcgaataaaaacactctttctagaaaaatttcttttgtgggacataatgcttttgtttgtcagttcctcatttaaaaaatgaaatggtgaaaatgaatggtaacttacgatttttggacaggcccttgcaaaatac

SEQ ID NO: 16267 - DNA, 860 bp, Diabrotica virgifera
  misc_feature (405)..(424): n is a, c, g, or t
  misc_feature (823)..(823): n is a, c, g, or t
tgaattcgaaaggaaggaagtaacatctaaggtgaggtagcggataacatcttccaccggcccgaacatcatggctgaagcggagcaacaacaaacagcgccagaacaacctaaggcagtcccaaaacagaaggaagtacttgcaactaaggtaactggcacagtaaaatggtttaacgtcaaaagcggttatggatttatcaacagaaatgataccaaagaagacgtttttgtgcaccaatcagccataataaagaataacccgaagaaagccgtccgatcagtgggcgacggtgaagtcgtagaatttagcgtagtcgtaggtgaagtaacgaggcggccaatgtaaccggccctaatggtgacccagtaagaggttcgccttatgctgccgaccgaagaagnnnnnnnnnnnnnnnnnnnnacccgagaggaagacgtggacgtcgtggcggtagccgaggcggcggaccgccaagggaaagccaaagtgaaggcgaattaaaggatggggtacaatcaggcggtgaaggcggccaaggtggccaaggacccccacgtcgttatgcaccaagacgcggacgtggaggatattcatattacaggggaccctatcgcggaccgccaggagaattagaacaaaatggagatgctccccgtggtcgtcgacccccacgtggctttttccgtcgtaattatcgtggaggtcgcggcggcgcaagaccacgttcccaggacagccagggccaggctggagagctaaacggtcaagaaggtggaccacgtggacctcgtggacacgctaccgcagacgtggcccagncccgtccagagccggtaactctcagtcagagtctgca

SEQ ID NO: 16268 - DNA, 530 bp, Diabrotica virgifera
  misc_feature (27)..(44): n is a, c, g, or t
  misc_feature (98)..(112): n is a, c, g, or t
aaaaatataggaaactcttaattacgnnnnnnnnnnnnnnnnnngaatcaacgtataagaaaatagaatagaatataaatagtatttattcatagttnnnnnnnnnnnnnnnacgagaagcaaagagagtgtgaagtgatatcatatgtatcacttggagttagatatgtaaatttaaacaacaatgaagaaattttatatatacatctttctgcatgattgtctgaggagtgtagtcttaaatattgttttttaaacagttgtataagagaagaaaatttataaatctagtacatctatataaagtaaaattcatagattagtttgcagtggttaacgaatcttgactaatatgggttgataaaaagaaggtattatctgatgttcgtacatagatggaattaaaaatatgactaaagatactggtatacatagttgtacaaacaactatagacaacaatcttcgcagagattctatatgcacatgatatatagaagttgttaacaattgccaaggagtaaattggatt

SEQ ID NO: 16269 - DNA, 63 bp, Diabrotica virgifera
  misc_feature (5)..(58): n is a, c, g, or t
attannnnnnnnnnnnnnnnnnnnnnnnnnnnnnnnnnnnnnnnnnnnnnnnnnnnnngggtg

SEQ ID NO: 16270 - DNA, 788 bp, Diabrotica virgifera
  misc_feature (7)..(35): n is a, c, g, or t
  misc_feature (37)..(52): n is a, c, g, or t
  misc_feature (54)..(96): n is a, c, g, or t
  misc_feature (104)..(216): n is a, c, g, or t
  misc_feature (225)..(413): n is a, c, g, or t
  misc_feature (415)..(776): n is a, c, g, or t
cccttcnnnnnnnnnnnnnnnnnnnnnnnnnnnnncnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagctta

SEQ ID NO: 16271 - DNA, 296 bp, Diabrotica virgifera
  misc_feature (15)..(178): n is a, c, g, or t
  misc_feature (193)..(218): n is a, c, g, or t
  misc_feature (231)..(254): n is a, c, g, or t
ccccacacaggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaaaagggaaannnnnnnnnnnnnnnnnnnnnnnnnnggaggaaaagggnnnnnnnnnnnnnnnnnnnnnnnnggggggagaagaaggggagggggagaaaagaaagggaggaaa

SEQ ID NO: 16272 - DNA, 727 bp, Diabrotica virgifera
  misc_feature (2)..(657): n is a, c, g, or t
  misc_feature (661)..(661): n is a, c, g, or t
  misc_feature (672)..(725): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgnaaatgaagggnnnnnnnnnnnnnnnnnnnnnnnnnnnnnnnnnnnnnnnnnnnnnnnnnnnnnngc

SEQ ID NO: 16273 - DNA, 602 bp, Diabrotica virgifera
  misc_feature (199)..(314): n is a, c, g, or t
gcctttaagccccgctgcagttatcttcaataccctctaccctttagaagacttatcgcaaccatgatgaggagacctagcttcgtactctgagcgtgaggcagacatgtcgaatatctcaagatttttaacattgtcaacgatgatcgttcacttatcaattctgttgataagcaatgggtatgaggcagtctgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctctaaaggacccaagttttcgacctcgggaatgctccgtataagcccttcataaaggcaactaaaaataaacccaaagtccgactttttacaacgattagactgagaaaaccagggcattaccccatttattaccatggtggaaatgccccctttatcaaggtgacatataataaaaaatagccgtaccaacgccccttccaaacagtgtaatgaagctaaaggctaaatggaatgagcctcgaagagaaaaataaaaagtgtggaaagcagagaataataaaga

SEQ ID NO: 16274 - DNA, 922 bp, Diabrotica virgifera
  misc_feature (841)..(841): n is a, c, g, or t
  misc_feature (857)..(857): n is a, c, g, or t
  misc_feature (883)..(883): n is a, c, g, or t
attccctgttagaaacaaaaactagggctcgatatatcggcaattgcttccgcactaaatatggaaatatttgcttttaatttgaacattttttctaccttttccacggggatgtaaaaggcacatcctgtaccgtcttctgatttggaggcatccgtgtagatagtactcgtggtaatcccaattggataagatgcttcgttataatgttgttatttcgctcttccagtgtttacataatttggtttaataaatttaatgtcataaaaaaatgtttcaaaatcatttatatctgtgtgtgatttttaagttaatagctccatcagcagaaactcgtgttttctctaagagcttcacatagggttggagagtttttctttatccaatatttattcgttaaatcataattgtttaaatttattaattcggtataaaggaaagtgttctggtgtttaattttcagtaaaaatttttcggccaggaaatgtcttctaagagaaattggaggttcaagtgcttcaacataaaggggctcaatataggagttgtcttcatcggcaccaatacagatccgcagacactggtttataaatatgtttaatttgtttagtaagttctttgctggcagatccatataaccaacatccataatctacgataaagcgaatgtacgtcctataaaaaagtaaggaagtctgaacatctgttccccaccaagttttagttgtcattttcagaaagtttaggcctttttcacatctatttaacatatattctatgtgaaatttccatgtgagtttgtcatccagtataatgcccaaatatttaactacctttttanaaggaatttctcgctngtgtactataaatggttctatattgngaatattatgtctactgaaaatggtcattttactgattt

SEQ ID NO: 16275 - DNA, 872 bp, Diabrotica virgifera
  misc_feature (747)..(766): n is a, c, g, or t
  misc_feature (800)..(800): n is a, c, g, or t
gtcatccttccgcacgattacaatgcttagtattagtagggtaaaagttaatgtgtgcagtacgcaagtgtgtttctctgcacaatcgcggtgatcagctgtgaaaggactagctttggtagatttagagagatttttcggcgctgcctctccgtctattacttcgaaatatttataactcttcagtaatttcgtgtataacagaataaactgaaattattggaacaatccctctttactatagtttttgttttccactataggttttgaatcgataataggttcttcctctactcttaacctaattcatccaacgtttcgtcttccgaatatttgacaacgacaagagaagattgtttgatgataattttattttatgtgtaataactaatacgtttatattcgcacaaccaactttcagcactaagtaaaggtgcaattatgcaagttgaagtgcattgcaggaaataaagcagattctaattttcgtcacgtttgacatgacatcatacgcattctttgtgtacctacatttagaagtataatgtgtaaatttcgtctgcttttattataaagaataattctgtttctgatcacaaatttatcacaactacaaaataaattcttactctactttatcaattttggtgactggcttaaatcgatcaaaaatgacaaaattgaatgggttaattattagagatcgttttcagcggaattgtattgatgatagtgattggattgtgnnnnnnnnnnnnnnnnnnnnctggacagggataagaatttatttataaaaagtntgtatagattgtgcttttatttatttgatatgaaatcttatgcctttagaaacattattcactatgtatcaa

SEQ ID NO: 16276 - DNA, 558 bp, Diabrotica virgifera
  misc_feature (2)..(44): n is a, c, g, or t
  misc_feature (52)..(164): n is a, c, g, or t
  misc_feature (174)..(287): n is a, c, g, or t
  misc_feature (289)..(354): n is a, c, g, or t
  misc_feature (356)..(387): n is a, c, g, or t
  misc_feature (389)..(544): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacag

SEQ ID NO: 16277 - DNA, 135 bp, Diabrotica virgifera
  misc_feature (101)..(134): n is a, c, g, or t
cgaaaggtaacatttaattgcactgctgctatttgcacacacagaaactaattctctgaactaaaatttaattatatcaatagaagtgatatgatggaaannnnnnnnnnnnnnnnnnnnnnnnnnnnnnnnnna

SEQ ID NO: 16278 - DNA, 759 bp, Diabrotica virgifera
  misc_feature (3)..(40): n is a, c, g, or t
  misc_feature (53)..(98): n is a, c, g, or t
ccnnnnnnnnnnnnnnnnnnnnnnnnnnnnnnnnnnnnnnaaccccttattcnnnnnnnnnnnnnnnnnnnnnnnnnnnnnnnnnnnnnnnnnnnnnnaattgtgaaagaatattttacctccacaatatacaaactgatgttctatatgtaccaccaacaaaaggaaaaactcagataaatggcatctgagttgcaacggaaaatgggagctccctgactaccacagtaagtatttgtagtgatgctgttagaaggtattaggatgataaaaatattggaggtgctcactccatgacacacatgaaattgaccgagacgaaataaaagaacccaatgtgagttagaatcttgacattgaatacctatgtgcccaagtgtatgcctacactggcacatatgagacttgattattattccaaatgcttagtcaaaaatgtaccaccagtcatacaaatcttgtgtgatatcatcctagaatgccaaattgcctagaacgtgcagacgaacgacaaacaggtgaaatccttacagtgaagcaagaagtcaaatctattttagaagaagtgacatattagcctttacatgagattgatgaccaataaacacctttagctaatactatcgtattacccactgacaacacttacacgactcaactccacagatcctagaaatgaccttgactaccactacaaatctataacatgtgttgctggttgaggaagtgtaatgaaacaccaagatttagtgaatctct

SEQ ID NO: 16279 - DNA, 299 bp, Diabrotica virgifera
attgattgagttgtcacagctgtatctattatatagtgtgaatatcgagtgtaattttaagaatttttcaagtgtacaacatttcttaggcttccatatcacaaaatactgcagtacttaatttgcttaagagccacaagcgctaaggccgccaataccaaaggagatggaaatgaaatacgtgagctagttatagtagctttttgcacagctgctagatgagaataaagaaaattaggaatgagattaagttgcagatgagtaggatgtgctgatctacaatgaagaagctgattagc

SEQ ID NO: 16280 - DNA, 310 bp, Diabrotica virgifera
  misc_feature (2)..(108): n is a, c, g, or t
  misc_feature (111)..(145): n is a, c, g, or t
  misc_feature (147)..(179): n is a, c, g, or t
  misc_feature (183)..(225): n is a, c, g, or t
  misc_feature (249)..(276): n is a, c, g, or t
  misc_feature (278)..(293): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnncnnnnnnnnnnnnnnnnnnnnnnnnnnnnnnnnngagnnnnnnnnnnnnnnnnnnnnnnnnnnnnnnnnnnnnnnnnnnnctaagaagcttacattgttttagnnnnnnnnnnnnnnnnnnnnnnnnnnnncnnnnnnnnnnnnnnnncttctagtattaaagtg

SEQ ID NO: 16281 - DNA, 625 bp, Diabrotica virgifera
  misc_feature (4)..(417): n is a, c, g, or t
  misc_feature (420)..(434): n is a, c, g, or t
cttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntannnnnnnnnnnnnnngtatttacatgcatgaatgatgatcacatgagaatgaaaaatgttgtatattctgacaccacatgagtgcgtttactctgatcatgtatagtatgatgttgtatatgatctataataatggcttgtgttaagtgggaattaaataagatgagagacatgactggtgtatgaatcaaggtagtttgctgtgc

SEQ ID NO: 16282 - DNA, 910 bp, Diabrotica virgifera
  misc_feature (314)..(331): n is a, c, g, or t
  misc_feature (400)..(422): n is a, c, g, or t
  misc_feature (481)..(498): n is a, c, g, or t
  misc_feature (739)..(739): n is a, c, g, or t
  misc_feature (821)..(821): n is a, c, g, or t
  misc_feature (897)..(897): n is a, c, g, or t
actaagcaatataatctaacagaatacctgattgttgtgattcatataaaaagtattttgttgtagcaaataggtgtattctggccaataaatctttagaatatatgaagttgttgcacataaagtaaaattgctagttttctaaaaatcataatattctaaaagatctattcaacttgaaatttaaaacttagacatacaaggaaatattttatagcagtattaaatttttttctcaaatactttgagaaaggagttattctaagtattaaaattttttctcgaatattttgagaaaggaattattctaggcnnnnnnnnnnnnnnnnnncaaaacaatactaccgaaaaatatctataagttctgtattaacagtctaaaagaataccacacatttcnnnnnnnnnnnnnnnnnnnnnnngtgtgttactttagtttcttccattaaagacaaactggtatagttacaacacccagtgnnnnnnnnnnnnnnnnnnacattgacatttgacattgatatttaacattgacatttgacatttataaaatgacaggaactgtttagtgctacaactttgtgaacaggtatagtgatgattcggtagtattctttgttttaaatgtatctttatatttcagtagaaggtttgaacactaaacaagtgaacacagtaagaaaaacagtatttatagttccaaaggaactgtgtgacttggtgccttaatacctgaatctgngcttttctccagacgatggaaaagaagtgaaaacagggtttggtaacaaaatctaaaggaagaatagtcatttgttccttanaacacacagaatgcgtagattccaaaaaatcacaaataacagctattttgatcttgatcacattcaatgacaatgntaagttttctttt

SEQ ID NO: 16283 - DNA, 309 bp, Diabrotica virgifera
  misc_feature (2)..(36): n is a, c, g, or t
  misc_feature (38)..(66): n is a, c, g, or t
  misc_feature (71)..(90): n is a, c, g, or t
  misc_feature (95)..(95): n is a, c, g, or t
  misc_feature (100)..(279): n is a, c, g, or t
  misc_feature (288)..(289): n is a, c, g, or t
gnnnnnnnnnnnnnnnnnnnnnnnnnnnnnnnnnnngnnnnnnnnnnnnnnnnnnnnnnnnnnnnnatatnnnnnnnnnnnnnnnnnnnnataantttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattaanntagttttttagtattaaatt

SEQ ID NO: 16284 - DNA, 991 bp, Diabrotica virgifera
  misc_feature (47)..(77): n is a, c, g, or t
  misc_feature (80)..(113): n is a, c, g, or t
  misc_feature (115)..(307): n is a, c, g, or t
  misc_feature (309)..(449): n is a, c, g, or t
  misc_feature (451)..(613): n is a, c, g, or t
  misc_feature (615)..(646): n is a, c, g, or t
  misc_feature (648)..(707): n is a, c, g, or t
  misc_feature (709)..(741): n is a, c, g, or t
  misc_feature (764)..(801): n is a, c, g, or t
ccccttaagcgtccgaattttttaagaaataaccccctgttagcccnnnnnnnnnnnnnnnnnnnnnnnnnnnnnnnccnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnntagattaccttacggataacagnnnnnnnnnnnnnnnnnnnnnnnnnnnnnnnnnnnnnntgcgagctcgatgtaggattaagcttataaatgaggtagcaggtatattattaaggctgttcgacttttaaaattttgcatgatctgggtttaaacgggggtgagcccggttggcttctatccttaagtgataaaatattttgggaccaaggccccaatatttaaatcaattttatattccataatatcc

SEQ ID NO: 16285 - DNA, 159 bp, Diabrotica virgifera
  misc_feature (5)..(49): n is a, c, g, or t
  misc_feature (56)..(157): n is a, c, g, or t
aagcnnnnnnnnnnnnnnnnnnnnnnnnnnnnnnnnnnnnnnnnnnnnnattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaa

SEQ ID NO: 16286 - DNA, 463 bp, Diabrotica virgifera
cttcacgcgtccgcacataagttaatgtaacttttctacttattatttgtaaaatgtgtaatcaattttgtatgtgcaacatacagtagactccctctataatgagaactgaaatgtcggactaattacctcgttaataagcggacctcgttatatcagacaacaataatattgaaacgggttgatgcctcttacgtagtttattaagtgtcaatggtcgacatgaataagggcagacttcgccatcgtaaattgtaaatgtcctacaatattcaatatcgctcgatagataaacaagaagtttattacgggcggggagtttattacagaacttgtctcgataataacacagatgtggtgaatttttttatatacgatgaggtggtgtgtatttatatctctcgtacatcgataagaagcgaaaaaaatcatgcttttctgaagcaatttccttaataatatt

SEQ ID NO: 16287 - DNA, 240 bp, Diabrotica virgifera
  misc_feature (7)..(44): n is a, c, g, or t
  misc_feature (61)..(61): n is a, c, g, or t
  misc_feature (64)..(77): n is a, c, g, or t
  misc_feature (79)..(102): n is a, c, g, or t
  misc_feature (110)..(131): n is a, c, g, or t
  misc_feature (175)..(175): n is a, c, g, or t
  misc_feature (179)..(179): n is a, c, g, or t
  misc_feature (200)..(230): n is a, c, g, or t
taacagnnnnnnnnnnnnnnnnnnnnnnnnnnnnnnnnnnnnnntgcgacctcgatgttgnatnnnnnnnnnnnnnngnnnnnnnnnnnnnnnnnnnnnnnntggtcgannnnnnnnnnnnnnnnnnnnnnagtttaaaccggtgtgagccccaggtggtttctatctttaattnattnatatattttagtacgaaaggnnnnnnnnnnnnnnnnnnnnnnnnnnnnnnngataattatt

SEQ ID NO: 16288 - DNA, 726 bp, Diabrotica virgifera
gatgaagatgatgactgacatgacgttgcctttatctagaactgacaggtatgtactcatcgtaataaagggagacagcgaagtccggatctttggcaaaaaatttcgtcatgtaaggagtatatgattgggagacgataacgacgcatccgatcctattcgttgcgaatccgcttgtcttagctcactctttgaaacaagatgatgcctccccgaaaactggaagctcctattaccccatataattacaaagttgcatgtgatgcccgataatatgaatgttcaatacatcaaacaaaaaacatatattacactcgaaagacgatccgaatcgccgtatggtgacacgtcctgaactataaatgacctttaccaagatccactgctgatgtctcacgcgaatacatcaatgtgcaattttgaatgcatacaccacgctataacaacactgagatgaattatttgaacgagacagatactatcagcagatcctcatattagctgtacagactgattcaatatctgcagacattgcataccgaccgtacaacgaaacttacaaagaactaatcctctttgtactaaatactccaagatatgatcgtagcgatcaaggccttctctattttatagtattgcgcacgtggtactcaacggacatactctatgcatttgccatttatttataatctatctttctcagactgttactcatatttgtcagca

SEQ ID NO: 16289 - DNA, 322 bp, Diabrotica virgifera
  misc_feature (5)..(39): n is a, c, g, or t
  misc_feature (112)..(129): n is a, c, g, or t
gatcnnnnnnnnnnnnnnnnnnnnnnnnnnnnnnnnnnntgcatagaagagtactaatattatgacatgcgttaacatatttttatatcttcttattatctattaatatcannnnnnnnnnnnnnnnnnccttgaacttatattaatgtacgtccgcatgaatatattaggactgcaacatagtatatataatagctgtgatttcggttaatagaagaaattctctgctttttttgcacctgagttattatatgcctgatattattgctaattacaatgacagcgtcgccctgaccacgtgattatttggaatgagtcgcgc

SEQ ID NO: 16290 - DNA, 947 bp, Diabrotica virgifera
  misc_feature (844)..(844): n is a, c, g, or t
  misc_feature (849)..(849): n is a, c, g, or t
  misc_feature (896)..(896): n is a, c, g, or t
  misc_feature (899)..(899): n is a, c, g, or t
  misc_feature (905)..(905): n is a, c, g, or t
ctcagtgcgaaaaacttgaaggtgtaattctgcatgaaaaaataatgaccgtttgctttataaacatgtccgcaagtgcttcttttctgagatacgagatgttgatttttttcttacaaactgacgatttatttattgctctaaaaccggttgagatatgcaaatgaaatttggtaggttttaagagatagttattgcacattttttggcatgcaataaagaattttatattctccattggcgcgcatacgggtcatattaccggcagctctagaatcaatatttaagaacacatgttatgggcatcaatatagatgaaacaaatctaaatcatctgagctttgcagatgacagacattgtattaattgcaggcaacttacaagacaccgtttctatgatacattcgcttaaaactctgtctgaaagagcaggattaaaaataaacttgtgagaaaactaaacttatgacaaatctcgtaatgagtggaaataaaactagtaacaataattccataccacaaatagacacaaatatctgggatacgagatcaaaataagcagaaacagtcaaacacatgaaatacaaaggcgaataggtctgacatgggcagaatttgacatactaaaccatattctaaaaagttcaattcccatgtgtctaaagcgaaagttctataaccagcgtgtctttcacgtacaaacatatttaacagacactacaaaaagaccgttcaagagcaaagctcgttcaagacgtcatcgaaacaatcacgacgcttaagtggaactaggcagggcatttagctagaacacaagacggacggtggataagactattcatgnaatgnaggcccagaaactataaaagaaagccgagacgactaccgaccagtgncgnatccgngggagggcgatggggcgatcggcccccctctcaaatgatgct

SEQ ID NO: 16291 - DNA, 955 bp, Diabrotica virgifera
  misc_feature (183)..(267): n is a, c, g, or t
  misc_feature (443)..(472): n is a, c, g, or t
  misc_feature (875)..(876): n is a, c, g, or t
  misc_feature (891)..(892): n is a, c, g, or t
  misc_feature (898)..(898): n is a, c, g, or t
gtaaaacaagtcgcttacccgccggtttgtagataattaattgcattttacgagttaagttaaggttacaaacaataaaatacaatgggttcttacttgtcggagccagtaactaataaagtatctacagatgagagtaacgataaattaagttgtggcgctagttctatgcaaggctggcgnnnnnnnnnnnnnnnnnnnnnnnnnnnnnnnnnnnnnnnnnnnnnnnnnnnnnnnnnnnnnnnnnnnnnnnnnnnnnnnnnnnnncacgaggtggcccaatattgttctcaaaagttacctcaatttataaaagacacacaagcttataaagatggtgatatcatgcaagctttgattcaaggatttttggaatttgatgcaactattcctacaaaagatgtggtagcagttctgaaggaaatagccggtgaaaaggaggnnnnnnnnnnnnnnnnnnnnnnnnnnnnnntagataatttgtatgaagaagctacgatgcccattgaacaggttatagaaaaatacaccaacctagtaaatccagttctgaaaagtcttaaaaaagatggcgataaatttccaaaatctccgaacttaaagagcaaacaagaagaagcgggaagttcatctgggtcatcaactatttcaaataaagcatctaaggatgattccggaaactctgaagatgccgctgggtccagcattgaggtgaaatctaccaaagaatcttcatcaagtccagaaaagaacgggtcaattccagagattaaggttacttcatcagaaagtccagaatcaaaggacgcacctcaggaatctcaggtgacacagaacggagaggcatcggaagacgtgaaaacggatggtaccanngtcactcccacagannaatggngatgtcagtaataaagggtaaggaaaagccccgataccgaaatctcccccaaaacct

SEQ ID NO: 16292 - DNA, 608 bp, Diabrotica virgifera
atttgatgaacctcagctacgacaacttataaaagattagcattttacagaatggatgactgaaattgaatgtaatgcattttatatgttattgctcttttgtgaaagttgtggaaaattttcttagtaaatcggaaaattaccgggatatagcggaagatatgctcaacaattttaacaaacacggttgccatatgagtattaaaatgcattacctccacagccacttagaccgtttcccagagaatcttgactttcttggtgacctcagtgaggaacaaggcgaacgcttccaccaagatatcaaaacgacggaagagaggtatcaggggagatgtgacactcacatgatggcggattactgctgtagtctttaaagggaccctccttttaaagactttgccagaaattcatatatgtaaaagtagaatatttatctttaatagtcatttatataacaaaaacagcacacatgtctttcatcaacatatgctattaggtaactccgatattagatgatatttgtactatattatactccgtaaactgataacttcattaccaataatataacactgcatgatatgcagtgcgtctcttcatgccct

SEQ ID NO: 16293 - DNA, 614 bp, Diabrotica virgifera
gtctttcctctcgcgtccgatgcatgttcaatcttcagagatctcacttcactttccaacaagacactggtttacttctctacaacggcaacaaaggtagcgacataagcggagactacatctctctggctttgaaaggtggcgttcccgaattcaaatacaacttgtggagcaggaacgaccctggttagagcagacagacctattactattggcgactggcatacaatcaaaatctcgaggaatagaaggaaggtaacgatgtacgttgacggagacggacctgttgtagctgttgctgacggacaataccccgatagatacacgtgaacgaatttaggctcaagaatatagatatcatgtaataactgctgcaaaaacaagactataaatctcgggcagataagactgtcaatcatgcgaagcgcgtgatcacagaagggcgcatttgcgtacgccagacaagttgtggagattcccgccgtaatacaaagttaggaatcagaaacaaccatacaacttctctcttgaagatactttgtaaggaggacgtacagtaagggtatagatgatgtagatcatccacaaaagcgctgatgacgtccggactgaag

SEQ ID NO: 16294 - DNA, 946 bp, Diabrotica virgifera
  misc_feature (802)..(802): n is a, c, g, or t
  misc_feature (849)..(849): n is a, c, g, or t
atccgaacatcctgacttggtaaaattaagatctgtgggaaaatctgtaagaaatagggatttgtgggctttagaaataaattctaatgtccaaaacaggacattgttaacaccaatgtttaaatatgttgctaatatgcatggggatgaagccataggaagacagttgatgatttacctggctctctatttaattcacaattatggcactaatgatagggtgaccagattggttaattcaactgatatttatttaatgccttcaatgaaccctgatggttatgaaaattcagaagagggcagatgtgaatctaaaaaacaatatgttggaagagaaaatgaaaatagtgttgatttaaatagagattttccagatcagtttgatgctacaaaagcaggaacaattctgtctggtaggcagcctgaaacgatagctatgatgacttggattatttccagaccatttgttttatctggaaatttgcacggaggtgcagtagtagctagctatccgtatgatgattctaactctggtcgaagatgctgtgtagagagtagatcaccagataataatattttcaaaacgttagcattaaactacgctcaatcgaatcctgtgatgaaaaagggtaatgcttgtaaagacgatacatttgatcagggcatcacaaatggtgctttttggtatgaagtgagaggtggcatgcaagacttcaactacgttcactccaactgtttcgaagtaacttttgaactgagttgctgtaaatttccgttagccaaaactctacctcaggaatgngcaacaacaaggaagccctactaactttcatggagtcaacacattgnggcgctaagggattggttagaaacgaaaacggtgacgccgttttggacgccgacgtagtggttgtgggtattacacataacgtcactacatccaacc

SEQ ID NO: 16295 - DNA, 52 bp, Diabrotica virgifera
  misc_feature (33)..(33): n is a, c, g, or t
acccttagggataacagcgtaattttatttggnagagtcaaatcgataataa

SEQ ID NO: 16296 - DNA, 887 bp, Diabrotica virgifera
  misc_feature (830)..(830): n is a, c, g, or t
  misc_feature (876)..(876): n is a, c, g, or t
ggaaagatgcgttgcagtgtattagtcgttttaataattgcatccatttttggatgtaatgctgacaacttgaacagcgttgttcaaggcaatgatgaatttacagcgaacacttacaaggaactcgtgaaaacattattcttagtggactgtctgcagaaatcgtcttatctttgcttgcaatggggccaaaggagaaacgcaaaaacagctgttgataggtttgggcttacccaataacataacagatgtaaataaggcattcactgaaataacatctcgcctaaaggtcaacacacccgatttaaaattgttatcagcaaacaaaatttatccagcgaaaggttttccaattgaaaaagcattccaagatgttgctgtgaatgattataattcaggcgtacaaaatctagactataacaaacctgcagaagccgctggcactatcaatggctgggttgaagaccaaactaaccacaaaatccaaaatctcattgatccccaaatgttggatgctagcacagtattggtattagttaatgctttatactacactggaaaatgggatcatccattcgaaaaatacaactctgctgatagattgttccacagctcacctactgaatccaagaaaatccccaccatgtacactgaagcattcgccaaatacgcttacaatgacaaacttaaagctaaatttttggagctcggatttcaaggcgcaaatgttactatgacctttgtattaccggacgaaatcaatggattagcagctgctgaacagaacttgaaagaatacttggctccacaaccattggcatctgctagangtgccatcaccctacccagattcaaaatcaacacaaaaattgactnttaaccgatct

SEQ ID NO: 16297 - DNA, 965 bp, Diabrotica virgifera
  misc_feature (830)..(830): n is a, c, g, or t
  misc_feature (949)..(949): n is a, c, g, or t
gttgcttaaagttgtaatttacggtttgatttgttgttgctttttgagttttttgaaagcgaatccaagggattggcccaatccgacggtttttaacatcggaggggttcttagcagtaatgagagtgaaaaatattttcaggagactattgcgcatttaaactttgattcgcagtatgttccaaaaggcgtaacgtactaccacacagctatattaatggatccaaaccctatccgcactgccctgaatgtctgcaagtacttgatatctaggaaggtatatgctgtcgttgtttcccatcccttaataggcgatctatccccagctgcggtgtcatatacaagtgggttctaccatattcctgttattggcatatcgtctagagattcagcattttctgataagaatatacacgtgtcatttttaagaaccgttcctccatactcccaccaagctgatgtatgggtagaaatgttaaagcacttcaaatacaaaaaggtaatatttattcatagttctgatacagatggaagggctttgttgggacgcttccagactacttctcaaagtttagaagatgatgtggatatcaaagttcaggtggagtccgtaattgaatttgaatcaggattggatagttttcgagatcaattattggagttgaagaatgctcaatccagagtatatttgatgtatgccagcaaaaacgacgcgaaaattatattcagagatgccgcagcatttaacatgacagatgcaggatttgcttggattgtaacagaacaagctttagaagctgataatattcctgaaggaatattaggcttanaactagtcaacgccaccaacgagaaggctcatatcagagatagcatatacgttttagcttcagctctgcgtgacatgaacccaacgaaggaaatcacagaagctccctgagactgcgancatttcggatccattt

SEQ ID NO: 16298 - DNA, 930 bp, Diabrotica virgifera
  misc_feature (866)..(880): n is a, c, g, or t
  misc_feature (913)..(913): n is a, c, g, or t
ggttccggcatctgtagcgagttcttcaaattagtgggtgaatattttcgatattttggaataatcctcagacatggcgttacattgtgagaaaattcgcatattgaatataataatcattataatgatgatcacttatgaaatatcagctagaccgggaaatgagtggagacagaacaactcatgtcaagacaaagattctataaagcgtgaaatctgccagagatgtgccaaacagaccaaatccctactggcataccctatgtgctgtaatgaagaagatgcagtccataaatggtgctatcattacaccacctatggcaaggtcgcataggaataatagctatgctacttgttaataaattagtgtgataggggattcagtacgaagccaccaacaatcaaatttatcaaaaagaaaatctttgatttagtcagaggaatggtgcgtgtggacggacttttatttgtgatattgtaaagtatacaagtgtacgttaagaatctcgtgtgtatataaaccccatatattttgtgtttatactagaagaggttccgatgtgaggctgacctgcgccgatctgtttaatggataaaagttatttgatatgagatttagtacgttaaaaatgataaaaaacaggggatgccgcatctgattttgacataactataattaattaatacataatcgtcccaggcagatatcattttggattttttggttcattcgaaacaaagaaggttttttgtaatttttctcttattgattgttttggagttgcaaacaatttacaactgaaaaaacgcaagttcacaattttcaaggctcaaacacaagtagaaagtattatataaagcacctnnnnnnnnnnnnnnnccttcttctatcaggtcatgataataatttttngcacgttttattctaaa

SEQ ID NO: 16299 - DNA, 923 bp, Diabrotica virgifera
  misc_feature (829)..(831): n is a, c, g, or t
  misc_feature (871)..(872): n is a, c, g, or t
  misc_feature (910)..(910): n is a, c, g, or t
aagttctatattatggcgtccagatgagtgtggtagactgttatgctgtttaaaatgcaaattgttagtagctgataagcatggatcatacacctattcaacagttttataaggatgccaacgtatttatcactggagggacgggatttatgggaaaaattctcgtggaaaagctgctgaggtcaacggaggtgggaactttgtatttgcttgtacgagaaaagaaagggaagcacaaggatgacagaatcacagaaatattcgacgatgtggtttttaaaagacttaaatcagaaaaatccaaattcagacatcgagtacaagctatatccggagacttaatgctaccgcatttgggattatcagagtcagatagacagcttttaatttcaaaagttaacgtaattatccacatgggagcaacaatcaaattcaatgaaagcatcatcagtgcattacatgccaatgtatatagtaccaaattagttatagacttagccaaagaaatgaaacatataaaatcgattgtttatgtatccactgcctattcaaattgcacacgaagcgaagtagaggaaaggctgtatgatccaccgatatcctatgagaaatcagtagagttaatagaaaagttgtcaccaaaagaattagaaaaatctacatcaaggttaataggtaaatggcccaatacatacacttttaccaaatgtatagcagaatcattagtaaataaggaaggaaataaattacctgtagctatcttcagaccttcaatagtggaatcgacgtatagggaacctatggaaggatggaaaaataacttttatgnnngccagtggtttctactctgcgctctataccggttttttanncagtaatattagtagtcgagatggtgttcttgacattngtccctgtgacat

SEQ ID NO: 16300 - DNA, 906 bp, Diabrotica virgifera
  misc_feature (102)..(126): n is a, c, g, or t
  misc_feature (350)..(368): n is a, c, g, or t
  misc_feature (752)..(752): n is a, c, g, or t
  misc_feature (841)..(841): n is a, c, g, or t
  misc_feature (878)..(879): n is a, c, g, or t
ggaagcagtacaaatatctttaaacccgtttaggtatctcagaactactaatttcgagttatcaagttatagtattaaggcgacgatataaaaacatctcgnnnnnnnnnnnnnnnnnnnnnnnnntgttctctaatggttactggtattgtataatttttattaagtacatggagtatttttaatatttctaatatctacatattttaatattaacgtccatattatgtattgtttatcaataatatattagggtatcctcgtctaataaagatttcataggtatatgttattttattcattttttcaagtagtacattttacataacattggttatttttgtatcacnnnnnnnnnnnnnnnnnnnctttaaagagacacacagtatttagtgcatacctttatattaacaaatgttttatttgtttatgatcatattactgtaaaatttatacatcaaagtatgttttattgacaatcacaatcaataaatttgtaaacttttgagttaaaccacagtattaaaaacaaatgaaataaacaccgctacaaatcagctgtttaaagcacaacacattatagaaatgtttgtattttgaaattactactgcgcatattcggactccgaatcggatcccaaggatcggttggactggttccgaactcgcagttcggttaccgcgaacgacaaatctgacaaaatcccggactagcagttcagaactcgattaccgcgaacgctcttttttanagtgcgcatgcgaagtaatcctggactagttcaggatcgttaccgcgaacgatattaatttatgtaccatcataccacgttatctctgnaaggttaagtgccctctccctcacagtggcatgctgnncatataaacgaatcagtgcaatcaccg

SEQ ID NO: 16301 - DNA, 934 bp, Diabrotica virgifera
  misc_feature (2)..(150): n is a, c, g, or t
  misc_feature (158)..(199): n is a, c, g, or t
  misc_feature (230)..(291): n is a, c, g, or t
  misc_feature (361)..(519): n is a, c, g, or t
  misc_feature (524)..(625): n is a, c, g, or t
  misc_feature (630)..(661): n is a, c, g, or t
  misc_feature (680)..(716): n is a, c, g, or t
  misc_feature (754)..(771): n is a, c, g, or t
  misc_feature (821)..(841): n is a, c, g, or t
  misc_feature (843)..(867): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccttnnnnnnnnnnnnnnnnnnnnnnnnnnnnnnnnnnnnnnnnnngggccccccccggttaaaacccaaaatgggnnnnnnnnnnnnnnnnnnnnnnnnnnnnnnnnnnnnnnnnnnnnnnnnnnnnnnnnnnnnnnccaaaccgggggggccaatttttttttatgttttgacccccccaaaaaaaaaccgggggttcccccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnctaaaaggaaccaaatttnnnnnnnnnnnnnnnnnnnnnnnnnnnnnnnnnnnnngggccccaaaatttaattccgggggggggttttaacannnnnnnnnnnnnnnnnncccggggggacccaaattaaaaccctttgagaaaaccccccctttccccnnnnnnnnnnnnnnnnnnnnngnnnnnnnnnnnnnnnnnnnnnnnnnggggggcccccggaggggggggggggaccgccccggaggggggaataaaaggggcgggggggggggg

SEQ ID NO: 16302 - DNA, 962 bp, Diabrotica virgifera
  misc_feature (63)..(81): n is a, c, g, or t
  misc_feature (84)..(97): n is a, c, g, or t
  misc_feature (412)..(444): n is a, c, g, or t
  misc_feature (883)..(883): n is a, c, g, or t
  misc_feature (890)..(890): n is a, c, g, or t
  misc_feature (902)..(902): n is a, c, g, or t
aaacgtaaacgattgtatgtagtaaataaaattagttattaaaatgcagtactgcaagcaaannnnnnnnnnnnnnnnnnnccnnnnnnnnnnnnnngcatatcatatcaatattgtggagcaacatataatttttctccttcaatgacagtagatatgaaatgtaggtcaatttgacaatttcaattgacaatatgaattatttaagaatgttgcaatattttctcccctattcgcgcacgatcgtttcacgtatcccttccaagtacttgcacaccacgaatataaccagcattcttaaaatcataatacagaatatcacaagacaaaggattaatatcactaacaattaattcacatgaaagtgcaacatggtggtaattgtttgataataaagtgtccaccgctgtgnnnnnnnnnnnnnnnnnnnnnnnnnnnnnnnnncaaaaacataagtcaagtaatactccatgctgatttgcaactatattggcctgccttaaattcaaatatgaaaaactttcacaaactgttaatgcaggatattctgcggggcaagagacagaaagaccatcctcagtagaataattccaagttgcttgtggaagattatagtctccaaaaagatataagctactattagggttgttttcaacgataaactctactgcagagcaatgatccacataaatatcctgatttgatgatggtgggatgtaaacagctccaataataacagtttcgttatggcttgacaaagaaacaaactgatgttcaacattaataaattcatcaagaaattttagaggaactaagtccttctttgctctctgatgctgatagattgtacaaacatttccagatcaatccctgattaagtatncacatanaatcctcattgnacatagaagtagctcaactctacctactctttaggcatatatccaaagcaaagaacacat

SEQ ID NO: 16303 - DNA, 864 bp, Diabrotica virgifera
  misc_feature (117)..(131): n is a, c, g, or t
  misc_feature (421)..(438): n is a, c, g, or t
  misc_feature (766)..(766): n is a, c, g, or t
  misc_feature (809)..(809): n is a, c, g, or t
tggtagtttacgaaatccaggccgtagaagaatgtcatggtttctgaatttgagagagtggtttggctgcaccactaataaactttttaggtcagctgtaaacaaggtcaggatatnnnnnnnnnnnnnnnatctccgataggagtagcacaagaagaagaagttttaagaactcttctggttcaaacctcggttcaccagtgaataccttcctcacatcacttagcacattacaatggcatagaatgtttatgaaagtatcttcttccatttcgcactttctgcaccatggttcatttaccttacctagtttgtataggtggtcttaaacggcaatgcccagtcaccatttcagtgaccgttttgatctctcgtttattggggttcatcaaattgttcgagagtttttgaacaatattcnnnnnnnnnnnnnnnnnnctagagttgcccttgagtggctctacatttcttttgatgattccttatcagccatttctgaacctcgtttttcgtagcatctttaataatgccaaaggaaggttccgggcctacaaaggtttctctcgtgccttgttttgccaacagatctgctcgttcatttccatgtatcctttcatgatccggcacccatattgaagacactttattgccaggctgttgaggagatctttgcagttaatcaacacttttgatttggcgagtgggttctgtactgccagaatggccgcttggctatctgtgttaatgttgattctctttgatttgngggtctccatccatgatttcataaatgcaggccaccaaagcanaaccttcaccctggaacacagttgtatattgacctaggctataagatttttgttt

SEQ ID NO: 16304 - DNA, 726 bp, Diabrotica virgifera
  misc_feature (2)..(15): n is a, c, g, or t
  misc_feature (20)..(527): n is a, c, g, or t
  misc_feature (534)..(571): n is a, c, g, or t
  misc_feature (591)..(604): n is a, c, g, or t
  misc_feature (607)..(629): n is a, c, g, or t
  misc_feature (637)..(659): n is a, c, g, or t
  misc_feature (689)..(720): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16305 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (159)..(159): n is a, c, g, or t
  misc_feature (162)..(193): n is a, c, g, or t
  misc_feature (200)..(220): n is a, c, g, or t
  misc_feature (232)..(232): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttgnttnnnnnnnnnnnnnnnnnnnnnnnnnnnnnnnngaaaggnnnnnnnnnnnnnnnnnnnnnttatatttagantaatatta

SEQ ID NO: 16306 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16307 - DNA, 690 bp, Diabrotica virgifera
  misc_feature (343)..(362): n is a, c, g, or t
  misc_feature (477)..(497): n is a, c, g, or t
cggctcctttacgcccgacgaaggtaaggggaaaccctttcccctttatagaaagatattattttttgtaggggcccctcgcccgcgagagatgtcagtgcactgtgtgaatgcatttatccattatttgcagcatgcgtatctggcattattccttaataattatagatttattatttgccattttcaaagccctaagagatgaagattataattgttaactaaataatgtaacatagttgttttgtgatgtgatgtgatacgttttttgatatactaaatattattaggaaatagatagaatattatttatttacgaaatatctataaattgataattttnnnnnnnnnnnnnnnnnnnnctttgtgcatgtggctaaagataaacatatattgaccacttaggtttatgataagaaggacagaaataagttgtcatatcttatgataagtaactgtttattttttcatattacnnnnnnnnnnnnnnnnnnnnnttttattgacacttacatttaaattatttgaagctatgcatgaagaagatagtttgagcctctaggagtatatttatgtggtaatgtagtgaggactaataaagaaatagggcgacatttttttcacctgattattaaatacatgacattctgtatgaaatatagtttcacgcgttgcgcactggtaagtttg

SEQ ID NO: 16308 - DNA, 888 bp, Diabrotica virgifera
  misc_feature (28)..(45): n is a, c, g, or t
  misc_feature (193)..(219): n is a, c, g, or t
  misc_feature (826)..(826): n is a, c, g, or t
  misc_feature (883)..(883): n is a, c, g, or t
aaatattatacattttaatttaaggtgnnnnnnnnnnnnnnnnnntgataaaaacttcaggattttatgatttatgtatagaagaatcctttttctccaaaggtgatgtagaaaaatcgatcaaatcactatatgactatggttatagaactatagcaataaatcaaacaattgaagatggaaatcttgaacnnnnnnnnnnnnnnnnnnnnnnnnnnngcgagggaagtgcaagaaccagtacctatgccttatgatttgttaccaattaaaactgtaattaagaatctgaatctggttaattttcaaatatttaaccgcttgacaatagtgtttgtcaatcaagatgggttacataaagtcactaaatcacctaacttcaggaagtaccagattgttgcagcggccccaacaacaaatcaagctctctcgtacacctgcaataatttcgatgcggacatcttcaccttcaatccagagaacaagtttggccttcgtttgaatagaaaactctacaaccaactcttacagaggggatatcacttcgaattactgtacagccccgccatagaggacacgacgaaacgaaaaaacttaatacacgcatcacatctgtaccacgcatttggtaaatccaggaatattatattttcaagtggagcacatgatcctgttgtaatcagaggtccatatgatgttattaattttggatttttatttggtttgagccaaatacaatgcaaaacggcagtgtcctattgtcctcataaggttgtcattaattctgttggtagacgacacggtaaagctatcatgttcgtagaanacatccctcgcgaacaagaaaatacaatagaaactgcagagattaatggtacggtgnacatc

SEQ ID NO: 16309 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16310 - DNA, 914 bp, Diabrotica virgifera
  misc_feature (823)..(844): n is a, c, g, or t
  misc_feature (892)..(892): n is a, c, g, or t
aggacgtcccccaggaccaaatccttataatggagcaaatgtccaagtcaagcctaacgcaccaaacacgatacaatatttaccagcaaaatctcaggtggggcaagctcctccacctagaggaccaccaattgtggatttcttaacacgtatcacaactcctatgaatatgatggacgcaaaaatgcaaccacagaatatgcaatatttctcctcttgtggtcctaacaatggccctatgcaaggaggtcccatgcctccacatatgggacacatggaagggcccatgtctcaagacggtcctattggaccaatgagtatgggtagtcatatgggaaatggaccaggccctatgggtggcaacatgggaatgcccgctggaatgatacccatgatgcgaggtcctatgaggcccccaatgggtatgagaatgccacaaatggtttttaacggaccccctggaggagcggaacctatgtttaatcctggcccgaacatgggtaatccctcaccacagatgtttgttagcggtcctaagggcagtccgatgggcctcggagccccagatgccagtcaacctcttcctccttcgatgggacaaaacaatagctttaaaaattcaccttttgtctgtcctacaactgctgaccccaactatgcacaacagttccacaacttccagcaacagctgtatgccactggcactcgtagtcaaatgggtggacaagccatgggaccaggcccaggtccaccacatatgcaacagcctccttactacaatcccaaatagcaaatatggtgctgagtgtgtgagtcagagtannnnnnnnnnnnnnnnnnnnnnctaatgagtaatccggcaataataaaatgtgagattgagttgtatatntagtggtacgcatcgaattcaa

SEQ ID NO: 16311 - DNA, 792 bp, Diabrotica virgifera
  misc_feature (25)..(70): n is a, c, g, or t
  misc_feature (268)..(316): n is a, c, g, or t
tatttttatttattttagaataatnnnnnnnnnnnnnnnnnnnnnnnnnnnnnnnnnnnnnnnnnnnnnncttaattaggattgtgatagaatattttattgttatgaaccaaaaagttatttttctgaacctagcgagtcaggaagatcgacataatagatattgaactcgtttgtttcgattttggaagatccacacatggaaattgttgatggtgacaggaacatcgtaactccacatgttcttagggctttagccacagtttgnnnnnnnnnnnnnnnnnnnnnnnnnnnnnnnnnnnnnnnnnnnnnnnnntacaagagcaagaagaaggcatttaccaaagcttccaacaaatggagtggtgatataggaaagaaggccaccgaaaaggacttaaggaaaagtgttagatactgtcaagttgtcagagatattgctcatactcaaacgaaattgttgaaaccacggcaactgaacgcccacgtcacgaaaatactgctgaatggtgctatcgaaggtgacacagaagcttgccctaaagaacaccttgaatagcctattcctattgacgacgattttgctcaagatgaaatgattgattgcattggcgttactaggggtcatgcatacaatggagttacttctcggtggtacacaaagatattgccgcgtgagagacacaaaggtcttcggaacgttgcctgtattggtgagtgcaatccttcaagatatcattcacagctgctcgagctggccacaagcttaccatccagaaatgagatgaacga

SEQ ID NO: 16312 - DNA, 923 bp, Diabrotica virgifera
  misc_feature (6)..(922): n is a, c, g, or t
ctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 16313 - DNA, 869 bp, Diabrotica virgifera
  misc_feature (8)..(493): n is a, c, g, or t
  misc_feature (495)..(565): n is a, c, g, or t
  misc_feature (567)..(602): n is a, c, g, or t
  misc_feature (604)..(701): n is a, c, g, or t
  misc_feature (708)..(745): n is a, c, g, or t
  misc_feature (765)..(778): n is a, c, g, or t
  misc_feature (781)..(803): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttgaatnnnnnnnnnnnnnnggnnnnnnnnnnnnnnnnnnnnnnntgttcgacttttaagatgttacatgatctgagtttaaaccggcgtgagccaggatgttatctatct

SEQ ID NO: 16314 - DNA, 797 bp, Diabrotica virgifera
  misc_feature (90)..(118): n is a, c, g, or t
  misc_feature (172)..(186): n is a, c, g, or t
  misc_feature (188)..(201): n is a, c, g, or t
  misc_feature (240)..(261): n is a, c, g, or t
  misc_feature (281)..(294): n is a, c, g, or t
  misc_feature (296)..(314): n is a, c, g, or t
  misc_feature (316)..(353): n is a, c, g, or t
  misc_feature (419)..(440): n is a, c, g, or t
  misc_feature (450)..(480): n is a, c, g, or t
  misc_feature (529)..(542): n is a, c, g, or t
  misc_feature (544)..(556): n is a, c, g, or t
  misc_feature (597)..(623): n is a, c, g, or t
  misc_feature (661)..(694): n is a, c, g, or t
  misc_feature (732)..(750): n is a, c, g, or t
tattttcacttatccttaaaataacaacccattttttagtccaagtaaacaaaaattttattcaatgatagtcaattacgtattgtgccnnnnnnnnnnnnnnnnnnnnnnnnnnnnncttattttttgcaccttgtgtatccgcgattattaattaataactatctattcnnnnnnnnnnnnnnncnnnnnnnnnnnnnnctacaatttttattgcaaaataaacattttaaataaccnnnnnnnnnnnnnnnnnnnnnnctttttaaacatatctcacnnnnnnnnnnnnnncnnnnnnnnnnnnnnnnnnncnnnnnnnnnnnnnnnnnnnnnnnnnnnnnnnnnnnnnncatatttttcggcatgagcttcccaatacacttttattacaatttaatctttaactcagaatcacnnnnnnnnnnnnnnnnnnnnnncaatatgtcnnnnnnnnnnnnnnnnnnnnnnnnnnnnnnncttttataaatcttttattaaaacataacatctacaatgtattcacccnnnnnnnnnnnnnncnnnnnnnnnnnnncaacttgtatatctcgtcaaaacctataggtttaatacacnnnnnnnnnnnnnnnnnnnnnnnnnnnccactaacaacatgtctttttgtatcaaccctacagcnnnnnnnnnnnnnnnnnnnnnnnnnnnnnnnnnnacatcttgaccgtgctaacggaccataatcattagttnnnnnnnnnnnnnnnnnnncgaagggatggatgacaaaaaagactgtctttatttgatttataaag

SEQ ID NO: 16315 - DNA, 938 bp, Diabrotica virgifera
  misc_feature (39)..(58): n is a, c, g, or t
ttttacgcgtccggtcaaaagttgtggagcgtttttcgnnnnnnnnnnnnnnnnnnnntatccaattaaaagacattttatcccaaatccaaactattttaaccacttacgctattgttcttccattcatacgtactatttacttttaccacactgttcaacctacttaaccctaattcgttttttttgcaaacataacttctattttcttgcaagtttcttcaaataaatcccaaatgaacttaatttgaatatattttaatcgcttttattttaaaatctgcctgatcatgtcaaaaagacatgccgaagaggcggctagcggcagccagccacctattaaaaaaattcactttgagcctcatttgattggaccggtttcgacactggaagagatggatatcaaagttcttcaattccagaacaagaagttagcacagagaattgagcagagatgtagaactgaacaagagctgaggcaaagaattgaacaacttgaaaaaagacagacccaagatgatgctatgctcaacgtcgtcaacagatactggaaccaacttaatgaagacattcgaattttattacaaagattcgatgccgaaacggcagatgaatctgaaacgaaaaatgaaaacgaagcgacgacttcctttttgatgcaactatctacgtgggataaagatgaattaaatgacaaacttgccaatagggtgcaagtttcaaggagggcagtggcaaaagttattcaagcctttgacagattaatgcaaagaaatgaaaaaataactttggctctcaaaggagagttagaaggccaggagataccaaatctagatgaagcgattcgtcagactaacatacagctccaagcagaaaatagaaacctgcaagcactacacaccaccctacatgaaaaataccacacactaagtctaaaa

SEQ ID NO: 16316 - DNA, 100 bp, Diabrotica virgifera
  misc_feature (34)..(34): n is a, c, g, or t
cactacgcggccgctctgttcattggggagtggntgaaaggcttgtcacggcccaccctgccagcaaacgaccggggggaaagaagagtgtatgaaaagc

SEQ ID NO: 16317 - DNA, 913 bp, Diabrotica virgifera
  misc_feature (527)..(541): n is a, c, g, or t
agaataagaaaggtcacaatgagagtgatcgttgttattgcttgccttattgtggcaatcactgccaaattgaacgactatgatcactgggtcttttttaaggacaaacattcaaaacactataagatcacagaagataagctaagattccaaattttccaaaataaccttcgccaaattgaagagcataacgcaagatatgctagaggagaagtaagatggttcaaaggtgtcactaaattcgccgattggaccaaagaagagttcaaggttttattgggacgccaagcagcttccagacccaagcgtaatgaaagtttgggagtgtatatggccgatccaaatgttaatgtgccatcctctgttgattggagaaatgaagatgcagtactacctgtaaggaaccaaggaatgtgtgggtcctgttgggcttttagtaccgttggagctctggagggacaggtagcaattcaccaaaaacaaaaagttcctttgagtcctcaaaatcttatcgactgctctacagnnnnnnnnnnnnnnnaggatggagaccaagtgaaagctttcgaatatgttcagtcgaacggtattagctccgaagaggattatccttatatggtaaaagatcaggaatgcaacaaaaatgtcaaaaaatcgatcgcttccatctcgggatacaaacatctaaatccaacggaagaagatttaatatcagctatagctaccgtgggtccaatcgctgtctccgccgacgcatctgattggccatactacgcagggggcatctatgatgacaaatattgtggagacaatatcaatcacgccataattgctacaggttacactgatgaatatattgtgataaaaaattcttggggagaagagtggggtgaagatggttacatgaggatag

SEQ ID NO: 16318 - DNA, 902 bp, Diabrotica virgifera
  misc_feature (12)..(51): n is a, c, g, or t
  misc_feature (152)..(175): n is a, c, g, or t
  misc_feature (391)..(414): n is a, c, g, or t
  misc_feature (427)..(444): n is a, c, g, or t
  misc_feature (478)..(500): n is a, c, g, or t
  misc_feature (726)..(746): n is a, c, g, or t
  misc_feature (825)..(844): n is a, c, g, or t
  misc_feature (873)..(873): n is a, c, g, or t
gattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgngatttatccaatgatttcctttatttaca

SEQ ID NO: 16319 - DNA, 530 bp, Diabrotica virgifera
  misc_feature (15)..(15): n is a, c, g, or t
  misc_feature (161)..(181): n is a, c, g, or t
  misc_feature (192)..(215): n is a, c, g, or t
cattacgcgtccggntttttatttgttaacaaatttagatatttgccttacgtttatataaagaaaaaataacaataccacaatcatttggattttaaaatgattaaatagttttcatacactgatttctacacatagaatgtagtttgtgcactactacnnnnnnnnnnnnnnnnnnnnntatacatatannnnnnnnnnnnnnnnnnnnnnnngcaacctggagttaggatagcattatgatagcattaaaataccggtatacaacttttacaaaccctttcacacgattaataatagtatgaatatttttattctctacacaaacgacgaatctataatacgtttatcgcttcatgagaagaatgctcacacgaaaagcatcactacataaatgtttttaaattgatagttgtaccagaataacaatttcaacaagacctggctaagctggttcaaaaactccgttagggcaagagactagtcaattcaaaagagcaaattcaaaaactccattaaaacaagggatt

SEQ ID NO: 16320 - DNA, 795 bp, Diabrotica virgifera
gtgatttgtgcgactacctcatgaagagtcttactgtgagagtttactcagtacaccaccaccgctgaaagggaaatatggcagtgacatacaaataataattctgttatgtggacctcaacttcgaacatgaaatgctcaccgttgctgcatccacctccctctgaaatagatacgaattgtctgatgtattatccttcaccattgtcaatcaatgataccgatgaccagaagtcctcttccaatcttccttcttgtccatgtaagcttgagaaatccacgaaaccgtatacaaatccataatgaaacgtgagctgatatccgtaaggacttgctacaccaatactgatctctccgaaggtaccaccatgtacccagccattgccgagagaatggaaaaggaaatgcatcgaccttgctccatccaccatcaagatcgagatcttcaataccccacaaatgaaatagtccgtgtgaaacgctggatgcatcttgagctccctctacaccttccaacagatgagtatctcacaaactgaaatacgtggaagccagcacagtaattgaccaccgtgagagcatcaaaactatgtaatcaattcatacctaataagctatttttactgttgattgtactgagattacatctttgcaagacttaaatagtatgcaaccgtgtgaggaactgacatacagacttttatgatcttataacaccttatacatgattatattatttgttatattcacttactataactagtttgtcactgttcattaccatatgtcctatct

SEQ ID NO: 16321 - DNA, 790 bp, Diabrotica virgifera
gtctctcatatttccaattactatctttcctaccccatgttgtccttgcttttcttcccctgagtatatgaaggtaccattctgttgatctatttgtcctttccctttccatctaatttcctgcagtgctgctatttccaccttatactgtatcagaactaatgtcatttcttccagttttcctgctctaagaaatgatgatatattccatgccactagtcttaaaactccacctctatctttttcttctaattagtgaaactcttatgaacagaatataaagatgaagtaaagagcttgattgaggattcggatgctatccttctcccatctcgaccaactgagaaacccctacgtctaccactccagtctttttacaaaattcgacgcaattgtaacagtacatgtaggtcttgttgaaacagatgtattgaaacctgcaatgaatgtactattcgctcctgacaattttcctactgaatgaacttcctttgaccatgtatcgcgaattcctccagtaattataacgtgctgacaatgatgttttcaacgtcaacaatgcctctgttacagaatgtgcgtcctggttacctacactgaagataccaagaacaaccaacccagaggagattaggacttacctgcccaagtcattgtcctcacaccaccctggttaaatctcaaaccaatatccccctgcactcgactgttcacacaggtcataatgcctgaaattcgctgaaatcaaacaaaaggtttaccgttgttctggaaacaccactgaataaaa

SEQ ID NO: 16322 - DNA, 778 bp, Diabrotica virgifera
tcttacgcgtccgagataataaggaaactgatgttctagcttttttgcataccgactggatatgttcagaccaagataatgtttccgtcacaagtacacccaagtctttttgctgtctaacagtttttagagaaacatttgaaagtacataccgattccttgaattgtgattacatagatgtattcctacatgataggatatagatgattgaactagcaaaaacagaactggctgctgtatatattagtgttagtgatatgcctagtttatagaatcacgaacgattatgacatgtatggaactgaaagatgtgtgtgattgataatgaaaaatcttattatgaacgagcaatcttgcgtcgtgcctgtcgattcaagtgtttggaattaatattgactctgaaatgaccaaaaaagtcagagatagtcattatggtaattcctattactgaaccagcctcttgattgtccaatttgtgaaatgtgtggagaatgtgatttactatataggaatatggtttttgattaataccgtgcgagatttactgatatagattctattgctaaaaaggctatgaagaagactgagatattgctgcaaatggtcacaactattatgacgactatgtatgcactgtaccagatgtatgagatttgcttcagaaattgcaagcaatgtccatttgtgtactacatgccagatgaactatatgcgagtggacactcatgttgtgaaataatttatgtctgagctatctggaaaagtgatcaatttatc

SEQ ID NO: 16323 - DNA, 57 bp, Diabrotica virgifera
  misc_feature (9)..(56): n is a, c, g, or t
ttatttaannnnnnnnnnnnnnnnnnnnnnnnnnnnnnnnnnnnnnnnnnnnnnnna

SEQ ID NO: 16324 - DNA, 846 bp, Diabrotica virgifera
  misc_feature (56)..(96): n is a, c, g, or t
  misc_feature (98)..(116): n is a, c, g, or t
attttataccagaataggcctaacctacaatttgaagtttttatttctgtatgagnnnnnnnnnnnnnnnnnnnnnnnnnnnnnnnnnnnnnnnnngnnnnnnnnnnnnnnnnnnnactgtacccatactgtaccatataggaaaatactaacctagaatgacaattgtcattttatccgttgacattgtgaaattactgtcacgatcgggcacttttacagtcaaccatacctccataagtagaaatcgctttaataggcaactatactccatctaatttacttaccgttgcacgtcatccgcgtcataacccgtgacgtcacatgataccaacacgaaatatttaggcggtaggtgtgttcttttttagaatcactttgccgagtactctagcattacagctactagacatattttattatatacgcgtagaaataatatttaaagatttatattaatgttaacttaaagaaatacacaataatatgtttcatttaatttgtataaatggattataaagcgtttttataaagcacatttgttcggaatacactgtaactataatcgaacgaaggtgatattttggcataaattggtaacttttatttgacagttgcggtgatgacacttcatatttgtttatattatttactataagtatttgtttcattatatttactgtttttattatgtactttaacgtaagattataacttgattagatataattcttgttttctatttctaaagtttttatttatttacattgaatattaatttgttttgctgtataatccacttcctcaaaaattgtgtgatgtatttgatttaaaatgaaactcaga

SEQ ID NO: 16325 - DNA, 991 bp, Diabrotica virgifera
  misc_feature (14)..(890): n is a, c, g, or t
  misc_feature (892)..(989): n is a, c, g, or t
ctcttcgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 16326 - DNA, 615 bp, Diabrotica virgifera
  misc_feature (160)..(187): n is a, c, g, or t
aagcaagttaggttagaacggggtgaaacgttacttcgatgtgtatagtatatgtatatagtatacagtatacatagtgtgaccaactccaatttagtcgaattcgggacatgactgaaaaaactacctaaaatccgggacttttcaatgaaaatcgggnnnnnnnnnnnnnnnnnnnnnnnnnnnntacatatcattttattgattatttaacatttttatgttgacaaaattttttttgatggaatgtgttgtaatgataattacatttttgttagtttttgacgtttcgacttccaatccggaaatcgttctcaaaaaacgaaaaattagaaaatcaactaatgttggatttccatgtaaattgaaccttgggataaaatataattatcattatttgatattcatgattttaaatcgtcttttcagaagacgataattaaaatacagaaaccgaaaaaactcacgagtttgagttttcctagaactataatacgacgatataaaatgtatatgcgttttggatgtggtattagtataacagtctagaaattgtcgactttttttcgtccctccaattcaatttgatgttaattcttagaagaataatgtatt

SEQ ID NO: 16327 - DNA, 966 bp, Diabrotica virgifera
  misc_feature (176)..(195): n is a, c, g, or t
  misc_feature (241)..(258): n is a, c, g, or t
  misc_feature (510)..(548): n is a, c, g, or t
  misc_feature (832)..(832): n is a, c, g, or t
gtgttaagcggggaagaagagtcctgccttatcgtagtgatgccaagcgacgccgatcttgtacctgccaataatgagctacttaattaaccagctaatttcaagaaatgactttattcaatttaaactttatttgaacttcatatttcgagccggatctgtaatcaatttttgcnnnnnnnnnnnnnnnnnnnntcattttagtttaatatttgcattcaatgcaatctgtcctcggagnnnnnnnnnnnnnnnnnncaatttatgtccaaatttatacaatgcaataccaaacattctcagatacatgtaaacaaaatctcagctatcgtttcgtaaatattaaccaattgttatttttttgttaggtcgccgcccaccggagcccccaggtcgcccgcgcagcgacagccgctcgccgaaacgccgcagtcgcagccgttccagatcgtcgagcggatcgcgatctcgctcgcggtctcgctctcgaagctaccgctcgcgatcgcnnnnnnnnnnnnnnnnnnnnnnnnnnnnnnnnnnnnnnnactactcacgcagtcgcagccgctcgcgcagttactccggagaccggcgcaggtacaaccgcagaggcggcttcagaggcaggcatctcaacgacaggggcacgtactacaaaccgaggttccaaacgccaaggcataacggtcaaagaggtagaggttattataataataatcgggattccaggtatggcgatagagactatcgaggcagaggcagaccgtacgggttccaaaatagaggtaatcgaagacaacagcgcggtagatatggttctagaggaggnggaggatacagagattatagggatcgcagatattcaagaagcagatcccgcgaccgcgatcacagcaggtcatacagtcagagcaactcagacgcctctccctcatcgaaacgagacaggtcttctcctccatc

SEQ ID NO: 16328 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16329 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (195)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngnaagg

SEQ ID NO: 16330 - DNA, 552 bp, Diabrotica virgifera
cttttaaaagaatgagaaaggtttagggggataggtttatggtggtagatggatgttgaggagaatgaaatagtttcctgaataagttgcttgtttggggtatagagtgtgagtgtgtaggttattagacttgagtaagatagaaccgtttggggatgttgtgaaatatcaatgtagtagctagcatacacgtatcgagctgtgatttgtaaacgtgtttgttgggggaggactatagacatagatggaacagatgagacaataatgttgtctacgagaactaccgagattgataagttacaatttgatctatgaacgatgcatttttcgtgttacgtttgattcacttgtttgaaggaaattgatgtccgcgtgttgctagaagagataggctactatgtcttttggaagtacgcgttgctaatgtagtctgctaagattgttgaagaagaataacttgtagatccacatgaatgactatgtagccatggaagtttctgatgattttttgtgtgtaaattatgctggtattattctatttctacaagtgct

SEQ ID NO: 16331 - DNA, 720 bp, Diabrotica virgifera
gaactggatgcatcgcgagaagtttcgtatattctaagggtagtagctacttttatttacacggaatcattattcaatctgcatgcctcctctcataagatatccttcaactgatacatcgaatcgatagcaagatgccttcaaatgtagctccgaattgacaactaccgctgtggcttcctgaccgactatgtaatatccactactgttgtaagtactctctgtaagagtccatttccaaatacaacatcatctgatattctgatggtgcacactcactttcaacccgttgctagccgagaagatggactactacatcgatattcctagattcgtagatattttgagcgattctctaaaggagataacaaccatgattattttagctgctttcatcaagttgatcgaagaacccaaatatcaactggattcagaggaacattgtataactatgaagatatgaaaagtattgaaacaattgttcattttaaaacagagaaaaatttgactgaagtatatgatctctgtgatgtccaattactaattgaaaaactacttattgctgttcagtatctgagtccctgcaaagaatatttaactgaactcagatctgcatgtctggaatgctctccagtacacgatagatagctctggcgagaaaatgcgcaaagactctcctagagaaactacaaattactccgtgttctcattcgtttgata

SEQ ID NO: 16332 - DNA, 80 bp, Diabrotica virgifera
  misc_feature (29)..(56): n is a, c, g, or t
acccttagggataacagcgtaatttttannnnnnnnnnnnnnnnnnnnnnnnnnnntgcgacctcgatgttggattaaag

SEQ ID NO: 16333 - DNA, 865 bp, Diabrotica virgifera
  misc_feature (64)..(82): n is a, c, g, or t
  misc_feature (761)..(778): n is a, c, g, or t
  misc_feature (817)..(817): n is a, c, g, or t
gtactcggctgccattttcttatattatacttctttttaggcttgtagatagcggacgtgatannnnnnnnnnnnnnnnnnncctgtgctagactgattgcccctgccaccagaagcgcactcgttgccaacacaaaacaatacttgaggccactgagcagtgtagtaaaccaaagtcaaatacaggtacagaatgtgcaacaacacaagcaacctaccctcctccccgctatccgcagtttccaaactacaccagtcagcagagacattgactctgcagctaaattcattggtgctggtgctgccacagttggagtagctggatcaggagctggtattggaacagtgttcggttcactcatcatcggttacgccagaaaccctagcctaaaacaacaactcttctcatacgccatcttagggttcgccttgtccgaagctatgggtctcttctgtcttatgatggcgttcttgttattgttcgccttctaaataatcggcctttacgggcaacatcatcttattccaccgttcgttacgtcaacaccatgtaactcatatttttaacttaaataaaattcaataggacttttattaatttaatgtgcgcgctctggatgaatatgtgtccaattcttttcatttctactaacatcgagagaatttgggcttactttcaacgaagattggcatgtatttattagagtctgtcatgtgtgttttctaggaaaatggaagcagtaaacctattgtacattgtnnnnnnnnnnnnnnnnnnatccttagtcctctataagcattattctttttttataanactccgttatatatacgatcagagctgttatcaattatttttaaggat

SEQ ID NO: 16334 - DNA, 937 bp, Diabrotica virgifera
  misc_feature (56)..(123): n is a, c, g, or t
ctcttcgcgtccgagcaaaatctaaaataaaaggccaataaatgttcaaaacagcnnnnnnnnnnnnnnnnnnnnnnnnnnnnnnnnnnnnnnnnnnnnnnnnnnnnnnnnnnnnnnnnnnnnctacgatgatgccaattccactgaagccgaagactcataaattataaattcatatcttttcactgttccattaacatctaggaataatattacaaaagtgttatttttaaattagtttaaatcagtggttctcaatctgtggtacatgttccactggtggtacatatcattatttcaggtggtacacaaaactcaaaaacaaccaaaatcagcaccaatattatagttaattagatcacctagctagataggtattttaggtggtaccaaaaataataaaagtttttggtggtacatgactcaaaaagattgagaaccgctggtttaaataaagaagcacgtttttgattaatttatgtgtggacatttattgaccctccttggtcctcactgtttctactaaaaggttggtcctgcgagggttaaagtctaaaactgtgacatgtctttttcttcccatactcgtctcctctttttccctgtattatcaatcttcgaatttcatatcttatttcagatattgcaacttatatattctgtattatttgcctatttcttgtgctcaagagaaaaatttttaacattgagcaaataccatgacattattaatcacagattaaaatatacaaacagtacaaattacatttgctgatcaagaatgtaggccaggaactcgcccacaatatagggctcaatgttaactaggtgttgaaaaaccgttcttttagaagctttatagtttgtttcctgttgtatatgaaatggtagactattgtaaaatttaacacatgcatacaaatgacttctccctgtt

SEQ ID NO: 16335 - DNA, 856 bp, Diabrotica virgifera
  misc_feature (495)..(520): n is a, c, g, or t
ctcttcaaaaggatttgattggagaaccctgaatttgctagtagctttagaagaacaatctccgaatatagcagaaggtgttcacggaaacagagacgaactagaaataggggcaggggatcaggatttgaccacaagacatgcaacgttttattggctttggatcagcagtctccagacattgctgctggagtgcacataaacaaaaacgaggaagaaattggagctggtgaccagggtcttatgttcggttatgccacggatgaaacagaagaatgtatgccacttacagtagtattagcacacagattgaatcacaaaattgctgatttgagacgatctggagaattctggtgggccagaccagactcaaaaacacaggttaccgcagaatacactttccaacgtggcgcttgcattccacaaagagttcacacagttgttgtttcgctccaacacagcgacaaaatcagcttggaagaattgagaaccgannnnnnnnnnnnnnnnnnnnnnnnnntaattccagccaaatacctcgatgaccaaacagtcattcacatcaatccatgcggtctcttcatcatcggaggacctcagagtgacgcaggcctaactggtagaaaaatcattgtagacacttatggaggttggggagcacatggaggtggcgctttctctggaaaagattttacaaaagttgacagatctgccgcttacgcagctagatgggtagctaaatcattggttaaagcaggactttgccgaagatgcttagtgcaagtatcatacgctattggtttagccgaacccctttccattacagtatttgattatggaacttcaaaactcactc

SEQ ID NO: 16336 - DNA, 913 bp, Diabrotica virgifera
cattaaagaaggtattataacaaattacaacatgactgaaaaggaaagtgctgcaaatttattattattcgaatcatctcatgaagctcctgaaaaaaaagtaaccttaaatgattatctggcaagagctacagataataggactatttattatttagcagccccaagccgaacgttagctgagaactctccttactatgaatctctgaaaagtagaaaacaagaagtgttgttctgctatgaaccttatgatgaactagtccttatgcaacttcagcaattcaagggtaacaaattggtttccgttgaaaaggatatgcgagaggataaaaatgctaatgatctaacaaatttaggagacgatagtttaaaacgtagtgaaattaacgacttgtcagcatggataaaagaaaagttaggtgataaagttgcagcagtaacagctaccagtcgtctagaaagtcatccatgtgttgttactgtagaagagatggcagctgctagacattttatcagaacacaaagtcacagcgtttcagaagacagaagatacgccattctacaacctaaatttgaaattaatccaaaacacccgattatcaagaaaatgtataccttgatgggcacaaatccagtactaggtgaattgttagcgaaacagttatttgcaaactctatggtaggagctggcctagtagaagatcctcgaaccctattgacatcaatgaatgatctactggtgaaagctctggagaaacattagactatttaaattaagatttttattacatttgctcattcctgtaaatatgttttttctgttataagattctcataatagcaaattaacagttaaatttgtttttgaagtcaactttccgataactttgttgtaaatattccattgtcaaaa

SEQ ID NO: 16337 - DNA, 911 bp, Diabrotica virgifera
  misc_feature (830)..(855): n is a, c, g, or t
attgaaggtagtatgaaggtaatatacaacttacaatacatctcgatgctgctgcacttacatttgactgattctaacttggctttactgtactaactaggatcaagcaaactaaaggtaattttagtatatatttaatcgaatatgaatatggtattaaattaagatatttcaaagatataagtgtattacacttagagaaaaattcgatcagaaactaaacgtctaacctcagagaggctcgcaccccaagtcctttcgttttaacaaacttttggactctttttctataaaaaaaatgagtggagatatttcccctctcaaaaaaatgacaactttgcttatgcaaaaaccaggctgttgctgggtacataatctaaacaatataacggaacatcaaaaaaggctaaaacggaacctaactgtagttttcagaaaggaaggttccctttgaaataagttaagccgatatcggtagatcaaatagaatttaaacgcaaaatagctatagctataaaatattgcatagagatccccgttttaaatacagtacctaacggtattttagtaataaatttgttgagaggttttgaacagcttttgtacaaaacagattacaataacaagacctatgtaaatatgagactctaggtctactttcaaaacattattgtttcggcaaggctgcaataaaaaatggtgtcctttataggaccgacgacataggcccgttattcttccatgaactaattcagtttgtcattcggacaccgaaatcgccaggaaagttagaccataggcgtagcatcagatagggtgtaacctattcnnnnnnnnnnnnnnnnnnnnnnnnnnaatcttgatttttgtttagtataaaaatgtataataaatacaaacaattttatgat

SEQ ID NO: 16338 - DNA, 884 bp, Diabrotica virgifera
  misc_feature (491)..(521): n is a, c, g, or t
gtcatgtcatgtcacccttgtcaaattgtaaatccacttcataatttctcagttggtctgtgcccattgaattggcaagtacctagtatcttcgagcagggaaccatggcacccttttagcatttgttccactttatccattaacatcgacttgtagcataacattttaacatattacattatgtaaaccatatatgatgatgttaacactatttacggtgtgctagtttcaaaatactcggcaggatgtaagtattcccacacttttttcattttaacagtcacatttttaaccctttgctttaatctaacgtggaaatacttcattctaggcactgaagatgttctgtttagaacgaaaacgttctgcaatcgatgacattttatagtttttaaataaacgattttataccagaatacatctcgaagtttttacttctgtattggttttttaaactatggtatacagccaactattgggattttcccannnnnnnnnnnnnnnnnnnnnnnnnnnnnnnctgttttggaaaaattaatgaaaaacaggattacacaatattgtcattttaattagtcaataattcttacccttggagatctttccttttgacaacaatcctacccaataatatagtcttcaaaatatgttggggatgttcattagattcttttttacttgaaaacaaagcaacttgaagcaaatgtggtagatgcttggaaaaattagcaaaaatttcatcaaagttggttggattcaaaaacatttcttgtgccaaataataaaagagacgtctattcttttcgttatcatcgtttgtctttgattatactttgctgtttattaactaaaagcaagagaatttaaaaatcaagtaggcatt

SEQ ID NO: 16339 - DNA, 874 bp, Diabrotica virgifera
caaacatgtatttacttatgcgatttcgaccaatacttttcagtacatgctctaaactttaccaaaacaacattcatgtattaacttatcacttccttcatattgcatttaacttgttttcattcgtcttgttagtaaataataatacattttcatgattttaatttgtatgttgtattagttccgtacaactttaatttggtgattaacgaaacaagcaaacacctacgaaactgtagacgcagaataaaaatattctgtagtgtaggttcatgattatccttgtagctgtcaaatgttatcttgacaacacaataactgtcatactgcatgccacatgtcattactagtctaccacggagcaatgacactaatgacagcaatcttacgtgtagatatattaatatttagtgacacatgacagaggctcgaaacaaatgactgtgaatgaaaagccctattgtaaaggtagttaactttctgattgttgttcacccaacttaaactagaactttgttaatgccaaattaaatgtctgtagtggcgttttccttggcttattataacggtaaaccaattagtattccgaaccaaattagcaatttttagaaactttaatatataggttacatattatatattataaggttgaaaaatgtactattgaagcactaataaataatgaacaagtatttatgaagtgcgcatgcctttagatagttctctttgatcctaattcttaagcatattatcgtttttgttaacttttaatttatgtataattttagtgtatttctcatcatgtttataattatttagacgatatatctagtgttgagtttatataatctaggaaatatagacgttttatacc

SEQ ID NO: 16340 - DNA, 221 bp, Diabrotica virgifera
gacacaatatataggagctaaccaagagaatcggaaacatttatttcaccagtttatccaagaacaggtcttattgaagttggcatcaagatgcctctaaccaatgagttacatacaaggacacgaagagtgtgaaccccgtggtggaaaaacacgcgtacaaacgtgtgtcaactagggggtcatcgtatagtgccactacccgcccctactgtggatag

SEQ ID NO: 16341 - DNA, 1017 bp, Diabrotica virgifera
  misc_feature (190)..(207): n is a, c, g, or t
  misc_feature (458)..(494): n is a, c, g, or t
  misc_feature (877)..(877): n is a, c, g, or t
ccccccctaggccgcgttgtttatgtaaggttatgttaggttacctgttatgaaaatttaaaaaatgagcagaaattttcttgttttaaagtctgtatgtttacattttaattccaattttcatacatcatgctgttatcaagttgctcctcgacaagccggaaactttatgaaaaaagttatgggagcnnnnnnnnnnnnnnnnnnatattttaaggaagaggcccctaatattacagatgcattttccaagccttcgacaggacatatttctacaaatccaagaagagtaacagttttaaacaaattgtttatgagaaacattactgacttaatgtctactgaattatattcttcccaattacttggtttgggcgtagaaatcaataaagtaaaaattagtacagattataaaattttgaaagtttactggacttcagcaaatattcatcaggaannnnnnnnnnnnnnnnnnnnnnnnnnnnnnnnnnnnntaagacatgcattatctcagttgcgtttaatgggaaatgtcccaataattcagtttgtaaaagacaagcattatgataaaattcatgaattaaacaaaagactggccattgctgattatggagaagatggtccaagcaatacagacccagtagctcatctcatttctgagtttcaactctcaatgccaattgatgataaattgaaggaacaacttgtaaaattagaggaacaaaatccatatgaagtgaaagacctgcaattacctgctatgacccactgtgtttttaatttagatcatgaggatattatgaatagggtaaagaaaaataatagaaagacaagaaatgctgattcctccagtagatcagtggatgaaagttgngctagtttcaaattaaatcaatattcaaatacagatccagttgtatttagaaaatgcaagttgcagagggaagcttttaataaatttctacatcagcgaaatataatgcagaaaaagtaaaagaatcaaggtatgctgat

SEQ ID NO: 16342 - DNA, 613 bp, Diabrotica virgifera
cacttcgcgtccgtgacgattgtagaaaaactacaataattacaatgcataaaaaaggcagctttcataaatgcgacaactatagaagcattcccttatctcacatgccagtaaaataatgctaaacataattaatgagaatgaaaactttcttacaaagagaaaaaaataccccaagagcaaactgacacataatagaaaaatctaggtaattcaatatctcaccatatatttgtttcattaatgattcccgcaaagagttcgacatggtcaaatggtaacacttacggcagatactaaaagaattgagcgtactacagcacttaatttcgcatataactgagccatatatgaacacactactggaagaggtaaagtgcttgacgcattcaaacgaattttatccagaacaaggggtaaattgggaacaattgaaaagatttcatcatttactgaatccgaaagaatctctgtttagatctgcaagtcctgcgccttaatgcctggtttcctcgcaattctttgaacaatgagacgaatctcatattgttactatatatatgtagtatagtgtagtatatctatatatatagattattatagacgtaatgta

SEQ ID NO: 16343 - DNA, 411 bp, Diabrotica virgifera
  misc_feature (396)..(410): n is a, c, g, or t
cagtagaaaactgaaagggaaattctaaacttttgcatttcttcttccctaatgattttagatcttgtgttaaaaacaactgttgaaactgttgtcgaaattaagtaggttccaaatattgtacgaattagctaattttttaaagaatattcatagaataaaataatcaatgaaagttttgataagcctgaagcgaataagataattcaagaaaattatcagtaaaacgacaagatctgcttataaggatatttaaaaaataatagtattttaaacttatcgagttgatacagactatttaggagattatgatataaggttttacttcttaaagcgcttatattagccttgatatattcaaaatgatttgtaaataaataatacattaaattcagnnnnnnnnnnnnnnnc

SEQ ID NO: 16344 - DNA, 971 bp, Diabrotica virgifera
  misc_feature (4)..(955): n is a, c, g, or t
cacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataaattaccttag

SEQ ID NO: 16345 - DNA, 952 bp, Diabrotica virgifera
  misc_feature (698)..(715): n is a, c, g, or t
  misc_feature (828)..(848): n is a, c, g, or t
  misc_feature (904)..(904): n is a, c, g, or t
  misc_feature (914)..(914): n is a, c, g, or t
  misc_feature (918)..(918): n is a, c, g, or t
  misc_feature (923)..(923): n is a, c, g, or t
  misc_feature (926)..(926): n is a, c, g, or t
  misc_feature (934)..(934): n is a, c, g, or t
gtggataccaagtaagattttaaatattgcaaacagtggctaatgttttttagaatataatttgaaaatagtatggatgatccgatgatcgaagttcacaaactaatcaaaagaagcaaaacaaatataaatctaccttcaagaagtacaagaagaggtgggcagctacaggttagaattttgaagtgttccaaaacataggttctatttttcagttttattccatgtggtctaaattctctgggatattactagtgttcatctaaatggtagcagcaatctatatgacaatcactttggtgcattcagaagagattaataaacagtaagattttaaatattgcaaacatctattagtgttttgtagaatttgctttaatatattacatggattacccaaataggcgagctaccaatctagtgaactactaataatctaaatgggcacaaaatatgaagcaatcttcagaaagtataatagagagttttcatctacaggttaggcttttgaaatattccaagaaaacagtaaggcggtaaggttttaaatatttgttaaaccttttgtagttagtttgaaaatattgcatggattatagacatgaaacaacgtaaacagtattcacgagaacgggcaaccaaaagtcgagtgccgtcatcaaaaagtagagagatctttggatgctacattttctatnnnnnnnnnnnnnnnnnngtgctatttttcaagtctgttcgattttaatattatgaaatggtattcgattgacaatacgaaaaagataacaagaaaaatgaaaacaccaataccagatcgagaagttcagnnnnnnnnnnnnnnnnnnnnnagcttttaaatatcggaattcagtcaaacattcaaatctttcatgtcgatcttcanaactcaattngttncatantgntagggtgngacgaaaaaatatttttt

SEQ ID NO: 16346 - DNA, 977 bp, Diabrotica virgifera
  misc_feature (56)..(79): n is a, c, g, or t
  misc_feature (333)..(348): n is a, c, g, or t
  misc_feature (778)..(806): n is a, c, g, or t
  misc_feature (854)..(854): n is a, c, g, or t
  misc_feature (861)..(861): n is a, c, g, or t
  misc_feature (883)..(883): n is a, c, g, or t
  misc_feature (911)..(911): n is a, c, g, or t
gctagatatttcgaaaaaaatgtgatttagaatattgcacatatttttatatcttnnnnnnnnnnnnnnnnnnnnnnnncatggaggttgatattttttatcgaaacacagggtatatagtaacatttttaaatacatattgaacttctttgacacgtgtagttcagcttttcaagaaacattattttgatctgttagttttaatgggttgattactataaatgttagaatagtaactaatcgggagagccatagcacatgtaagtaaataggtagagttcttgttccgaattttgcacaaaacttcattgctttttttcgggtattttattnnnnnnnnnnnnnnnnatgtttgacatgtaactaaataataggtatttggtaggattaatatttcatttagatactttcatataggtataggatggtataggtaatgtccctttctttcgctctaccacaagatgctttccacggcaggtattttaagttttagtttgaataactatatttagcaaattttattaagttatatatcttccctcttacgctaaaataccactcttttgatacatttacatctgtacatcataatatgaatattatataaagtacctaactgaacacaaataaaacatcaattgattaagatctagatacttaacgaaaaatataaagttgacatttattgaaatacaattttagagtacctatacaatcagtttataatcctttattgttacaacttaatctgcatttatatgatgaaatatacacnnnnnnnnnnnnnnnnnnnnnnnnnnnnngaaaataagtagtctaaaaatttgtttcattttttttgagatactaanacagtgnttttagtaatgaaatcatatgnagataaatactgataataaagaaacatntaaaagatttatataaactaaagcttatatttacctacatagtacaatccaaccagcacatttaaa

SEQ ID NO: 16347 - DNA, 915 bp, Diabrotica virgifera
  misc_feature (99)..(116): n is a, c, g, or t
actggttgacacgatggttcaagataataaaataagtaacaatttggtgtatcaactcgtaaatacagaaatcaaagagggagatgacgtaacggcaannnnnnnnnnnnnnnnnnatgacaaaatagattctggaccaactattggaaagaggcatcaacaagctcttattctttgtattttgctaacttgttgtttcgtaatcagaacagcattaactgttgccatagtggctatgactgatccaacagccagcagcaacaaagatataccgacctacaactgggatgacaaaagcttagtgatggcctcgtttctatggggctacttcatacctcaagtagccgcaggatacttctctgataaatatggcggtaaatggttcttggttgtaagtgccgcgatcactgcaacagctggtcttctgataccttcagcagctctatatcttggctccaaaggagttatggtttgtcgatttctacaaggtctatctcaagggttcttgtttccatcattacacgcaacttgtggcaagtggatacctgttccagaaagaagtagattgggcacttttgtttatacaggtgcaacattaggtgtatgttcttccttgatattaactggatacatatcttcatcacgctatggatggcctatggtcttttatagcttcaacactatcgcgttgatagtggtggctctatatgcctatatcggaaccaacgacccaagtagtcatccgacaattaccgaagaggagaagaattacattataaatagtttaaacactgcgaccgataggcgcaacctgtcagttccttggaaggaaatgctaacctctaaggcactgattgctgtgctgatgaccaatatttgttgtaattttactcactggctttttatttcggaaac

SEQ ID NO: 16348 - DNA, 687 bp, Diabrotica virgifera
  misc_feature (15)..(42): n is a, c, g, or t
  misc_feature (52)..(113): n is a, c, g, or t
  misc_feature (132)..(151): n is a, c, g, or t
ccttccagcgtccgnnnnnnnnnnnnnnnnnnnnnnnnnnnncctttaaagnnnnnnnnnnnnnnnnnnnnnnnnnnnnnnnnnnnnnnnnnnnnnnnnnnnnnnnnnnnnnntatttttaagagctaaacnnnnnnnnnnnnnnnnnnnngacaaataatgtaatgaacgtttttgctcccaggggccaggattctccgagggaatccctctgatgagacacaaacgggagagaacggtagagaccatcgctgacgaagcccaaagatcgagaattcgatctcggtctgaactgagctacaaatcttcagagtcctctcacatcacataacgagcaggagttgacgcacgtaggacatcttcgcacagaccgatgtgagaaggatgtgacataacggtaccagaaagaaccccaagaaggagagatgtttgtgagatattggattgagagaatacaccactgacgcggacttataccatttgatgtccaataacagacccacagaaggagtgcaagatgcgatcagaggctaaaagtgcatgtcgtacaggcttttcgtatgtcgtgcttcgagaatgctagatagtgttgagcagtgaaggaaaaatgtacagatatgaaaattaatgggtagagaattcgcgttagaagtgcgccgactgaaatagcaaatcctgctactcctg

SEQ ID NO: 16349 - DNA, 355 bp, Diabrotica virgifera
  misc_feature (3)..(15): n is a, c, g, or t
  misc_feature (90)..(107): n is a, c, g, or t
  misc_feature (162)..(185): n is a, c, g, or t
  misc_feature (213)..(240): n is a, c, g, or t
  misc_feature (258)..(274): n is a, c, g, or t
  misc_feature (277)..(296): n is a, c, g, or t
ggnnnnnnnnnnnnngagtgaaaaaaatgtttgttttattgtcaacataatattttatgatatttatttgggaagggaatgggattatgnnnnnnnnnnnnnnnnnngatttgaaaagatagtatattttgttattaaaaatgttatttaagaataagaatnnnnnnnnnnnnnnnnnnnnnnnngtttgagtgatgagatattaagaagaannnnnnnnnnnnnnnnnnnnnnnnnnnnaaagattgtgttaaatcnnnnnnnnnnnnnnnnngtnnnnnnnnnnnnnnnnnnnngagaattattatatttgatagtggttttatgagaaaattattgattgacatttaggatg

SEQ ID NO: 16350 - DNA, 77 bp, Diabrotica virgifera
  misc_feature (4)..(58): n is a, c, g, or t
  misc_feature (61)..(62): n is a, c, g, or t
attnnnnnnnnnnnnnnnnnnnnnnnnnnnnnnnnnnnnnnnnnnnnnnnnnnnnnnnttnnataatttttttgatc

SEQ ID NO: 16351 - DNA, 681 bp, Diabrotica virgifera
  misc_feature (3)..(482): n is a, c, g, or t
  misc_feature (489)..(526): n is a, c, g, or t
  misc_feature (546)..(559): n is a, c, g, or t
  misc_feature (562)..(584): n is a, c, g, or t
  misc_feature (592)..(614): n is a, c, g, or t
  misc_feature (644)..(675): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16352 - DNA, 122 bp, Diabrotica virgifera
  misc_feature (3)..(98): n is a, c, g, or t
  misc_feature (101)..(101): n is a, c, g, or t
agnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttntttgatcccattttttttgat

SEQ ID NO: 16353 - DNA, 681 bp, Diabrotica virgifera
ccgaacaattttgagaaactccacccatgtttgtttttgttagttgtcggttacatcgaaactccacatgatcttatgtctttagccacagtatggtatgatcctctctcctgaagattgccgaaggcgcttctacaataactgctactagaataagaagaaggtatttaccaaagattccaagaaatggagtgatgatttactaattaattccatcaaaaaggacttaaagaagattgcaaaatactgtgaagttgccagaatcattgctcatactcataagaaattgatgaaatttcgacaaaataaaggccacattatgtaaattctattgaatgatgctattgtatatgactaactaccttgaactaaacatacagcttgataagactattcctattgtcaacgtttttgctctggatgaaatgattgattgcaatgcagttactatggagcatgtatacaaaggtgatacttctcgttgccacacaaagaaattgcaccgtaagacacactaagaacttcgtaaagttggctgtattgtagcgtgatatccttcaagagtatcattcacagatgctcgtgctgatcaaaaggtttatcttcgcggagctgcgatgagacacaagatctacagaatgggagctggaatccacactaaagatgactagagagtcaaaa

SEQ ID NO: 16354 - DNA, 925 bp, Diabrotica virgifera
  misc_feature (45)..(64): n is a, c, g, or t
  misc_feature (220)..(243): n is a, c, g, or t
  misc_feature (769)..(786): n is a, c, g, or t
  misc_feature (805)..(805): n is a, c, g, or t
  misc_feature (868)..(868): n is a, c, g, or t
  misc_feature (894)..(894): n is a, c, g, or t
  misc_feature (915)..(915): n is a, c, g, or t
gagatagcaaaacaaattagaagaaaataaagaaatacatatacnnnnnnnnnnnnnnnnnnnnttactaaattttgtggaagctcagtttagaattgaagtagttaaactattgctcaggaatccgtaaggaagcacagttaattatcaaataattaaatctgaaacatactgaaagggcaaggagtagtagaagatagactgtagaaatcgaaacacnnnnnnnnnnnnnnnnnnnnnnnngattttatgatgctttttggaacatactattatgtttaatatgagattttttgaacattgacctaataaaatggagtattaaattttttggtaatatataattaaatcgagatacgctgggttttactgatggtgatattttctagtagaggagttgatacgtccatatatatactagattttagtctagataaaacttagggatgtatattatatgataaaaagtagtgaatagtacttatatgatcgagaaaattggaacagtgtccagtggccctagctttagtttttaaaaacctcgatgattaaaacaaaagaaaatcgttagataaaaatagttattcttaattacgtaaatattggctcatcgtattagattcgtattatattctaaaaaataattttagtttttagtcatcgagatttgtagtaaatcataaaattttttacctttttgtaatatagtctagattaattttgtgatttacgtctcctgtgaatatttttgacaaaatggttttctggnnnnnnnnnnnnnnnnnngcagttacatactttttanaacaactgtatttaatgtacagacatagttttttgcccagatatttttactttgttttattgnggctatattttatgcagaatcatcanaaagttactatacagtattgngaaatttttt

SEQ ID NO: 16355 - DNA, 765 bp, Diabrotica virgifera
  misc_feature (11)..(43): n is a, c, g, or t
  misc_feature (82)..(98): n is a, c, g, or t
  misc_feature (101)..(124): n is a, c, g, or t
  misc_feature (135)..(171): n is a, c, g, or t
  misc_feature (199)..(211): n is a, c, g, or t
  misc_feature (213)..(238): n is a, c, g, or t
  misc_feature (257)..(279): n is a, c, g, or t
  misc_feature (286)..(298): n is a, c, g, or t
  misc_feature (300)..(317): n is a, c, g, or t
  misc_feature (446)..(498): n is a, c, g, or t
  misc_feature (594)..(613): n is a, c, g, or t
  misc_feature (615)..(628): n is a, c, g, or t
  misc_feature (651)..(686): n is a, c, g, or t
  misc_feature (689)..(707): n is a, c, g, or t
attattttacnnnnnnnnnnnnnnnnnnnnnnnnnnnnnnnnncacctctatttaccgatagtgaattactattgagagagnnnnnnnnnnnnnnnnnccnnnnnnnnnnnnnnnnnnnnnnnnagagcatcacnnnnnnnnnnnnnnnnnnnnnnnnnnnnnnnnnnnnnccatttaaaagatctaaaaagattaacnnnnnnnnnnnnncnnnnnnnnnnnnnnnnnnnnnnnnnncatgcaatgttattcctgnnnnnnnnnnnnnnnnnnnnnnncagatcnnnnnnnnnnnnncnnnnnnnnnnnnnnnnnngttacacatgtttatattattactactacatatttttaggaatagagcttaaaaatatcattttattatcatttaatttttacataaaaattaagattagaaattttcacattttcctctatgctatcnnnnnnnnnnnnnnnnnnnnnnnnnnnnnnnnnnnnnnnnnnnnnnnnnnnnncagatttaactgattcaaacttcagaacgacgacaatattactattaccacattgtatatttagcagaaatatataggatgaataacggaattcgnnnnnnnnnnnnnnnnnnnncnnnnnnnnnnnnnngctttttgccttacatatacccnnnnnnnnnnnnnnnnnnnnnnnnnnnnnnnnnnnnccnnnnnnnnnnnnnnnnnnncgcatatccattagtctttttattcgaagctgcaacgaaggggtggatgataacaact

SEQ ID NO: 16356 - DNA, 101 bp, Diabrotica virgifera
  misc_feature (25)..(26): n is a, c, g, or t
  misc_feature (47)..(48): n is a, c, g, or t
ttgatatagaataatttacttaggnnatacagcgtaattttattggnnagagtcaatcgataaataagattgcgaccctcgatgtggataaagtttataat

SEQ ID NO: 16357 - DNA, 486 bp, Diabrotica virgifera
agagttttaattgccctcagaggttgtgaatagtttacggggagtgatcgtggtataagaaaagttttgtgtgagttaaattttgtgagtgaagatagaggtgtagaaagttttggattatgacggagtgctcatttctataattggaaattttaggagttatgcgtattagttaacgatgtgttaagataagtaaaatttatatattaatagatatttaaagttgattaagaaggtgtatttgagattataaagtgggataaatgattacatgaaaacaaaggtaagaaggagtcattggaagggattagttgtgaaagttgactatgatttgtttatttgaatgtacaggtaggagtagaataaggagactttttatttaatataacgatgagataagtgatatggaaatagaaccttttattaatggatcgaagaaattactaagaaagttgtttgatctgatatggaacagcatttgtatgt

SEQ ID NO: 16358 - DNA, 882 bp, Diabrotica virgifera
  misc_feature (15)..(16): n is a, c, g, or t
  misc_feature (34)..(36): n is a, c, g, or t
  misc_feature (44)..(45): n is a, c, g, or t
  misc_feature (53)..(55): n is a, c, g, or t
  misc_feature (72)..(74): n is a, c, g, or t
agggaaagctgggtnnacgcctagcaggtaccgnnngtccggannattcccgnnnggtcgcacctctacgcnnngtccgcatctgattgccacatgtgaatatactaccaaatcttaacatagagctgcaagcgcagacgagttgcgaaccgtacgttggaagacgttgacaacctaagcatgcataattgcttgactgagcttaatataaccaactagtttgtgattgttaattatctcaagatttattaatactctctatactagtaactaataccctactctatgtgcagaagggcatcaaaatcccgtcacctgccactttcaccattcatggtgaatgctcacttatgctattggaaaatctggctcttgcaattggttgcactgagcatggaatatcatctacaagtaccatccgtctgtggcaagacgtgcttcgtttctagatggatcattgcgcgaagcaaatgacgatgctgtagaaattattttacctaaccccgttcataagttcaactctcctgactaccctgaatacatctcgtggctattttgatgtactactcatgaagctccgacaccaatgcaggcaccacagtgaactgatggcacgagcgttcctgacctcaatcttataatctttcctggctctgtttaacactctatgttacagcctagctgctgacattcatatcggcacccaaccacctctacaaatgccatgattacctcatgatttcaactgtgcacccactactaaactgtgtcatcggatgtcacgagagatcccaagagtttggctggactacgattatgccatgactgttgtgtattctgtgtaagctccttcatcttaccaatatcaagttctgcatgaga

SEQ ID NO: 16359 - DNA, 779 bp, Diabrotica virgifera
  misc_feature (699)..(747): n is a, c, g, or t
gaattccggggtggttctttgggggggaaatagtcaagaagatatagtatgtgtatgattttttattgaaatttaaggatattctttaaggagtttattttgaatgttagtgagagaataggtaggacccggtgtttatttaattgggtaggagtaaatgtataatgttattgtatatagttatggatttattataatgttattttataggaataagttgtataattggtggttttggaagatgatttgtacttttaataagtggggaagctggtattttattccgattaataagtaagataggagtttatttggttgcctcgaatgtattgttattataattaagaaggttagaagataggatgcgtggaaaggggatgatgagattattagactgtgttatataataatgtggatgtaggttttttagtagaaaaaattattgttagattacaagtatgtgatatttcatcgatgataagtgtgattaattttattgcatgagtgattagtatatgagatgtaaatatattttttgatagaagacttatttgtgtttgagctgtgatgattggagtaagacttgatgtataatgtttaagagtattagttgaacaaattagagtattattaactgatggaaagttaaagataggattgtttgatggagatggagggggagagtaaattgaatattgnnnnnnnnnnnnnnnnnnnnnnnnnnnnnnnnnnnnnnnnnnnnnnnnngcaggatattgctttaatttctggtattgtta

SEQ ID NO: 16360 - DNA, 759 bp, Diabrotica virgifera
  misc_feature (175)..(195): n is a, c, g, or t
tgatgttcaatgaattagccttgctcaagacattatagttgatctttttttacctgcattcttacaaggcttaaattaagacgaccgtttgtttttatgattagaaagtttggccacaccacactaggtatttgtgaccaaagtaatgagattttaaataccagaaccatcaacnnnnnnnnnnnnnnnnnnnnngaagaataaataaataaatttcacgaacatatcacgatgacgactgagaaattattagcagtgggcgatattggaagttccatgcaacgttttggatgggtagattacgtaaccttcattgaaatgctatgaataagccttgtagtaggtatttatttcggagtatgcaagaaatcagagacagcacaggactatttggttgctagtcgatctatgggaataattccaatagctatgtcattgttagctagctcagttagtggtatatcgcttttaggaattcccacagaagtgtatgtttatggaatccagtacaattatattttaggaggcttcgttattgcgtcaattttgatgggatacatcttcttacctgtttttcaaggtctacaattgacttcaacttatgagtatcatgacaggagatttagtaaaggtgtcagattatttggttcattactattcagtattaagatgctgtcttgggtgccactagtgatatatgtgccagctctcgcattaaatcaagcgtctggcataaatgtccattttataacaccaact

SEQ ID NO: 16361 - DNA, 653 bp, Diabrotica virgifera
tttttttttttttaggtgtcgaaactataggaatatgttgcgattaaatggtcctattggatgggctcttgcagttttgatgcagggggctttactaccagctgttatattggctcaaacggaaaaccccaatgtatcttgtgacaacgaatatgcttattatcctgatccaaacgattgcagctcattttttcaatgtataaatggcaccaaacagcacatggagtgtgtttctccactcctttgggataaccacatacaaggatgtgaagaagagtccgactgttgtatgtatatcaataatacttatttatttaatgaaacaatatgtaattttacgtgatatttcagtttttgtaaatttcagttttttctactgatgcttaattattgattttttaatttacaatttttattaacaattatccacaattttacactaaaatatgtatattttgacgttttgatttgcgctatgcaaatagcgcacaataaaaattgaaatattttgttctgttactatacaaaactgctttgaatatgttataaattttatctgacttattcactaataactattacaatttttttactgttattacgtactgtattgtttacacccaccttgcataataaaataatgcatcatatag

SEQ ID NO: 16362 - DNA, 983 bp, Diabrotica virgifera
  misc_feature (196)..(213): n is a, c, g, or t
caaatgacaaacctaacatagctggactcatcttggcgggtagtgccgattttaagactgaacttagtcaatctgatatgtttgatccaaggttacaagctaaagtaatcaaactagtagatgtctcgtatggtggtgagaatggatttaatcaagccatcgaattagcagctgaatcacttcaaaatgtaaagtnnnnnnnnnnnnnnnnnntgataggcagatatttcgatgaaattagccaagatacggggaaatactgttttggagttgaagatactcttaggggcttggaattaggtgctgtagaaacactaatctgttgggagaatttagatattcagcgatatgtattgaaaaaccatgctacaggttcggaaactatactgcatttaactcctgaacaagaaaaagataaatcacatttttcggataaagagactggtgtagaattggaattggtcgagtgtcaacctcttcttgaatggttggcgaataattacaagaacttcggtgccactttagaaattattacagacaaatctcaagagggctcccaatttgttcgagggtttggtggaattggaggaatactacggtacaaagtggattttcaatctctacaagctgatgaacctcttgatgatgtagacctcgatgattattaaggtctactttgtcctgtctctacgaaattgaaggtttgctccggtacaaagtagacttccaaagtttacaactagacgatatggataacggcgaagaatttgatctagatgattattaaatgtagagacaaatttgtagaaattttcatttaaaacaatggtgggcccgttatgtaataaacacgtgtaaaaagtaaatgatggcaatatactaatttatcctaaaggagtataatatgatgtgctttttttgtaatattatttccaatttatcctttcacaaactttgaagttatttccatgaaaagttttaat

SEQ ID NO: 16363 - DNA, 216 bp, Diabrotica virgifera
  misc_feature (3)..(214): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 16364 - DNA, 202 bp, Diabrotica virgifera
caaatattactatgagaaattgtcatatgttaaaatttgtatatcatgtctttttagatatagcgattttgcattttcctctcagagaccacttccttatctttgagcactcttatgtgatgtgaagattcgatctatcatgttcactagtataagcagcaccgctcaacgaaatgaaatctgactccccaagcccatgacg

SEQ ID NO: 16365 - DNA, 838 bp, Diabrotica virgifera
  misc_feature (208)..(225): n is a, c, g, or t
  misc_feature (299)..(322): n is a, c, g, or t
  misc_feature (437)..(492): n is a, c, g, or t
  misc_feature (506)..(568): n is a, c, g, or t
  misc_feature (578)..(623): n is a, c, g, or t
  misc_feature (625)..(647): n is a, c, g, or t
  misc_feature (649)..(667): n is a, c, g, or t
  misc_feature (682)..(708): n is a, c, g, or t
  misc_feature (756)..(777): n is a, c, g, or t
  misc_feature (783)..(801): n is a, c, g, or t
  misc_feature (806)..(837): n is a, c, g, or t
ctctttcgcgtccggttgggtgctgtggcaagagcaacttccactcttttgcctggaaaatccatcgaaaaagttggttccgaatcccttaaaattgtctcttcatacaatgttctttatagagacttcgctgccaagggtgctgccgataaggtacaaagtaaattcgaatttagacatggtagaaaactaataatcttattgtagnnnnnnnnnnnnnnnnnncttttgtgtgacgaagtcttagtcgatattgaatacatcgaattttttaacaaatatactacacttatttatgnnnnnnnnnnnnnnnnnnnnnnnngcttgatatcattggtattacatattttgagggatgagctcaaccagaagattttatcaaaatttaatttttagataacaattaagattaaaagttttcatatattgaaatatgnnnnnnnnnnnnnnnnnnnnnnnnnnnnnnnnnnnnnnnnnnnnnnnnnnnnnnnntatagatttaaagnnnnnnnnnnnnnnnnnnnnnnnnnnnnnnnnnnnnnnnnnnnnnnnnnnnnnnnnnnnnnnngaggtttagnnnnnnnnnnnnnnnnnnnnnnnnnnnnnnnnnnnnnnnnnnnnnncnnnnnnnnnnnnnnnnnnnnnnngnnnnnnnnnnnnnnnnnnnatgaatgaccgcgannnnnnnnnnnnnnnnnnnnnnnnnnnccattagtttgtttattgaaagctgcaatgaaggatagaatgaaaatnnnnnnnnnnnnnnnnnnnnnngaaagnnnnnnnnnnnnnnnnnnnaaagnnnnnnnnnnnnnnnnnnnnnnnnnnnnnnnnc

SEQ ID NO: 16366 - DNA, 902 bp, Diabrotica virgifera
  misc_feature (67)..(85): n is a, c, g, or t
  misc_feature (89)..(135): n is a, c, g, or t
  misc_feature (137)..(153): n is a, c, g, or t
  misc_feature (155)..(170): n is a, c, g, or t
  misc_feature (173)..(209): n is a, c, g, or t
  misc_feature (247)..(310): n is a, c, g, or t
  misc_feature (355)..(401): n is a, c, g, or t
  misc_feature (406)..(418): n is a, c, g, or t
  misc_feature (420)..(480): n is a, c, g, or t
  misc_feature (488)..(517): n is a, c, g, or t
  misc_feature (519)..(548): n is a, c, g, or t
  misc_feature (550)..(564): n is a, c, g, or t
  misc_feature (566)..(590): n is a, c, g, or t
  misc_feature (605)..(628): n is a, c, g, or t
  misc_feature (670)..(691): n is a, c, g, or t
  misc_feature (732)..(774): n is a, c, g, or t
  misc_feature (794)..(812): n is a, c, g, or t
  misc_feature (859)..(894): n is a, c, g, or t
atagatatatttttaggtaaacccctttgaaaaagttccccttaaggaagttagttaggattgtggnnnnnnnnnnnnnnnnnnnccgnnnnnnnnnnnnnnnnnnnnnnnnnnnnnnnnnnnnnnnnnnnnnnngnnnnnnnnnnnnnnnnngnnnnnnnnnnnnnnnnatnnnnnnnnnnnnnnnnnnnnnnnnnnnnnnnnnnnnngataagttttgtgcaatgaaatttgattcgattttagnnnnnnnnnnnnnnnnnnnnnnnnnnnnnnnnnnnnnnnnnnnnnnnnnnnnnnnnnnnnnnnngttttatatgattagtattagatatttttagggatgaggttaagnnnnnnnnnnnnnnnnnnnnnnnnnnnnnnnnnnnnnnnnnnnnnnnaaagnnnnnnnnnnnnngnnnnnnnnnnnnnnnnnnnnnnnnnnnnnnnnnnnnnnnnnnnnnnnnnnnnnnnnnnnnntatagagnnnnnnnnnnnnnnnnnnnnnnnnnnnnnngnnnnnnnnnnnnnnnnnnnnnnnnnnnnnntnnnnnnnnnnnnnnngnnnnnnnnnnnnnnnnnnnnnnnnngacgtgattattagnnnnnnnnnnnnnnnnnnnnnnnngaaagtctcgtctgtccactgattagtttgaatgaccgagannnnnnnnnnnnnnnnnnnnnntataatcattagattttttattgaaaggtggaatgaaggannnnnnnnnnnnnnnnnnnnnnnnnnnnnnnnnnnnnnnnnnngtatttttgagttaaaaagnnnnnnnnnnnnnnnnnnnggagaagatcgtatagaggtttataaattattactaaggttttttgnnnnnnnnnnnnnnnnnnnnnnnnnnnnnnnnnnnngggtgtgg

SEQ ID NO: 16367 - DNA, 607 bp, Diabrotica virgifera
  misc_feature (5)..(23): n is a, c, g, or t
  misc_feature (28)..(220): n is a, c, g, or t
  misc_feature (224)..(326): n is a, c, g, or t
  misc_feature (344)..(420): n is a, c, g, or t
  misc_feature (432)..(535): n is a, c, g, or t
  misc_feature (539)..(568): n is a, c, g, or t
  misc_feature (582)..(602): n is a, c, g, or t
ggggnnnnnnnnnnnnnnnnnnnctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatatgggcccccccnnnnnnnnnnnnnnnnnnnnnnnnnnnnnnnnnnnnnnnnnnnnnnnnnnnnnnnnnnnnnnnnnnnnnnnnnnnnngaggggggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcnnnnnnnnnnnnnnnnnnnnnnnnnnnnnnaccccggaaaccannnnnnnnnnnnnnnnnnnnngggtg

SEQ ID NO: 16368 - DNA, 880 bp, Diabrotica virgifera
  misc_feature (656)..(682): n is a, c, g, or t
  misc_feature (684)..(705): n is a, c, g, or t
gcgacttcaactattttttatattcagacattcagattgaattaaaattttgttttgaaagcagtataaaatggcaaatccaaataatagcggacccctaggatcgggaaatacagaagatgatgagctgacccttcccagagctagtattaacaaaatgataaaagaattagtgccctcagttaggatagcaaatgaagcaagagaattaattttaaattgttgcacagaatttatccatttattgagctcagaagcaaatgaaatttgcaatcagctgcacaaaaaaacgataaatgcagagcatgttttaatggctctgaacaggcttgggttttgtgattacactgcggaagctgaagccgtcctcaaagattgtaaggcagtagcagcaaaacgcagacgacaaagtacgaggctggaaaatctaggtattccagaagaagaattgttaaggcagcaacaggaattgtttgccaaagctagacaggaacaagcacaagccgaccaacagcagtgggaacaactacaagccgcagccgcaagacaagcccaacagcagcaacaacaacaaggagaagatgatctagatgattattgttaggtgttgacgatagtggagtacaagaaggcactgtagatagttgatatgttcnnnnnnnnnnnnnnnnnnnnnnnnnnncnnnnnnnnnnnnnnnnnnnnnnatgcatattaggacatacacaatgtgtcttttctgctttcaattgtcttttatataaaagaaacagttttgtaattagtccagagaaataaaatttttctcgtgacacatccccctctaggccaggaccaaattttttgagtagtatggacatctatattaataacctttacgtt

SEQ ID NO: 16369 - DNA, 930 bp, Diabrotica virgifera
  misc_feature (711)..(742): n is a, c, g, or t
  misc_feature (803)..(803): n is a, c, g, or t
gttaagtgctggaattgaaacccaactatattatcatgctcagcttttcttgacattctgttttttggttcaatcgctgatgttggacaataaaaaaggttgggtgctttagcaactggccatgtttttcatcaatacagagtgtgcgacaaactttaataggtgattctgtatgaaagggaaatggcagtttccattataaagttatgcccgcaaatgtttcgtttccgagatgcggggtgttgaagtttttcttacaaactggcgatttgtttattgctctaggaccggttgacattatgcaagtgaagtttgatgggtcttaagaggtagttattgcgcatttttgacatagaattaagaattttatattcaccattggcgtgcatacgggtaatatgactcgtatgcgcgccaatgaagtagcttcttaaaacctaccaaatttcagtttcatatctcaaccggttttggactagtaagtaaatcgtcggtttctaagagggatttcaacatcccgtgcctcggcagcggggcatttgcggacatgtgtttataaggcaaattgtcattaatttttttgtgcagaatttccccttaaagtttaccgtacttatttagaaacaccctgtattgatggagaacatggctggttgttgaagtgcctagcttttttattgtccaacataagcgaattgatagaaaagcagnnnnnnnnnnnnnnnnnnnnnnnnnnnnnnnntttagtttaagtattttatagatgctagaatattccacagggtgcggtgaattttgagaanaggatagagtttgattggttcacccggtgtacagtgacagtttgcccgtctggcagcaatattgttgcagcgatgttgttgaagagtggggctatgacatattgaaaaatcacttaaatcggacagc

SEQ ID NO: 16370 - DNA, 926 bp, Diabrotica virgifera
  misc_feature (818)..(818): n is a, c, g, or t
atttgtttcttattgtcattgtttttaatgacgttttttggcagtaattaattatttcgtgggaagaaattaagtcgattttaatgtattaactctgccctaaaactgcagtactcaaatgtttaccagttatgaaatcctaacttgcgcagtaaaatagtaaaattgaccaacacaaaatacaaaattttaggtttagagattcttagaacatttcacaactggtaataaatatgtacaaagtactaaactcagtagttacatacctaccatccaataacttagtgttgccagaaatcatatttaccaacaccttcaacgaaatgttaaggataggtaaattttaatttgtagtattagtctaagagctttcttaaaattcttgtttttccgacattgctagcttttggtccttatgattactataaacttttaatgtgagttataaatgtaatattcatgtctacaataaaattaataagtgttaaatgtattttcttattgttgagtactgtaagagcaacatgaaaacactgaattgaatcgaattttgtccatgagatttagaaagtcatccttcctatatacaccatttacattatatatgacaatagtatttttattatctttttggatttatataaacctagtgacttgttgttcaagtagtagtacaataattgttaaagaaaatgtagccttgttacaagaaattagggtactcgaaaaagcttctggcctattttgtgtgttaggtcttcactattgaaaaatacactaattttgtaggaatgtatcttgttttttaattattttgntaataaaatcacatatacccctgttattgtatagtaaatatgttaaaagtggccttagttctacattatttcatgtaatttcgtattatttcatccaattgtcacatc

SEQ ID NO: 16371 - DNA, 344 bp, Diabrotica virgifera
cttcttcgggaacggtagtgtctgattactatttttttctgattggactttttgctcgataaattagagaagcgatattttagactcgcgtgcaacgcttcagacctataagaaaactacaaatgactgatccaccaaacgtggacgatgcatacgaggcgtcgctcctgtagcttgctccaatttctaaacgagggaaaacagtgggaggaggagcaggttacgacaacatagatggcaggagactatagataagaccgtatagaggatttacataacggagtttacactcttctatgaagagtacatatcgagcgttgggggcagacaataatcagagacag

SEQ ID NO: 16372 - DNA, 714 bp, Diabrotica virgifera
  misc_feature (2)..(515): n is a, c, g, or t
  misc_feature (522)..(559): n is a, c, g, or t
  misc_feature (579)..(592): n is a, c, g, or t
  misc_feature (595)..(617): n is a, c, g, or t
  misc_feature (625)..(647): n is a, c, g, or t
  misc_feature (677)..(708): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16373 - DNA, 625 bp, Diabrotica virgifera
gagcaatagtgatggtaactgacacttttactgactcaaaaaatgtgatttcgataaactttaattgcaatttgcgccgtaattatacgtaattaagagttggcgcaatgataagatttggccgttactttgaaacgaatctattcgtatgggttttattgaatttgagtgacattatatttttcatgggatgtgtgcgatgtccttttcgatttatttaacaacctgtttatttgtttttttattagctggtttctccattgtccattgttttatcagtagatttgataagcttaaatctttgtatcaactttggtagacagggttgccaggccagttcttactctttcagtactatccgttgcaagataattcggctggaattccggaacaacatgaacgtttatgtgatatatctgctctgaagacgcagacgatttattatgccgatatcgatggtgatgtatcaagtcaaacacgaagagccaaccagcagtgattaatgcaacgtgaggaaaacagagttcgcttattctgctctcccatgtgtcataccgactcattgtctacatttttcaatgcctagaactttatgctttgtagacgactccctaaactcgtagct

SEQ ID NO: 16374 - DNA, 620 bp, Diabrotica virgifera
  misc_feature (25)..(46): n is a, c, g, or t
  misc_feature (52)..(70): n is a, c, g, or t
  misc_feature (161)..(182): n is a, c, g, or t
  misc_feature (488)..(514): n is a, c, g, or t
atcagaagtagacgttcagctgagnnnnnnnnnnnnnnnnnnnnnnacgaannnnnnnnnnnnnnnnnnngctttctacctggatttgcaagaaaaggtataagaagtagacgatcagctgaattagaagaaccagaagaaaataacgaaagagcaaagannnnnnnnnnnnnnnnnnnnnnctttgcaaggaaaggtatcagaagcagacgttccatatacttagaagatacagaagatgaagaatctggtaacagagaaaggagaaatatcggctttttacctggtttcgcgagaaaaggtattagaagcaaacgatcagtagatgatgaggaagaaaaggattctgaaagaactaagagaaacataggatttttaccaggttttgctagaaaaggaatcagaagttaaactaaatgatttttgatttcaaatgtactaactgttaatatgcaattttttaaaattgcatattaacagttagtacnnnnnnnnnnnnnnnnnnnnnnnnnnncatgtaaatgtatttattatagtatttaggtatttgtgtataattttttagataataaatcttttgtaatatagttacaagctgggtcttattggtgtaaggtatg

SEQ ID NO: 16375 - DNA, 913 bp, Diabrotica virgifera
aaacgtgaacgtcgagcaatcatcaagcaaaatgaagcacaagatcaagcaatgcgtcaacgggaactagaatatcgccgaaagcaacgtgctcaagctactacagaacaaatcttggcaagacgtatacgggacgctgaagcccggcgtcttcggcgtgcaaatgaaactgaggagcaagctgaagcgagacgagcgcgcgaatctgaagcccgtcgtatacggcgcgcaaatgaaagcgaagagaaaaaagaagcaagacggaggcgtgataatgacgcacgtcgtttgagtcgaaaactcataactaatagcgaagcccgaccttttgtatccatattaaagactttactagtttataaattagttgactagaagataaagctagccgtgtaaaacacgttttgatgttttgctacaaggttatttgaaacgaggatggttactggtaaaaaatgtcgtagtactacatgtacataattgtgtgacgtggacactatcgaatagaagctaagaacgggctcaattctgggtatctctaaactccggtttcaacatccgtttttatccggttttaccgatataagcgaggctctgtcagaagtgaccatccattaccgaacttcttgtggaacaagatgttctgttgcatttcgacggcgaaaggcaggacctcgtaactgaaaacttttcataaaatgagttacttcggttttcgctttaaaataaatgtagcggcacctattaaccagcggttaaagctgggaaaatctccggacggacttaaattacagaaaacgctactgctcaacataagacgatacgccctaaatgaaaaatgattcggtttttttggtctcctgtaaattcgtcatcttgccacttacgagttcctgccctttccgccgtcaat

SEQ ID NO: 16376 - DNA, 78 bp, Diabrotica virgifera
  misc_feature (21)..(21): n is a, c, g, or t
taacagcgtaattttattggnagagtcaaatcgataataaagattgcgaccctcgatgtggattaaagttataattgg

SEQ ID NO: 16377 - DNA, 839 bp, Diabrotica virgifera
cggacgcgtgggcatacttaaacagatgcttgttgcaacaaggtttcttgcagggtggtcgaagtgtgagattgttctgttgacaagttcaagctgtagtaacttacttgttttggatgaaacgccctgtgtcttactagtctgtcgcgtggaggatttacttggctttcaatttgtactggggtttcctatacctatctttttgcagggtgctcaaggtattggattgttctgttagcaaattcaagctgtaataacttgcttgttttgggtggaacaccctgtatcttactagtctatcgagtggagggtttacttggctttcaattcttgttggggtttcctatacctatctcccttcattttttaaatgtttagagatttcctaatttgtaagctttagaaattagaattaagtacctatgtcgtggttgtttgcaacacatcgccagcaccggcaatatacttaaatatcttagtcaggatggtttcattgatggaattcgcatttttattatttaatcacacagagtgttcttattttaaatgacataggtactcgatattctattctttataatggaagatatttaaaatctcttcaattccatgttaacattctcaatacacatgttatcctgtaaatataaattcccatgttattctgtaaatacccattcaattagtttgaaaacccatttgggggtacacactggaaaaaactacaaatcttgaacttgtttaaagcagtttattactgcaagttataacggtagctctgttaaacatcagactctgtaaaacacaggtttaatttaaagtaaaatgttattcttaat

SEQ ID NO: 16378 - DNA, 702 bp, Diabrotica virgifera
  misc_feature (109)..(154): n is a, c, g, or t
  misc_feature (177)..(194): n is a, c, g, or t
  misc_feature (263)..(283): n is a, c, g, or t
  misc_feature (371)..(393): n is a, c, g, or t
  misc_feature (576)..(593): n is a, c, g, or t
aacaccaaatgactgataaaaaaacatgccaacttttatggaaaaaaagagaaaacagaaatgaaaaaataaatggataaaatgaaagaagaaagagagaaaaagttgnnnnnnnnnnnnnnnnnnnnnnnnnnnnnnnnnnnnnnnnnnnnnncggggtctcctttcccccctttnnnnnnnnnnnnnnnnnncccccccttttccccccccagggggggttgtgcgccccccctaaaggggtggggggggggttattcccnnnnnnnnnnnnnnnnnnnnnccccccttaagctggtgtgggggtttctttcgggaaatttttataactttttgggaatcgggaaattttggccccttttccggggccnnnnnnnnnnnnnnnnnnnnnnnaaaaattcttcgggttggggcggggggtttggggccagagttttttgccggggtttttccctgggtagaccctttccccgctttttttggcccctggggaatttttttttgcaggggggggttaaagggggggggtttaaaggtgttttttcccctttttttcttttcggaaatacttttccnnnnnnnnnnnnnnnnnngggggatttaaaccggttgggaaaggttggggtttttttttttgcccccccgggggtttccctgggtgtttttttgttacccccccgcggggggcgggttgtcctttgt

SEQ ID NO: 16379 - DNA, 958 bp, Diabrotica virgifera
  misc_feature (830)..(830): n is a, c, g, or t
  misc_feature (834)..(834): n is a, c, g, or t
  misc_feature (844)..(844): n is a, c, g, or t
  misc_feature (936)..(936): n is a, c, g, or t
agctttttctaaatatagaggattttaaactttggcgacaacaagagtaccgttaaaaatatgttggacaatattagcagttacttgtaaatatttttatcaaacagttctgcaaaaatcagctgagaagttataaattttatgactctttataatgcgtgcgcccccttccccatgggggtcgcactatggagtcatgaataatgattacacgattgtttgatagaaatatgtacttaatattttaagggtacctactccagttgggtataaatttaggtgcgttatgccctctatatttacgaaacgccccctcccctgaaaattttccgaaatagaaaggttttccgactcgacatgaataactgaataaaaaaatttcgtaagggtaggtagtaattttttaatggtgagcccaagaactataagcaaaagttgtattagatataaagtaatggtattactacttaattcattttgttaattataaagatatatatttgtgttaaataaaagacacatatgttgcggatgtaatgtcagtcctgacctagaaatacgtgtacatagattgtaaatgtactttttttatttcaagctgttttatttaattactggctgtctgagctgaaatctaccaaagacgatttatacaggaccaccttgtataacaaaatatttagtcattagtcataggttattaacatatcacagtagaaattatatgtaaaaaaggttacatttcatgtatcacccgtttggatatcaaagtaaatagggtgttattttgaaagtttccatatgtcctttaacgtgtatttacatttggnctanaatggctcanataaaaatcgtttaaagacagtaactttcagctcagtttttttgcaaactatcactatctccatgtaaaattgtaatgtataatatttctgntatatcaatttctcatttgttt

SEQ ID NO: 16380 - DNA, 53 bp, Diabrotica virgifera
  misc_feature (7)..(10): n is a, c, g, or t
  misc_feature (12)..(52): n is a, c, g, or t
taattgnnnngnnnnnnnnnnnnnnnnnnnnnnnnnnnnnnnnnnnnnnnnnt

SEQ ID NO: 16381 - DNA, 911 bp, Diabrotica virgifera
aaacaaagccatataattttaaactttctggttatggagggacgaatcacttgcgatcatatggacgtaatttgggcagctgctcaactaaaacattgttcaaaacctgtccacgatctgttaccgggtcttgttaaacatttagcagccgcgcctactttacatctctatagtttgttaacgaagctcgaacctaaggatcacacggaacaagtaagtacatattaacattcacaaaagaaaaatcatgagatgtttatgtataaagaaaataatttcttggttaagttcgcttttaatttatgtctactataataaaatactctatcagttactgttttgaccgattttttaatcttcttctttaagtgccatctccgtgaaagaggtcggcaatcatcatagctattcggattttagcgacggctgctctggaaagttcattggatgtacatccgtaccattctctcaggttgcgcagccacgaaattctgcgtcccctggtagggcttttcattcacagtcatttgtttcgagctttctgttatgtgttgtatgatccgtgtatattaatattatacacggattatacgacatttgacagaagctcgaaacaaatgacaatcgatgaaaagccctataagcgaagcaataaagcacttaaatcggccttaactccgaaaaaaaaacgacaagacggatcttaataattcttgttacactcgattcgtgaaggcgccaggaaactttgtgacccagagccatgatataaaattgaaaaactgcatacaaaaaatgcattattaaagtgcatatcaaacgacaataaaaaaaattcagaactcgtcaattatcggcggaaatgagttcaattttgttactcggggtgcctactgattaccacgttttct

SEQ ID NO: 16382 - DNA, 917 bp, Diabrotica virgifera
  misc_feature (149)..(185): n is a, c, g, or t
  misc_feature (349)..(366): n is a, c, g, or t
  misc_feature (858)..(858): n is a, c, g, or t
cccattctagtcaacaacgtcgtactattactactagttccagtagtggatcaataacttcaagatggcctccaccttcaactaatattgaaagtactagactcggttccatctcggaccttacactcaaaccaataccgtacaaaggnnnnnnnnnnnnnnnnnnnnnnnnnnnnnnnnnnnnnaaaagtccatttcctagacacaatagcgaaagactgcccacaaaaactaccaacaataacgtggtatccaaaaagttcattcttcctagtagccaaaaagttgaaactgacgccagaccttttcaaaatggtagtaccatttcaagtgtgccccgaatacagcnnnnnnnnnnnnnnnnnncaaccaataatactaggcccatcacattgagtgacataccaaagtatgatactaatgggccgagaagaggaactgttgtgatatttaacaacattaaatttttggacataaaagacgaaagaaagggagcagaattagatgaaaagaatctgaagacactatttcgggatatgggcttcgatgtctacgttcatcaaaatcaaaaactgaatgaaatgaaaagtaaacttaacagctacagacaaagtagagatgtcggcagaggtgacatattaattgtaatagtaatgagtcacgggaacaatgcgaggggcagtgaagaaataccaggagggtttacaaaaattcagacctccgatgacaaatatctgaatgttgacgagtttctatcggagtttaccaacgataggtgtgcgccgatgaaaggaaagccgaaaatttttatcttccaatgttgcaggggacatagagaagaattgcaaattgatgcgngtccttttaccaacattgtaaaaaaacacgcagacatgctgattgcgttttctactgta

SEQ ID NO: 16383 - DNA, 121 bp, Diabrotica virgifera
  misc_feature (10)..(66): n is a, c, g, or t
  misc_feature (68)..(111): n is a, c, g, or t
ctacaaagcnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnntcgtcgatac

SEQ ID NO: 16384 - DNA, 720 bp, Diabrotica virgifera
  misc_feature (353)..(367): n is a, c, g, or t
  misc_feature (689)..(716): n is a, c, g, or t
gaggcaggtaatcattccgctgttttggcactaatacaaaataactctgattgtgatgctacagatgtagaaaatgacaatgcatttcacatagctatgagagaaggacatctaaatgttgttaaagtactactaacagaatcttatatagatgtcgaggcagtaaatttgaagggtaggaaccctcttcacgaattgtgtaaatatggaaaagataatgcagccaccatttgcggactgttgttagaatgcattcctacgtatccaataaataatccagacattttgggtaattcacctctccttctggcatatataaatggaaacggaagcctttgcagagttttagtcannnnnnnnnnnnnnntgtcttccgaaaattcagaaagagtgactatatttaattaccaggttccaacaaagcagcttttgaaccgccttctagacacattatcggaaccagcgccatggacaaacacagattcctgccaagagtgtggtaaaagatttacccttacagttcgcacccaccattgtcgccattgcggacgagcactctgtagcaagtgttcggatacggaagtgccgattataaaatttggcgagaacaaaccagttagggtctgtaaagtctgttttgatgtattgaagactggagctagttaattattaagatattgttcaggatnnnnnnnnnnnnnnnnnnnnnnnnnnnnctgc

SEQ ID NO: 16385 - DNA, 921 bp, Diabrotica virgifera
  misc_feature (263)..(284): n is a, c, g, or t
gaacaataagagccgaaagagaaaacaactacatagtggtgtctacaaactaacttgtgactgtccgaaaacttacatcggtcaaactggcagaacctttgacaaacggatagcagaacacaaaagggctttcaataatagaaaaacagatacttctacatacgcacttcaccttctagatcataatcattcatttaatgaagagtttcaaattctgcatattcaaaataaaggtcttaagctatctttattagaatctatgnnnnnnnnnnnnnnnnnnnnnncagatataattctgaatgaccaactcgagacaaacagctccccactcctcaacctcttcagttaaagactttaaaaaggcaaacacatagtaaactaaatcacttgagaaaggcactctgccgaaacagctgtagtcacatagttataataaattttgtggaagtatagaaaacaaactttttcggtgttttattgttagagaatagacccatttatcaaaaaaattatcctcgttgctctttcttcctcctttgcaggacactagactagaccaaccaactatcactattagacaagcgactgcaccagaattactatagtagagacagaagatacctaaacgtggtacatataagtacaagacaaggatcagtcagtaatacatacacgattagcgagatttaagtgttttatatggtgcatatgactttattgtccattccctccagtcatcgacaactgtagtgttccttcgtttctttgatgtctggaggtgtaatacgactcaaaacagagacccacggagtaggggtaattttaatacattcgctgataatcctcatctgttcagccacactggagtgcagtattcgataagtgagtagaccagactctcagctgatattctgagaatag

SEQ ID NO: 16386 - DNA, 918 bp, Diabrotica virgifera
actacctaagattgatttgatcgctattgcggacttctgcgctggtgctatggaaaattggggccttgtgacttacagagaaacctgtcttctcgtagatcctaaaaacacttcggctgttagcaaacaatggattgcgctagtcgtaggtcacgaacttgctcatcagtggttcggaaatcttgtgactatggaatggtggacccatctgtggttaaatgaaggttacgcttcatttgtagaatttctctgcgtcaactacctcttccccgagtacgatatctggactcaatttgttaatgattcgtacatcaaagctctagaattagacagtttgaaaaattctcatcccatcgaagtacctgttggaaacccctccgaaattgacgaaatattcgatgacattagctacaacaaaggagcttctgttataagaatgttgcatcattatatcggagatgaggatttcaggaaaggcatgcatttgtacttaaccagacatcagtacaaaaatactttcacagaaaacttgtgggctgctttagaggaagccagtcaaaaaccagttggggacgttatgtctttttggaccaaacaaaaaggatttcccgttgttaaagttacacagcaaccggcaggtgacggtggtggtgttaaactaacgctctcgcaatctaaattcaccgcagatggatcgagtccagcggacgaagattatctgtggatgataccaatttccatatctacctccaaacatccttccaaagaagtagtttgcattgttctcactacgagaacggcagaaatcgttgtacctgaaagtgaaaaatcggattggattaaggttaatccaggagctattggcttctatcgaacccaatacacccccagaatggttggagaagtttattcctgcta

SEQ ID NO: 16387 - DNA, 821 bp, Diabrotica virgifera
  misc_feature (13)..(198): n is a, c, g, or t
  misc_feature (202)..(816): n is a, c, g, or t
cctctcgcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaac

SEQ ID NO: 16388 - DNA, 999 bp, Diabrotica virgifera
  misc_feature (188)..(207): n is a, c, g, or t
  misc_feature (264)..(283): n is a, c, g, or t
  misc_feature (406)..(425): n is a, c, g, or t
  misc_feature (885)..(905): n is a, c, g, or t
gctttgaaaaagtcgacttgcaaccttattgatggaatatagcgttcacgttctagtgagtagaactattgagtgcgctcttataagtaatgaatttttctatcgtatttatagtttttaaaaaggattcaagtagagataaaagtagattttattaatctatgaaaagtaatattttgcctttccannnnnnnnnnnnnnnnnnnntggaataatgatgcggctgtagtttcgtgttgcaacgaaattgataatggttattcnnnnnnnnnnnnnnnnnnnntcaacttttcccgaaaacattttttgttttgaaaattatttccaattctggaataatcttccttaacaagatagccagtgttatagctgattttctatctaaacatccatgatgttgattgcnnnnnnnnnnnnnnnnnnnnttgattatgtttagaagtttgtcctgcaaatgtatcgttttttggttttattaaaaattctcgtctttttctgttgattttatatattttttgctacttttttctgttttctgcaatgttatctttcgtaaacgttctaatttacgtacttttctgaaagattggttagaaaaacgacgattgaatatatttgttttataatttcaaatagttggatccaaagcatattaattgttaaatatgttcattgtatagatgtttacttaaacatgacatatttcaccacggtgtggtgaaacatgtcatgtacataatatgcagctgtatttgctatatagctgcatatatgtattgtctagtgaataagtgccaaaatggaaaggtatttctttatttacttgtaactttatgactcttcatacaccacttggtaatccgtaacttgtgttacagattcaannnnnnnnnnnnnnnnnnnnncgatagaactttcattactaaaaatacacttatttcacttttttctacgtaaagaatgtatgattttgtttgacgtaatatattttgttctatg

SEQ ID NO: 16389 - DNA, 502 bp, Diabrotica virgifera
tttcgtttgttcttgtatacgtataaggtgaacgtagactattcttgcttgttctctgcagctacttctcatgtgccaagtagaaatggtctattggcgttgtgacctcctctaacaactcgagtatgtctaatatccacgatcgtaacgcaagtagattaaggaatcacttaccaaagatttgtaatagccgtggtgcatagaccgctgaagagagaagagaaagcatctacccgcgatggtgaattgagtaacttggagctcgactttgactagagctgtgtacagatagcagaagaacatcgaacgcaacgctgatttccattgacaactcagtatagcaatgcggaagctgatatctgtcgcgagagatactgatcggaaggacgtgctcgatctgaacaactctgtcagccgaggaggaaactacgagatggtcttgctgaggatgaacaaaccgtcgaaactgtcgaagagatggttgttggtcgtgaaaagagct

SEQ ID NO: 16390 - DNA, 602 bp, Diabrotica virgifera
  misc_feature (23)..(23): n is a, c, g, or t
  misc_feature (25)..(26): n is a, c, g, or t
  misc_feature (30)..(30): n is a, c, g, or t
cctctcggggccgcgcgccgggngnnacancccaagaagcgctttttggatcctaagatcaagtgcgaacaggagcatttactttagatcccacagaatcaaaatgagacaaagttttttttcaacaccacatcggcaacaagaaaaaaaaaacagaaagcacaacacacgcacagcacctacaagaacataatcaaaagccaaaagaagaactgcaaaatctgaagattcaaaaagaaggacgcagtggaacatgattagaagcaatgaaaactaagacactaaaagagacagatataaaactgaaagaccaactccagacaaaaagatccccactcctcaaactcaccagataaagactttgaaaagcgatccagaagagaaagtaactcacgtttttttttcctcggccgagcaagctgaagactcttaatagaaatagaaatggtggaacaatataaaaccgacttctaccgggattacaagccagagaatcgacccagttaacaaataaatcatacccacagctctaccgtcctccttcgcaggacaataagaaagcacaaccaactacgacaataagactcgccacagcgccacaa

SEQ ID NO: 16391 - DNA, 853 bp, Diabrotica virgifera
  misc_feature (533)..(550): n is a, c, g, or t
actaaaaatgcatcccagtttgccataatccgaaacattcaacaagttggtgcaaatcttacagccattttttcataaaaaggttcccacctattatttgcaaaggtagacttggacttgtgaaatcaaatggtatgcgcagaattttatgaagaatacatgattaaatttccagtgccctttcattaggtagattttgtaaagttttgattttttgatatttgatattcaattacgccctctagcggtggacctagaattgtgaaaatgttttccgggcttttcccgaggcaacttttgttataaatatttttttctcaaagctgtactataaacggttcatgacatattgccgagagccgttcttattgggacacccggtacattccttttgtcctgtatgtttttttttcatcctgtgtccatgttatcgtcaaatggtccttgtgtgacctattttcttcctttcagagtctatcactgtccacatttcgactatttttgtctagacatgagtttgtctgtttttcaannnnnnnnnnnnnnnnnnctattctgctatttctgacccagtccttaatttccttcaccttgcatctccggaatcttcgcaattaataattacctatactgctagctctgtccaatagtatcttaccatcgatttttttaagggttttcatctctgctgcttctagcaatctttttgtcctctttgtgtcaggtaatgtttctcccacatggcattattggtctgatgactgttttgtaaattctgcgtttcatttgtaccgatatttttatttctccttactgtttcatttcacgtaacctgcggctctatcacttgatc

SEQ ID NO: 16392 - DNA, 809 bp, Diabrotica virgifera
  misc_feature (2)..(42): n is a, c, g, or t
  misc_feature (44)..(71): n is a, c, g, or t
  misc_feature (74)..(87): n is a, c, g, or t
  misc_feature (92)..(283): n is a, c, g, or t
  misc_feature (285)..(577): n is a, c, g, or t
  misc_feature (604)..(641): n is a, c, g, or t
  misc_feature (661)..(674): n is a, c, g, or t
  misc_feature (677)..(699): n is a, c, g, or t
  misc_feature (707)..(729): n is a, c, g, or t
  misc_feature (759)..(790): n is a, c, g, or t
cnnnnnnnnnnnnnnnnnnnnnnnnnnnnnnnnnnnnnnnnncnnnnnnnnnnnnnnnnnnnnnnnnnnnnacnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggaccaaatatatag

SEQ ID NO: 16393 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16394 - DNA, 102 bp, Diabrotica virgifera
cctggacctctttgacatcaactagttccttttttaaatctccttaaccatgtctgacgaagaagaaggtcactccggccaggacgtcgataaggagtcttt

SEQ ID NO: 16395 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16396 - DNA, 730 bp, Diabrotica virgifera
ctcctatgtacagttattgatgtcttttactattaatcgtcacaagatgggatatacccatatgcctcgtagttcattatttgccatccgctgtggaccgaaaaaatcatgtatcgtttgaattcaaataccttgttgctcttgtgcgctatgaccccaattttgctgatgtatctccttgcttctatattataatacaccatccacccacacataaaaagagtacttaaatatatcctatttattccgttgaaatatacaacatgatgagagcaaacaagagataacaaaagatcgaaaatgcgacaccgatggtgtcgtataaatctgtaccggatatggaaaaggatatattactggagacaccaataatatcaagagatgaaacgaacctcaaaaaaaacgaatgcaatggagcacaggagaaaaggacgccctcacaatgcaacacaccgaacccaaaaactacacaatgcttatttactaccttatgcgtatgggtaaatatacatgaggctgcaaaactctgcattgttgagcctaaaggctgttttggaggaatgaactgacatcaaatgttgaagtgcgcctttgataccgttatggacacagctcttatgccacatgatcaccacttattggataatattctgcattatgctccttacagctactatgacgatctatgattatcgacagagggcgaatcgacctcacacactgtgaagca

SEQ ID NO: 16397 - DNA, 214 bp, Diabrotica virgifera
  misc_feature (2)..(142): n is a, c, g, or t
  misc_feature (147)..(176): n is a, c, g, or t
  misc_feature (178)..(197): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgnnnnnnnnnnnnnnnnnnnnnnnnnnnnnngnnnnnnnnnnnnnnnnnnnncaaagaagggtgggatg

SEQ ID NO: 16398 - DNA, 535 bp, Diabrotica virgifera
  misc_feature (386)..(401): n is a, c, g, or t
tacttataagtacatgtttttggtgagaaaggacaacgaatataatgaaaataccgaagtatgtttaggtcgaaattcccgccgctggaataacaactcttagcaaaggcttatatgtacaaactggtgaatgctcgggaagtgaaaggccttacagcagaggcaggatctccgcggattcccgaaagacgaatttcgactcctgaatgtcagtatagtatttaacagaagtttattagagtgcttaacctgtaaactgcgtagagtagtcgaaacgatcatacccagagttctagattcgtccctctgtatagatcctctactttctcgcaccgttataatcactattgctggagcgtcctttggaacatccgctcgagacgacnnnnnnnnnnnnnnnnaagttacgtatctgcaattcgtgaaatgcggtgaaatcttgatatatagaaaaataaggcacttgtttccattttttacttatatgtagtattgtatcttctgttgaagcaagaatcaaagaaggattaaacaa

SEQ ID NO: 16399 - DNA, 882 bp, Diabrotica virgifera
  misc_feature (34)..(59): n is a, c, g, or t
  misc_feature (443)..(457): n is a, c, g, or t
cttctcgcgtccgacaaatgatttgatagatgannnnnnnnnnnnnnnnnnnnnnnnnntataaaattcctaggatcaataaattatctttaaaaatagtatgaggttgcaagtatttgccaaagaaattcctcaacatataaaatgctttcaagaaaaaataaagatttgcggaccattaaggaaggagttgttggaaaatatgttaggaaagatactcctccggaaatgcctataataaatgtgtggaccaccgaaccaattagaagacattcaaatcaaggtagatcatcattgacttcctctaatacaataccaacgtcatcagcttcctcttcaaactcttcctcccagttaacggtccagaaatttggcaatcagaaaaccttaataagtgatgttggactaggagctcatgaaggaaaatatacacccagtgcttnnnnnnnnnnnnnnnctaccaggttcgcaaatcttacaataggactagctggtgattcaaccacgtttggcaatccagtgataaattcatcccagccaatatactcaaatcaaccccttggaagtgtatacaacgatagttcagcaaataatgctaactacgtggaaatagaccagatatatcctttgagtcatgatagtaataactaccaggattctcggtacaatagaacaaattctcctatttatcaaaatacaaataaaaattcagtaataaatgacacaaatttagactcgacacctatatatagcaacaccaatattaattcatttggaaatcaacccagagtattccgtatgctgagtcgttttctccacattcaagacatagcattaatagatctgaaaatactcaggaaacagctgaggaactacactacc

SEQ ID NO: 16400 - DNA, 93 bp, Diabrotica virgifera
  misc_feature (9)..(9): n is a, c, g, or t
  misc_feature (15)..(15): n is a, c, g, or t
  misc_feature (17)..(17): n is a, c, g, or t
  misc_feature (22)..(92): n is a, c, g, or t
taatttatntaattngnggtgnnnnnnnnnnnnnnnnnnnnnnnnnnnnnnnnnnnnnnnnnnnnnnnnnnnnnnnnnnnnnnnnnnnnnnng

SEQ ID NO: 16401 - DNA, 469 bp, Diabrotica virgifera
  misc_feature (316)..(334): n is a, c, g, or t
tttagctcttttcaattctaacatgatggatacctagtgattatctcatcttttggagctataaaatcttcctacatagcgcatcgtacaatctagtagataattcatttagttgtgtccgaagatacttgtcgattattctcccagacacgaagaatcgccgagcacactgcacatgctgaagtctgcgtcgcgacagatactttgatagaaagcgacacaaaggcataagatcgagaagccgttctcatgcggaagacatttacacaacatgaaagcaccctcgctccttgtctctttcagctaaatacctacnnnnnnnnnnnnnnnnnnngccaccgtcatattgaaaccgtactaccgagtccaggaacaaccggaaacaagccatgattttggtagtatttgaagagattagtatgacaccgatgtacaatgaattatacctcttcaggccttactcctgacc

SEQ ID NO: 16402 - DNA, 856 bp, Diabrotica virgifera
cggacgcgtgggttgatagtagactaacttgtaaagagcatattaacaaactaaaaggaaatgcaatgaagaggcttaatataatcaaggcactgtcacagtatacttggggtgcagacgaaagcattttacttaatatctatagagccttaattcgctctaaactggactacggtagtttcatttacatgtctgcgtcaaagtctgacttaaagttactcaactctgtgcataatacttccattcgtctctgtttaggcgccttcaaatctagtcttgtagagagtctttgcgaggctaatgagccacccctctggattcgacgagagtagctcctacaatcttacttttctacagtatctgcaaatccatctaaccgcgtctatcgtctaataaattcaaagcccgtctcggatttaccgagaacgatccaatcaattattgaaatccagaaatcaaccttaagaaatgccatcgatcttaccaaaacacttccatatccaattccaactacccctccttggagcagatcaatcctagatttaaatacttctttgttggcctataacaaacacgaaactccgagcattttaataagacaatactttgaagaaatcatagaaaagaaccaattccaaaaaattttatacacagatgcttccaaaagtgaaataggaactggatgtgctgttaccacagttgataagacaataaaatcatttttattaccagatgtatgcagcgtatatactgttgaattatacgcgatattagaagcttttaaatccttagaaatcgatagaaaaaccaagcaatatgcacagatttcttatcatcactcttctccttaaaaagt

SEQ ID NO: 16403 - DNA, 841 bp, Diabrotica virgifera
  misc_feature (454)..(471): n is a, c, g, or t
  misc_feature (766)..(766): n is a, c, g, or t
  misc_feature (839)..(839): n is a, c, g, or t
caactagcatacatattagggaaaaataaatgtatggtggaatatatttgaaaatttaattaatgatgtcatgctattatataaatatgtaaaatttacagtagcatgacattattaattcaatttttgaatatattcttccgtatatttatttttcttgaatgtatgcgagatggtgggatatgaatgggatcgtatccaacttggtgtactctggtattttggatttatcgtcgttacgcgtaacgttgcgaccctgacagaagtggtggtgagatctgttgactgtctcaattggaatcaaataaatttattcgttgcgttgaccaactattactaatataaacaatgccaatacttagaaaattgtttgaagctgtcatgaaatcattccatacagaagtggttgaatttttatggatataggaaaagtaacaaaccatttaaagaatannnnnnnnnnnnnnnnnnttataaaaaagtttattttattctggttaatggatttataaaataagtaaaaaaatgtcaattgttcgcctcttaacaggattaatttggtctttgttgctactggcttgtcattttttctatatccaaagttagctgcattgccactataggtttttccagccacatctatagtggatgtgcatgtttaactgtaattttaaggttatagaatatatattattgtaattatgtatttatgtatagatgtgataaaatggaaatgaacctatatatcaataaataacgttataanatatatgatatttctatatgtgtgaaaagggtacaatattcacagttctgtcatatttaatatattgattggnct

SEQ ID NO: 16404 - DNA, 928 bp, Diabrotica virgifera
  misc_feature (14)..(66): n is a, c, g, or t
  misc_feature (68)..(82): n is a, c, g, or t
  misc_feature (84)..(836): n is a, c, g, or t
  misc_feature (842)..(855): n is a, c, g, or t
  misc_feature (857)..(879): n is a, c, g, or t
  misc_feature (903)..(927): n is a, c, g, or t
attttcctcttatnnnnnnnnnnnnnnnnnnnnnnnnnnnnnnnnnnnnnnnnnnnnnnnnnnnnncnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagnnnnnnnnnnnnnncnnnnnnnnnnnnnnnnnnnnnnnttttctttcagatttaaattcatnnnnnnnnnnnnnnnnnnnnnnnnnc

SEQ ID NO: 16405 - DNA, 515 bp, Diabrotica virgifera
  misc_feature (333)..(353): n is a, c, g, or t
tctacctggggccgaatcacacaattttgtggatttgtgtgacccttaaagggctatagaaattttggggaaggtaaggagaggggaggaggtgtattattagtttggggggttttctcttggaagggcgtgcgtgatgatgagatttattggtaggggatgaggattgtgggattgaggaggtgtggttgatgttgtggtggtgggtagtgtgtgagtattatgtgtaaggaggtggtgatgggggagttaggggtagtgtgttgagttatgtggttgagaaatttatgtggttggttgtggggttgatgttagtagggagggtgatgtggnnnnnnnnnnnnnnnnnnnnnaaagggatgaggtgggagggggggtggggagtatcggattgtgtgtggtatagcgtgatgatttataggaggggggggaggtgagttggatgagttaaggggggctggtctttggtttatgtatgtggatttgggaaggattagtgggagggcagtgtgatg

SEQ ID NO: 16406 - DNA, 824 bp, Diabrotica virgifera
  misc_feature (223)..(239): n is a, c, g, or t
  misc_feature (759)..(775): n is a, c, g, or t
  misc_feature (791)..(791): n is a, c, g, or t
ccatgagccaaaatttgtgaaaagggagtgtattttgttttgagttttatacattaaaaagtcgattaaacgttttaaacaatgtcatctgctggctccagtggatcaggccgtggaagaggaggacaagctgctgtaggtgagcaaaaggaaagtaaagaatcaaaacctaatccgaaaatgtcaaaagctcttggaacttccgccaagagaattcagaaannnnnnnnnnnnnnnnntctagatcctcctccaaattgcagtgctggcccaaaaggtgaaaatttctatgaatgggtttcaactattcttggccctcctggatctgtttatgaagggggtgtgttcttcctggatatacatttttcaccagagtatccgtttaaaccacccaaggtcactttccgcactaggatttaccattgtaatattaacagccagggggttatttgcttagacatcttgaaagacaactggtcaccagctttaactatttctaaagtgttactctcaatttgttccttgcttactgactgcaatccagctgatccactagtaggcagtatagcgacccaatacctacaaaaccgagaagagcacgatcgcattgcgcgattgtggaccaagcgttatgccacgtgattctacttccccctaagacatagcttcacacttccatctttcaagatcactccctttgccaaacagaatggcaaaaaaattcatctttatcatttttcatttaggttaggctatgtnnnnnnnnnnnnnnnnnaacatattaaatcaangatattgtttaagttcattatacaatatgttta

SEQ ID NO: 16407 - DNA, 475 bp, Diabrotica virgifera
  misc_feature (54)..(71): n is a, c, g, or t
  misc_feature (178)..(192): n is a, c, g, or t
  misc_feature (194)..(207): n is a, c, g, or t
gggagttgggacagagttaattttttaggacttctattaaaagggatgaaatgnnnnnnnnnnnnnnnnnnattcaatttatatgcgtgagtgaagcctataatacaggataaaaggtaagagtgtgatagatgacaaaacacataagatagatgattaggatggatatggtaaaagnnnnnnnnnnnnnnngnnnnnnnnnnnnnngtggcaagcctatcgaccaataagaagtatagttgtgtgaaaaagggaagagcgtactgacaggtcgatgtaagtgatgaggacacatggtctcatataacgagtatggccgattgacaggagtggactatcaagtcctacatttaggaagggaagggagaacgaaatagtagaaagataagaactgacgatacgtgaaaggaagagttgaacgctgtatagagaagccgaagtggtagagaacaggctgttcgagctaaagaaggac

SEQ ID NO: 16408 - DNA, 360 bp, Diabrotica virgifera
  misc_feature (15)..(15): n is a, c, g, or t
  misc_feature (18)..(19): n is a, c, g, or t
  misc_feature (21)..(21): n is a, c, g, or t
  misc_feature (26)..(26): n is a, c, g, or t
  misc_feature (29)..(29): n is a, c, g, or t
  misc_feature (32)..(32): n is a, c, g, or t
  misc_feature (55)..(55): n is a, c, g, or t
  misc_feature (64)..(64): n is a, c, g, or t
  misc_feature (112)..(134): n is a, c, g, or t
actccctgggggcgnggnnanaaaantgnatnaagaggaagtccttagagagaanggatggtgnaattgttggattagagagtggagaagaaatttgtgaaaagagagaagnnnnnnnnnnnnnnnnnnnnnnnggcttagtgataaggggagggagattggagaggatgaggagaagtggaagagaggaaattgatgtgtgtgaggtggagggagaagaatgaagaagaaaaatgaagatatagagaagggaaagaaggatgatatgagaggtgtaaaagtagagtgtgagagtgaatgatagaggaagtaatgaggaggaggatgtttgatgaaggagaataaattaattggagggag

SEQ ID NO: 16409 - DNA, 619 bp, Diabrotica virgifera
cggacgcgtgggtttttgattgtcttcttttttcgacagacattataattccaacgttttcttacacttggacagtgaacatatcatattatttattatacgtatctctcccgcttgagaaacctatgtgatgagttctgcatcgctaaggattctcctgtggcctatggtctcccagaagtgctacattgatagacgtgcaatgtgttgtgaggaattagttagagaaacctattaccgccaagcggggggtgatgaaaacgagggatgtacttgcctattacccgctccaacgtctacgagcgactataagctgccagcgatcttgccttcatatgcgcgccatagctcaatttaataggagaagcaggtgtcgtttgtatgtctacttgtacctcacctgcgcgtgaatgttccctcccatagcacacgatacgtcttacttatgtagttagtgcacctgttccctcagattgagtcacctccagaagaataatcaatgaggtggtaaactgctgggtgaattacggtctttgcaaacctcttttataactcgtgatgatgcaatcgaagacatccaagcataacagccagtgccattgaacatgttatcattccc

SEQ ID NO: 16410 - DNA, 51 bp, Diabrotica virgifera
  misc_feature (2)..(48): n is a, c, g, or t
gnnnnnnnnnnnnnnnnnnnnnnnnnnnnnnnnnnnnnnnnnnnnnnngtg

SEQ ID NO: 16411 - DNA, 404 bp, Diabrotica virgifera
taacaaggaattgatgaaagtagtatgttatggtttctgatgtattattatatatatttgttctgtttatttattaccgtagcttgtatctatgaaggagtactttgaattttgaagtgatgagtaataaagctcagagagcaaggaatgttagtataaccaatatcgatgatctctttactttgttctgttattgatgtggtgtgacgcaagtgttattctcgtagagcatgaacttattcaatttatatgccatttcgggaggatttagtatatgggatataaaatatatactaaaaaagtgtgatatggtaggttacagtggtggcggcagtgcgggaaaccacgagtacatatattctatatcatgctataccatttttcttgggtttgttgagttgttg

SEQ ID NO: 16412 - DNA, 252 bp, Diabrotica virgifera
  misc_feature (5)..(144): n is a, c, g, or t
  misc_feature (146)..(161): n is a, c, g, or t
  misc_feature (179)..(198): n is a, c, g, or t
  misc_feature (200)..(213): n is a, c, g, or t
atgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnngttaggaataagaacgannnnnnnnnnnnnnnnnnnngnnnnnnnnnnnnnngaggcgtatcgtgagggtccagacaagtcgaccgacccg

SEQ ID NO: 16413 - DNA, 545 bp, Diabrotica virgifera
  misc_feature (80)..(114): n is a, c, g, or t
  misc_feature (462)..(487): n is a, c, g, or t
aagatgcaggtatgcatcttgggagatcagcaacattgtgacgaagctaacgccaacaatgttccattcatggatgtagnnnnnnnnnnnnnnnnnnnnnnnnnnnnnnnnnnngttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactctgcctttctgttgctgttggtcatgtaggcatgaatcaagatgaattggttcaaaatgtccatctttcaatcaacttcttggtctcactgttgaagaaacattggcagaacgttaggtctctccacgtcaaatcatctatgggacccccacaaagnnnnnnnnnnnnnnnnnnnnnnnnnntgagacttttatttacacacttaaatgtgggtatctaaataaacatcgtttttaagtc

SEQ ID NO: 16414 - DNA, 852 bp, Diabrotica virgifera
  misc_feature (134)..(155): n is a, c, g, or t
  misc_feature (481)..(500): n is a, c, g, or t
  misc_feature (703)..(721): n is a, c, g, or t
  misc_feature (723)..(743): n is a, c, g, or t
atcctgatagtatctagtgtcatacaaggacccgattgtataatataataatcagtgcaataacgtaactaatctaactgatatcaatttcctaagcaaaataaacgtatctcaattttttctgttaaatatannnnnnnnnnnnnnnnnnnnnnagtactattttaacatcttctcagtaagtttatatccaaagatactagaaaaaataacaaaaaataacgtgtcctgagagcaactaactaaaatgttaaatatctcagattaaccaattcttgagttacgccattttggcttaggagggcagtattagtccaagtaatgaagcttaaaataggacaaaacctcgcaatttttacagaatagatcgatttgcttgaaaatttgagaataagtatagtagatagtccaaggatcaaaatctatatgaggccgaaaggtgctttaccaggggtggttgccaccccatctcgggggaggnnnnnnnnnnnnnnnnnnnnaccgcaaaagttggtaaaaacattcattctaagcaaaaaacgttccatacatttttttgataaaattaatagttttcgatttattcgctatcgaaagtgttagttttaaaaggaaaaagtctcaatgtttttaatcagttttctgctaataactcaaaaagttttcgttctatcaaaacaactttgcttaacaaaatgtaccnnnnnnnnnnnnnnnnnnntnnnnnnnnnnnnnnnnnnnnnctttaagaccaatagtaatcgagctatactttatttatatgttagctcttctttcgtcaatgctaaatattgcagtttcgaactcaaaaaacgggaaaactgtgcattt

SEQ ID NO: 16415 - DNA, 716 bp, Diabrotica virgifera
  misc_feature (14)..(41): n is a, c, g, or t
  misc_feature (47)..(126): n is a, c, g, or t
  misc_feature (137)..(187): n is a, c, g, or t
  misc_feature (189)..(586): n is a, c, g, or t
  misc_feature (596)..(609): n is a, c, g, or t
  misc_feature (612)..(635): n is a, c, g, or t
cctcctagggccgnnnnnnnnnnnnnnnnnnnnnnnnnnnnccatgnnnnnnnnnnnnnnnnnnnnnnnnnnnnnnnnnnnnnnnnnnnnnnnnnnnnnnnnnnnnnnnnnnnnnnnnnnnnnnnncttgtgtatgnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaattcgnnnnnnnnnnnnnnaannnnnnnnnnnnnnnnnnnnnnnncggattaaatatacagctctcgccctgccactgatgaaatttgaatgaccgtcgcactttctacggggcaatccaccccca

SEQ ID NO: 16416 - DNA, 673 bp, Diabrotica virgifera
  misc_feature (481)..(502): n is a, c, g, or t
attgataccagaatgaagctactatatttgccacttactgagtattatccgactcttactgtcaacgaaatgtgattcaacagatgatctcaccacaccagcttatttcaatgatgccaatttaaacacgagtgaagatgtgatccagacctactaagtattaaaccgcggaatgaaaaggacctaccgagagagctcccattttaacttataccccactaaaatcctcataaccggtatcggcaaaaacgcacaaagatcttgaagactatattgaagaaatgcttacttaaattaccaagaacctctcaaagattgaatagttgtataattgaaaaacacaatattaaccttaacgacttagcatgctacaaaaacagacccacttgctgaacttactacaacggaagttatagataatgatttggatccataacagtagcgacttaacgctgtttattggatatttattttctgcgcnnnnnnnnnnnnnnnnnnnnnnattattagtcctctacatagattgaaaataattgtacttgacgtatatggtcctatgttggtattgttgtctgtgtcagaagaattgatattacacaatcctgatgcttttttcatagatactgatcatacgaacgatcaaaagattgaatatgaatgtgctattgcacac

SEQ ID NO: 16417 - DNA, 692 bp, Diabrotica virgifera
  misc_feature (504)..(522): n is a, c, g, or t
  misc_feature (655)..(667): n is a, c, g, or t
  misc_feature (670)..(689): n is a, c, g, or t
aaaaaaattatctttaggtagaacagctcatgttccaaattatagtttcaaattgatcccgaacgtctggtatcgtttaaataagcgctcatcgtttccactggtgaaaaaaggataattttgaaacatttttggatcatttaaaattattttgaacaacagaaaacacattaattttaaaaatctagaattattatttattagagtaacaaattaggtagatctgattatgagagttaatagttgttcaattattaagggaataggcgcaaaatttcccgccaatgtgttttaaatgcattaatttttttcgaatcctgagaaaactaaagtttttatacacttcacttgtactttgtcactttgtcttttaatccattttaaaccaacttcccgccagactacctacctagaaattttcagaatagctcagaattcgataacaatgccatattcaacagttttttttatgaataaattgagttttattttgagttttaagcnnnnnnnnnnnnnnnnnnngcaataaaatttagatcccgttgtaaagtatgtaaatcaatgtttgtttacaaaattcttttatgacatagaaattgaaataaaagatgttttataatggtaagtaaacatggtaagcgttataaacagtccnnnnnnnnnnnnntgnnnnnnnnnnnnnnnnnnnncgc

SEQ ID NO: 16418 - DNA, 154 bp, Diabrotica virgifera
cttatcacctttccattaacccaccgccccaccccccccccacgtattaatgctgattctttctatttttcttttgtatatttagtcagaatttcacccttcaccccccccccctccaccctgctttctctccgtctcccactctctaccctct

SEQ ID NO: 16419 - DNA, 323 bp, Diabrotica virgifera
  misc_feature (2)..(170): n is a, c, g, or t
  misc_feature (177)..(214): n is a, c, g, or t
  misc_feature (249)..(271): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaagttataattggnnnnnnnnnnnnnnnnnnnnnnntgttcgacttttaaaattttacctgatctgagtttaaaccggtgtgagccag

SEQ ID NO: 16420 - DNA, 1195 bp, Diabrotica virgifera
  misc_feature (173)..(191): n is a, c, g, or t
  misc_feature (206)..(226): n is a, c, g, or t
  misc_feature (425)..(568): n is a, c, g, or t
  misc_feature (581)..(624): n is a, c, g, or t
  misc_feature (658)..(680): n is a, c, g, or t
  misc_feature (731)..(750): n is a, c, g, or t
  misc_feature (825)..(846): n is a, c, g, or t
  misc_feature (890)..(927): n is a, c, g, or t
  misc_feature (1011)..(1062): n is a, c, g, or t
  misc_feature (1069)..(1090): n is a, c, g, or t
  misc_feature (1120)..(1141): n is a, c, g, or t
ctcttcgcgtccgaaaaatattatgcacctatacattgcatactgtttaaaattgtttatatcttgagtatattgtttatttccgtagtccaatgactttgattttataggttttaaattaatatataggatctcacttatattgtaaaatgtaagggttttatctgggattnnnnnnnnnnnnnnnnnnnaaagtctttattttnnnnnnnnnnnnnnnnnnnnnaacttatggtctcaggaattatttattactctctgtttggtttttgtctatcttgatgccgacttcaaaagaccataagtttggatcatcctgtagatagtagtttaagacaaaagtattattaactaatcttcctttttgtttattgtatagcagactgttacataatgtatatgactctatagttaatataaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaaggaacnnnnnnnnnnnnnnnnnnnnnnnnnnnnnnnnnnnnnnnnnnnngggccccaaaattaaaatccggggccgggttttnnnnnnnnnnnnnnnnnnnnnnncggggggttcccaaatttaatgcctttggaaacacccccccttttcccagnnnnnnnnnnnnnnnnnnnnccccccccatccccccctttcccaaaattttcccctctaaaggggaaatgggaccgcccccttaggggccatttnnnnnnnnnnnnnnnnnnnnnnagcgggaggggggggcctttaatttttggagggcccaaaggcgnnnnnnnnnnnnnnnnnnnnnnnnnnnnnnnnnnnnnnacgggttgggggggtttttccccccaaaaggttaaaaaagggggggccctcccttttggggtccccgtattttggggtttttcnnnnnnnnnnnnnnnnnnnnnnnnnnnnnnnnnnnnnnnnnnnnnnnnnnnncccggannnnnnnnnnnnnnnnnnnnnngctgaaaaaagagggtgtttttttcccccnnnnnnnnnnnnnnnnnnnnnnccgcccccctctttttttaataaagagaggggggctcctcttttttctttcccc

SEQ ID NO: 16421 - DNA, 593 bp, Diabrotica virgifera
  misc_feature (18)..(20): n is a, c, g, or t
  misc_feature (26)..(26): n is a, c, g, or t
  misc_feature (31)..(31): n is a, c, g, or t
  misc_feature (33)..(36): n is a, c, g, or t
  misc_feature (52)..(52): n is a, c, g, or t
  misc_feature (66)..(66): n is a, c, g, or t
  misc_feature (69)..(70): n is a, c, g, or t
cgccccctcaagggcccnnntttttnttttntnnnntttttttttcccctanaggggccccccaanaannaaaaaaaaccacacaccatgaaccgacaaacaagggagaacaaagagaatagttttgaaaggaagcaccgggagagccaagaaacaggagagagacgaaaaggaagagcagagacgagcgagaagaggagaacagagggaggagacggaggaggagaaaaagcgaaaaacattattatatagagaagtgtcgtccgaaataatagaagatttgtccactatataggacaaaaaagggatatatgaaaaaaccatacattagtaagatctattgtaaaactacaataaaacatatgcagggaagggacatgaatcgaaactaaattaactaaaagagtagagagatatattaagcacgccttcgtccagagcagcaactgaaagaaatttcagtacatatggatttttatccactcctctaaaaaaagcgtctcattgtcaaacgggctcgtaaggtaactgttattggtcacaatttaaaaatgaaagacgtaaaccagtccatgaatgtagctggccacctt

SEQ ID NO: 16422 - DNA, 715 bp, Diabrotica virgifera
  misc_feature (2)..(163): n is a, c, g, or t
  misc_feature (308)..(326): n is a, c, g, or t
  misc_feature (421)..(438): n is a, c, g, or t
  misc_feature (488)..(502): n is a, c, g, or t
  misc_feature (504)..(533): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacaactcggactacacacctttcctattctacaatatgttactatttatttttatacactatcattcccacacccagacaaaccaaaaacccccccacccccccaaatactataaacttcgtaatgacgctacctccactagnnnnnnnnnnnnnnnnnnnaccccccaaaaccctcccctcacccccccccccattcctctctccccaccgccgcacccacccctttccccccctccccccctagcacccattcnnnnnnnnnnnnnnnnnntcccgcgctctccccccccttatcaaactttttctccactatcccccctnnnnnnnnnnnnnnnannnnnnnnnnnnnnnnnnnnnnnnnnnnnngccacccccccccaacctacctcatccctcctctactcctaccctactacaataccgtcatcttctccaatctcccacctctcccacgcctcccacacccacattcccccattattgccccccccgatctgcacccccttcctccccagccacgaccacctcccaccccacccccccccccc

SEQ ID NO: 16423 - DNA, 54 bp, Diabrotica virgifera
caattctttacacaaactatatgacatgtttacatattgtttttattgaatttg

SEQ ID NO: 16424 - DNA, 951 bp, Diabrotica virgifera
  misc_feature (32)..(909): n is a, c, g, or t
  misc_feature (912)..(950): n is a, c, g, or t
ggtccggcgaattcccgcggtcccaccctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnnnnnnnnnnnnnnnnnng

SEQ ID NO: 16425 - DNA, 941 bp, Diabrotica virgifera
  misc_feature (821)..(821): n is a, c, g, or t
  misc_feature (834)..(834): n is a, c, g, or t
  misc_feature (836)..(837): n is a, c, g, or t
  misc_feature (887)..(887): n is a, c, g, or t
gatgttgctataaataaattacaatacagtgtttgaacataaaaaaatgttttcgattaactttacttctagacacttgaccgtataagagaaaatatcgaattttaaaacgttcgttcgtatataaatcgtgtatactcggccttttttttagataatttcgataatccgtataatttgataatccggatcggggtccggtcccaattaatccggattattcgacgttctactcgtaaccttaccaacgttaacagagtttgaagctatttgtgcgccttactttcagagacgaaaagagatagagtttttcacttaatgaacgcttatcaaagatcgtttatgaaatttctttataatatcttttattcattctaggaggaaactttattagtgagaatcaactacgcataaaattgtaaatacttttattgtttggctagtatcgccgccttatatcataccttagttttcgtacattgagaggtgcagccattttatttagccttgcatcttctacgtatctcagccaaatatagaaacatagtaaccacacctcttatcttttaagaaattcttattttcgtctcaaacatttaaagcggccatttcttacacatctgacgcttttacttgagtaaagagatgattcttcacccttgagtattagacttttattgttgtagtaaccaaaacaatagtctaaacgttcagagaattattatacattgtcgttcaaacacaaattggcggtaacattcaaaaatttcgttattccaaatttccttaagcaggggtattgtataatatgatcttttagntatcattgtcagntnngtgtaatgatacatgatattttgtatatagaacggtttcttttacagcangaaagaaagtatatattcattagacgtataacgagatgattggactgtagtaaa

SEQ ID NO: 16426 - DNA, 818 bp, Diabrotica virgifera
  misc_feature (627)..(627): n is a, c, g, or t
  misc_feature (747)..(747): n is a, c, g, or t
  misc_feature (754)..(755): n is a, c, g, or t
  misc_feature (776)..(776): n is a, c, g, or t
cggaaacgagaagcgaccaacatacactcgagaaaaacaaattcaacttcaaccccacgctaccaccgaaccagttcaattttcaaccgaaaccgcgtcctcaaaaaccagccaccgaaagttcttcagatgtttacaacgaaaatccatttttcactaatggcaatatttataatactggaaataatgggcaaacaccgaatacgggcagtattgttcacacaactagaccaactccaccaccctttaggccaactccagcacccttaaggccgacgcaaaccattcctgccatagccacacacacggaaccacctcggccttcagaacagtcaatagacttcccagaagacatcgaactggcatcgaaagatagcgtacaacctgtcaggccaatggacgatgtgtgtggacaatctttgacgaccaatcatttgattttcaatggaaagcttgtaccaaggggggcttatccgtggttggtggccgtttttcaggtgaaaactactggtgtcaactatatttgtagtggatcgcttatttcaaccaaacatattgttactggtgctcattgtgtggagatcgaccacagaaaacttcgacctcaagaggtactactgatcctgngaaaactgaatatccacaaatggataccagtacgaggagaaaagatagtggaaccggagtccatacacattcatccggattacgaaagcttaaccagtgacgcagacatagctgtttaanttcttgnnagatcactaaaatttactaantatatacgacctgtgtgtctttggatgggagatacggattta

SEQ ID NO: 16427 - DNA, 552 bp, Diabrotica virgifera
  misc_feature (369)..(383): n is a, c, g, or t
cccttttaaagaatgttgtatttattttagattaatgatcaacgaagccgacgagcatcagggaaagctaccatgtttttagcaacaataatgagagagtctacaagcaaaccaagcatacccaaaaattttcaggactgccgccactccatctcatagaacggcaacacactacagactactggagccaataaaaatttcgaatattccaccaagaattacttagaatagatatgtaaaaaagtagagggctgccgaccgcagcaaaacatggtctatacaatggaatgatatcaattaaccttcggggcaacaccccagtagctaataatcccctaccacagcgctgaaagagaattttgctagctnnnnnnnnnnnnnnnaccattggtgagcgcaagacggcgtgctatagcatgtaatagcaatagccgatggaccagcacgaccggacgagactctagatttgacgtagtctctatcaagtaccactgtgggacaacttgtgtactatcagcaccactccaccacaattgagaacgatggtaaaaa

SEQ ID NO: 16428 - DNA, 800 bp, Diabrotica virgifera
cgtggcgttacaacccttcgtgggttttacctgactcgaaacatgcctcaattcttctttgtcttgagcaatctagttctccacgccaatagctaggtctccacgcccatagtcttcttccagttgggacttctacccataccagttttaccgttcgttcttcagctatactcgctttggaaatgaatgatagtacagtttttatagcagaataccacaacagtctgtaaaaagggactattcgacgcaaaaatagaaatataaccatccctacaaacttacaatacagtgcaaagtatcataagaaattgctatcaatcattttcaaatgacgtacacgcatcttaaagaatatcttcttagcagtttttctatcgttggctttaatattaaattccctaacaactaaaagttcgttcaaacgaaaattcattaattcattcaaaacgttcacatccttgcttattggattaaagaacgagatgaacgatacattaaagtctgtcattaataataaaattgtcctaacatttagtcgtttgggtaaattgtgctattttgccagatttttctgttgcccaatccatcataacctcacataacctgtaaaatctgcattctttattgcaaagctgttgctatgctactgtcttttgttattttgttcttcttttttctgctatctctttttgtgtattcaactcattcttaaaattgtctaactcatttcaattctatttatttgggtttatccgtcatcttgtaacaacgttttatcttaaattttatcacaatgagaa

SEQ ID NO: 16429 - DNA, 821 bp, Diabrotica virgifera
  misc_feature (6)..(43): n is a, c, g, or t
  misc_feature (45)..(750): n is a, c, g, or t
  misc_feature (759)..(820): n is a, c, g, or t
cctctnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaagggnnnnnnnnnnnnnnnnnnnnnnnnnnnnnnnnnnnnnnnnnnnnnnnnnnnnnnnnnnnnnnc

SEQ ID NO: 16430 - DNA, 602 bp, Diabrotica virgifera
agacattattaagatttatccctcttaaggtataacttataatatctaattttactactatttaattgttacaacaaacctctccccaaaaaatctagtcttttataataacatataatttctctctcaatcctactcattcttcttcaccaaaaaacctgaaactaaaacatcgcaccaacaaagcacaatctaagaacctacagaaactatatccctccctaccatgtaactccactaacctcctggccccctaaaacggcactgcgcttcctccttcccctccccggtccctaactatccattattttccaattttagcctcacacctctccccccccacacatttcacacttctacttccccctccccctttttatatcttctccttccttctccccctcatctcccccactacaaacacactgatagcaccccccccaccccccctccccacaccatcaacaaactcccacccttcttcccctacttctctcttttctattcctcctagtctcccctctcactccccctcaccacttctcccatctcttcctcctcacaccttctcctatccccccctcccatcccctctccccatt

SEQ ID NO: 16431 - DNA, 164 bp, Diabrotica virgifera
  misc_feature (2)..(25): n is a, c, g, or t
  misc_feature (36)..(89): n is a, c, g, or t
  misc_feature (98)..(135): n is a, c, g, or t
  misc_feature (137)..(152): n is a, c, g, or t
cnnnnnnnnnnnnnnnnnnnnnnnnaaatgaaggtnnnnnnnnnnnnnnnnnnnnnnnnnnnnnnnnnnnnnnnnnnnnnnnnnnnnnngtaaaaagnnnnnnnnnnnnnnnnnnnnnnnnnnnnnnnnnnnnnngnnnnnnnnnnnnnnnnctacgtttttta

SEQ ID NO: 16432 - DNA, 907 bp, Diabrotica virgifera
  misc_feature (633)..(651): n is a, c, g, or t
gatgtttcaacaattattaggatttatggcagtgctgaactatatgcaatctattttcgaagctgccaagactagcattaattccaatacagcctcgttaatattaggaggtgttcagattatttccaacatattttccactcttttagtagatagattaggaagaaaagtacttttactagcttccaatgttggttgtactatatcactagcagctttaggagcatttttcttttgtctagagaacaattataatacagactccatattctggctacctattcttagtcttattgtatttttcgtatcattcaactttggatttggtacattacctttgacagtgtgtggagaactgttttccagtaacatcaaagcaatggctgccagtttgtcaacatgtgtttgcctgttactggcttttctagttactttaggttttccatatttatctgatgcagttggtaggccgtacaccttttggattttcgggataacttcagttctttctattttgtttgtagtatttatagtgcctgaaacaaaaggcaaaagttttaaagaaatacagcatgtactagaaggaaggcgttgaaggtgatgtgaaatgacataagactagagatatgatcnnnnnnnnnnnnnnnnnnnatttaaaaccattttcgaaaacattgtgtgggttttctactcttatctgcaatattttatcgccattatttgaatggaaaatttagctaagattgtagataatacgtttttgacagtattgtattaatgtaatcatttggaattcttctacaaagtgcctaaatcagatcattagcattttataaacattataataatcgaaattccccagattattttagaatttaaaaactatttatacttttccagcaaaaat

SEQ ID NO: 16433 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16434 - DNA, 625 bp, Diabrotica virgifera
  misc_feature (232)..(254): n is a, c, g, or t
  misc_feature (585)..(603): n is a, c, g, or t
cattcattgatcgtagttgtagatgcgaggtagaatattttctttatatatattcttgatgtttctttcggcgcttgcacaccgggtgcacatgactgaataagcatatatttattatgttcgaatgagaggactcaatcagagtaagacttttatgggggaataatgatttaaaaaacctctattagagaggaaacggtattccttgttgactatagctaagtttttgcgnnnnnnnnnnnnnnnnnnnnnnngcaagatatttataattaagtactcttatattattaatatgaaatatttatcgcgtgcgagcttaaagtgagaatttttttaagatttagtttttaaataaagatgagcgctagacaattttcatattttacaatatggtataatcttatgttcatatattattatacctgactggtccaccataatgtttatcaatagataacagtcaggatcattccaggttgcagaacgtgatgagtgatattactaatcaataatactggatagcctacgaaaaatatatagttttaatgacggaagtcggaacattttttttccctgcttattatnnnnnnnnnnnnnnnnnnncatgaccaggtctcgcctgccc

SEQ ID NO: 16435 - DNA, 640 bp, Diabrotica virgifera
  misc_feature (182)..(199): n is a, c, g, or t
gcctcaaggaataaaggtgacatgatgctaacttgtgcttttaccgttatggtggatgccaccccttctcgggggtgaattttttttaataataccataaatcgatagagacaaattctatgcaaagtttgttatatacagttattaatataaatcaatactttttgagttattaaatatcnnnnnnnnnnnnnnnnnntaataaaatgcatgttttaaagctgtttttcacgtataactcaagaactataagcttttacaaacaagttattattaccaaaattgaatataattaaaagctgaatacagtccttacttaaagaactaaactaatgttaattcaaagtgagttgtgggtgattgaatgtatattttttcgacgagtgctcaggtctaggcgtttaagcttaaatggggggaaaacgatgacttttatagaatatacctgctaagcacttctcaaagtacttcggagtacctatcagatgagctgcagtagaagttgatagcatcacaattatattaagcaagttatgatgaaaataagagaagcctttagaactttttagaaaaagtgaaaaataaaacatacgccatttccacaaaaatttatagtaatccttagaagaatttctttata

SEQ ID NO: 16436 - DNA, 332 bp, Diabrotica virgifera
  misc_feature (6)..(28): n is a, c, g, or t
  misc_feature (219)..(292): n is a, c, g, or t
  misc_feature (297)..(331): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnc

SEQ ID NO: 16437 - DNA, 863 bp, Diabrotica virgifera
  misc_feature (11)..(25): n is a, c, g, or t
  misc_feature (28)..(40): n is a, c, g, or t
ctaaggtttannnnnnnnnnnnnnncannnnnnnnnnnnncaaacattgttaacagtgcaagtccttcgaacgatacttattaggttccaataaacatgacatcggttcaggaaaggcttcaattgaaacgagaaccactagataaatggtccgtaagagaacaactttgtttggcttctgcagtgagcagaagtggagaccagaattggatgtctgtttctagggctttaaaaccttttggtgaaccaaatcgaccgtctgactggtttcatttaaaaaattgtgcggcacagtatggaatgctattgggtaatgtcgagactccgaagagaaaaaataagaaagccagtgttgacactggtggtgaaacgccgccagaaagtattttaaagagactaagtatcgagaggcaagcagaattgaagaaacttcttgcagaagaaaaggcagaatatcaaaaattacaagaggatatggttcttcttcaatcagggaaggtatcagaggaacaattagataagtggtgtcaggaaatagaagatgaagagaaccaaaaagaacaagaatccctcacacactccagatggttgaaagagagggagctacgtaaacaggaaattgaaaaagtctggagaccttcaaaaacaataatgggacagaaacgtaaaagctcagaccggctagataatctgatagaacaagaacatatggatgagcttatgcttcaacagcaaccacagctcaatcaacaacaacaacatcatcagatatattcacagccttcagagacaatgaaaccctgcctttctcctttactgacaagtttattaaaatctccttcacaagttcccaagacctccta

SEQ ID NO: 16438 - DNA, 620 bp, Diabrotica virgifera
  misc_feature (529)..(561): n is a, c, g, or t
acaagatttgacaaagttacatgctgtacagttggccagtatcagtttcccattttcgactcattttcttcaaccttttctattttattctacaggcttcctatctttacattgtacaaatgagattgaaagtggaacacaaaatttctgataacttgtagatgagacaagatggatccttatcatatttcttctcaactgaataacggaaacgactgttacaacagggaggacaaccaacaggagttcactgtcatatcgggaactgaactctttgacaaaattttccactgagtgggctccagatgaggcagtgcgttagatttcagcagcctcttgaatcggctatctaatacctgcgcgatcaggccgtgattaagagtagtatacctgctatgaatattacagaaagtgagagggtctgatagaaacagacaacgtggatatgactcgtagcctaagaaatatatggtgtcgccatgcgaaagacagaggtgatttttggtagaacaaatttttataaagtttnnnnnnnnnnnnnnnnnnnnnnnnnnnnnnnnnaactgtaaatctaaagaataaaagtatttgaaagtgagtattcaactatggcaggattc

SEQ ID NO: 16439 - DNA, 96 bp, Diabrotica virgifera
  misc_feature (2)..(21): n is a, c, g, or t
  misc_feature (23)..(51): n is a, c, g, or t
gnnnnnnnnnnnnnnnnnnnngnnnnnnnnnnnnnnnnnnnnnnnnnnnnntaacatgtttttcacctgttgattaaaagcatgtctttttggatt

SEQ ID NO: 16440 - DNA, 69 bp, Diabrotica virgifera
  misc_feature (2)..(63): n is a, c, g, or t
cnnnnnnnnnnnnnnnnnnnnnnnnnnnnnnnnnnnnnnnnnnnnnnnnnnnnnnnnnnnnnntacctc

SEQ ID NO: 16441 - DNA, 774 bp, Diabrotica virgifera
  misc_feature (7)..(112): n is a, c, g, or t
  misc_feature (114)..(681): n is a, c, g, or t
  misc_feature (694)..(694): n is a, c, g, or t
  misc_feature (698)..(698): n is a, c, g, or t
  misc_feature (704)..(762): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcttanattnttttannnnnnnnnnnnnnnnnnnnnnnnnnnnnnnnnnnnnnnnnnnnnnnnnnnnnnnnnnnatttattatata

SEQ ID NO: 16442 - DNA, 198 bp, Diabrotica virgifera
aacgatcttaaacacggtgctcttgctgcggtatacactaaagatgtcttcatcgttataaactcatgataaacaggctagactgaacaagcatacatcagagatgaccgggtgacgaactaatgtgatattaagctcatgaactcttaccccaagttgtagataacagataatgaaaagcgagatatttataataat

SEQ ID NO: 16443 - DNA, 916 bp, Diabrotica virgifera
  misc_feature (142)..(165): n is a, c, g, or t
agtttttattgggattcgaaccagctatcagcgcggttggtatattggggttcattcgccttaaacgcttcgccacggaggcagtgtgtcattatgtgcgaagatcgactaactaaacggattaagcttttgacatttttgnnnnnnnnnnnnnnnnnnnnnnnngaattgaaatgatttagaattgaaaaaatacaacaaaacatagagtaagaaaacaatatattacgtgaacattgatagaaattttgatggtaatcaaattatgtaaataaaagtattacatactatgtattttggtaggttcaaataggtaggtacctatgatacatttacaattattacgtacctgttgcttttaaaaactatttaaatgtcactacaattataaacttttttgtttctgtcctcacaacaatataactaatatattatacatttgtttaccttcatattgaacaattatttattattgacagatcatttcaacacccaatcagagcccgtaataacgactaataccatactgtcggtgagcgcatgcgcgcagatcaatataaattcaccctcaatctcaatcgcgcctaaagaagtataacttcaaaaataaaagtttgtattggggattgaacccacgtacattgtgttcaaattccagcacctttagatatcggctacggggacatatgcattttactggaagatagagcaactgaacaacttgacagttccgaatttaacgacattaatttgatgtctacggaatttaaatattacaacccaacaaaacagagcaagaaaacaatattagatgaatatttttagaatctttgttgggtaggtaggtttattttacattttccaaataggttatgtaaattttttattgcgatactgaaacatttacaattattat

SEQ ID NO: 16444 - DNA, 953 bp, Diabrotica virgifera
  misc_feature (902)..(902): n is a, c, g, or t
  misc_feature (927)..(928): n is a, c, g, or t
cttctatattggtgcaagcacttgatagattttacaaaagaatagagagtaatactctctgcaaagatattgattttgccaatgttgcagctgaaattgttatcaatgctgccagaaaacaatgtaaatcccacttacagattctaaaaatgcattttgctgattccttaaccaaaattaggcaagcattaactactccaaaactaattactcaggaagaatcttcaaaaaatttaaacgaattattaaattcattggtcattactattgtggaaaaagtaaaaggagtgttacaagacttagtaattttcttacaacctaatattaattttgcttataaaccacaattcaaagatagtttttgcatagataatgttagggagggtttaatagtctgtttccttcaccatttaactgctacagcaagaagtttttgcactaaagttgcatctgacccaaaaattccaccaactctcttacttttgttatctaaattctgtgtagattttcaaaatggccatgtccattttatattatcccagacagatgaattgttcaatataaatgctcaagaaaatcttgccgtctccaatgaaatagaaattacaaacgcaatgcaagaatctgcacaagaattgctaaatttttttgttagaattcaaggtcttaactgctcacaaatgttaagaaagagtgtagaaacaagagattggcttaacactatagagccaagaactgttagagctgttatgaaaagagtagtagaagatatttcagctatagactcaactgtaacacaattatatgatgatcatggaaacaatggtactgaacatagtagtgattctagtcgtaaagcacatagtatttctctacccaagcaccagtacagatctaattgntctaactatacatctaatcctttgnnatctgcactagtttctaatatgcac

SEQ ID NO: 16445 - DNA, 301 bp, Diabrotica virgifera
  misc_feature (17)..(34): n is a, c, g, or t
  misc_feature (42)..(62): n is a, c, g, or t
  misc_feature (92)..(159): n is a, c, g, or t
  misc_feature (161)..(173): n is a, c, g, or t
  misc_feature (252)..(264): n is a, c, g, or t
  misc_feature (266)..(283): n is a, c, g, or t
atttttatctgggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatgattatattttaactttcttctttatgannnnnnnnnnnnnannnnnnnnnnnnnnnnnncattcatgtttgattcat

SEQ ID NO: 16446 - DNA, 242 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (201)..(229): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggannnnnnnnnnnnnnnnnnnnnnnnnnnnngataataataggt

SEQ ID NO: 16447 - DNA, 804 bp, Diabrotica virgifera
  misc_feature (2)..(17): n is a, c, g, or t
  misc_feature (19)..(61): n is a, c, g, or t
  misc_feature (69)..(181): n is a, c, g, or t
  misc_feature (191)..(368): n is a, c, g, or t
  misc_feature (370)..(798): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatt

SEQ ID NO: 16448 - DNA, 873 bp, Diabrotica virgifera
  misc_feature (11)..(11): n is a, c, g, or t
  misc_feature (110)..(127): n is a, c, g, or t
  misc_feature (163)..(190): n is a, c, g, or t
  misc_feature (347)..(372): n is a, c, g, or t
  misc_feature (534)..(551): n is a, c, g, or t
  misc_feature (831)..(831): n is a, c, g, or t
ctgcaaacaantcgggatatcaaattggacaactgcggccatggacaggagaaaatggagaaaaaccgtggagaaattccaagccatgggcctttaaggcctgttgagcnnnnnnnnnnnnnnnnnngtgtatatgtgtatatatatgtgtgtatatatgtgnnnnnnnnnnnnnnnnnnnnnnnnnnnnatttacacgcgcgaaagtggactgatacagtgccgtagctgaattttcactcgaagcgacgaccgccgcgcgacgtacagtagtatttgtatgctgcgtgtcaatcgcttcgagtgaacattttagctccggctctgtatcaagcctactttcgcgnnnnnnnnnnnnnnnnnnnnnnnnnnctttgattaaagtgtgaccattgaactagtgtttgatattttttgagagtaattagtttgtaccatgaactaacttttgagctttgaaacaattaaaacaagttgtaaacagcgaagtagtcgtatgtctgctttgctgtttcatggctttttgcaaatggnnnnnnnnnnnnnnnnnngcatttgttttcaagacctttgaaatgcgcattttgagtatttttttgaaattataatgtaatcaacaaattctgagaaatgttgatttgtttgtaactgttttttttaaacatttaaagattgtgcaggagaatggaagatttatgttttgtcgacaaaatattgaatgcgcatcacatctttatattctttctaagtttgatcagtgtcccttgattgttttggttgttgttgcgactgtgaattcgttgttaacggttgaattgtttgctgaatatntcgtaattttcaccggcttctgcagttgtgatctgtaccaag

SEQ ID NO: 16449 - DNA, 271 bp, Diabrotica virgifera
  misc_feature (89)..(106): n is a, c, g, or t
atatatgccagaatatatatcacacaagtgacgtcatccatctgagcgtgatgacgtaatcaatgattgaaaggttattaaattttccnnnnnnnnnnnnnnnnnntctggcatatatatcacacaagtgacgtcatccatctgagcgtgatgacgtaatcaatgattgaaaggttattaaattctccatttagtgatataaacattaataccgttatccacacagggtgtccaaaacaacttttttatattaaactaattgacataaaaa

SEQ ID NO: 16450 - DNA, 835 bp, Diabrotica virgifera
ggaaggtttagtaagtcaaaactgatatgtatgctgtatcttcctacctgtaagatacaaccacaaaagcatttctaggacgaggatctttgacagatgataactgtgaactgtagatgccatgagaagataatgactatatttatgctatttttcagagaatgcaaaaatttctccctatgtatccacaactcaattcttcgagtattctagttgctcagatcctacaatcgtccctattattatgaccgtagaaagcgctatagataaaaataattttgaatacagagcgagcgatgaagatataaaaagataatagaacaatactatcatagtcctagacactagcatatagttattgcttttaacaatcaacatcaaacaagatataagtgtgaagttctaacaaagattatcgtgtttaatatatagatagattataatatgtgatgatactttagataaatttaaacaggatccgaatgtataaggtaaaaagagcaaaggaaacattcactaactcatattttgctacttgtatcattttgcaatgtaacttctggctatcttaaatgtattcataaaaaggataaaaaacatttacctgtttattgttgtattaagtaaatcattgactataatattgcgataaatgttagatattttacttcatggggttatacttttgatgtaaaagtttcacatatttagctttaagcaaacgtgaattgctaatgatataataaattatgtaagaacaaaattaagtaatgaatataccacataattcttcaactaatgaggtactacagaaaattcttcttactatttcttc

SEQ ID NO: 16451 - DNA, 866 bp, Diabrotica virgifera
  misc_feature (201)..(220): n is a, c, g, or t
  misc_feature (441)..(462): n is a, c, g, or t
  misc_feature (465)..(478): n is a, c, g, or t
  misc_feature (779)..(779): n is a, c, g, or t
  misc_feature (858)..(858): n is a, c, g, or t
gcttattaacatttttaaagtatctaatgcctggttgcaccaacagatcttaagttccagattagctaacctctacttataaatagggcgtccttgagtatcacttacgttgcaccataattttagattcttaccttattatcaattatatacctcgacttaagcttaagatctgttggtgcaaccgggcataaatcatcnnnnnnnnnnnnnnnnnnnncaaaggtttctagcatcggaaatgaacgagttgcactgaaaaggaagtttgcctctttttttggtaaaaaaagtcgtaaaggcatcgctctgtttggcaccttcaatgaagttaatcgttaccgccttactatttattttaactgtatgtgtattgtttatgtgatctgtaagtttgatatttttgaagtgcttcgttttgaaaaaaattggttttatagnnnnnnnnnnnnnnnnnnnnnnccnnnnnnnnnnnnnncttaaaaagtattagtgataaaaaatcttacagagcaaaaaaagtaggtcttgctattataaatatgctagtttcattttgtttttcagtaagacaaaaattggttaagatatggctgtttaaaatttgcatacactcgtgattagtgacccgttcaagctttttcaactataaccctttcaaaaacaagcactttaaaccggtgagactgacagatcatataaaaaaatagataagtaagtaaattgtttcattgtttgtaaagcggtagcgattaatttcgtttggggagctaaacggnggggagattttcatgattttttatcaaaagaagagggccaactttgttttgggcgtactcacttatttttgatgctagnaactttta

SEQ ID NO: 16452 - DNA, 964 bp, Diabrotica virgifera
  misc_feature (76)..(95): n is a, c, g, or t
  misc_feature (779)..(779): n is a, c, g, or t
  misc_feature (868)..(868): n is a, c, g, or t
gtatttaacagtgttcataaaatagcagctggacaacataatgcataggtggaaggtggaaggtgaaaggtggacnnnnnnnnnnnnnnnnnnnncgcaattgtacaattattgtacataccaataaacaatcattaatactcttacctgcctaatcggcggggcccacaatacacgaacaaacttgatctcacataatgactatattaactcaactcacaaatgatgcagaattttgagaatttgtggtttttatgaacctttggcgtcctttgtttgtggtggggttttaaccaatcaaaattatgggaaagtgtgagagatattcaagaacagatttccttaccactcgtaaaagggcttagcgaacctaatacttaagacgagttatgggatgcaaggcccatatcattcaccagaaagctattaaagtctaatgttcgactctatcgatagcacatatgtgtttctaagaaaaacaacgccgatagggactctaggatctaatcagttaagataaaagcgtgaaatgaaagggactagaccaaaatctacactgggaaaacgtaaacgttacaatgataatgctcgcattttcacctttttatatatattttcgataaatgtattgagaaatcaaaatttcgatgaaatttgctttcgcttgaaatttgttctaatgtgtcttcttcttctttttgtatagacatgactctgtctgttttccgatgtgcctctagcaagttgtcgttccatagttttcttggtcttcctattgnggaactgtctcccgatgtccttactacactatttgttgtcagtcggcttatgtggtcattccattctcttcttctttttctttaccagntattaatgtaaagactgaaatagttttgtacacacttatgaaaacaggtgaatagagagaggtgtgttttttgaagtgtgtgagttaaatgactcc

SEQ ID NO: 16453 - DNA, 721 bp, Diabrotica virgifera
  misc_feature (6)..(589): n is a, c, g, or t
  misc_feature (591)..(624): n is a, c, g, or t
  misc_feature (645)..(675): n is a, c, g, or t
cctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnncaaatatataggattaatagnnnnnnnnnnnnnnnnnnnnnnnnnnnnnnngattaaaagacatgtctgtttgtatcaagtataaaggctcgcctga

SEQ ID NO: 16454 - DNA, 100 bp, Diabrotica virgifera
  misc_feature (2)..(47): n is a, c, g, or t
  misc_feature (75)..(94): n is a, c, g, or t
tnnnnnnnnnnnnnnnnnnnnnnnnnnnnnnnnnnnnnnnnnnnnnntcggcacatttttttcacctggttattnnnnnnnnnnnnnnnnnnnntaatat

SEQ ID NO: 16455 - DNA, 468 bp, Diabrotica virgifera
  misc_feature (21)..(38): n is a, c, g, or t
  misc_feature (258)..(277): n is a, c, g, or t
ataaatattcgtacgataagnnnnnnnnnnnnnnnnnncctaccaaccaagatacattccatcaatattttcttacacactaccttctttctttttgtcaatacataatcgtagtgtcccactaaagataaacccacgtccatgccctctctttatctttcatgttcgccacatctagtcatagctaaaaaaccataaacttgtgaaagtttattgcgaatatgtcacggatctccacattcatcagaaaatgtctcnnnnnnnnnnnnnnnnnnnngttgttttgaggtacatttattaacattttttcatgactctatatattacatagctgatttacacagatatttcaataagaatatttactatgatgtttcatgatataattgtgctcttcacttggttctcagtgcttaatgacttctattttttttctatactaactgtagcttttaccagtatagatgc

SEQ ID NO: 16456 - DNA, 166 bp, Diabrotica virgifera
  misc_feature (2)..(31): n is a, c, g, or t
  misc_feature (38)..(72): n is a, c, g, or t
  misc_feature (84)..(102): n is a, c, g, or t
  misc_feature (104)..(104): n is a, c, g, or t
  misc_feature (109)..(125): n is a, c, g, or t
  misc_feature (127)..(156): n is a, c, g, or t
gnnnnnnnnnnnnnnnnnnnnnnnnnnnnnncactggnnnnnnnnnnnnnnnnnnnnnnnnnnnnnnnnnnngtctcgcctggnnnnnnnnnnnnnnnnnnncnccgcnnnnnnnnnnnnnnnnngnnnnnnnnnnnnnnnnnnnnnnnnnnnnnngctggaaatg

SEQ ID NO: 16457 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16458 - DNA, 71 bp, Diabrotica virgifera
  misc_feature (3)..(38): n is a, c, g, or t
agnnnnnnnnnnnnnnnnnnnnnnnnnnnnnnnnnnnngactaatgtttataacaatattaataaggcttt

SEQ ID NO: 16459 - DNA, 587 bp, Diabrotica virgifera
  misc_feature (101)..(119): n is a, c, g, or t
  misc_feature (231)..(253): n is a, c, g, or t
  misc_feature (311)..(326): n is a, c, g, or t
  misc_feature (328)..(348): n is a, c, g, or t
  misc_feature (351)..(368): n is a, c, g, or t
  misc_feature (397)..(434): n is a, c, g, or t
  misc_feature (489)..(511): n is a, c, g, or t
cccattcgggcccccgcacatagaaacagaaaagcaaaaacctttttttggagagagaaaggaaaaagttaatgaaaggatagttaaaaggaattgggacnnnnnnnnnnnnnnnnnnnaaagaaagctccttctgtagtacctgtgtgtaacagtggataattgacaatcgctatgtgtttattatgttcgaagtaaagagccataacaattgaaaatttttatcgttannnnnnnnnnnnnnnnnnnnnnnttggaaggaagcgatacgcagttttgtaaatatatgctaaatttttaaaaagtagacnnnnnnnnnnnnnnnncnnnnnnnnnnnnnnnnnnnnngcnnnnnnnnnnnnnnnnnnctatttttaggggtgagtttataaatagnnnnnnnnnnnnnnnnnnnnnnnnnnnnnnnnnnnnnnccaaagattttcatatttctagtacatgttattatctattttgatatatgattannnnnnnnnnnnnnnnnnnnnnncactaacatataaatgtaaatcatttaaattctattaatggcgatagtagtagcattaagaaattgtatatttagt

SEQ ID NO: 16460 - DNA, 444 bp, Diabrotica virgifera
  misc_feature (9)..(29): n is a, c, g, or t
  misc_feature (49)..(105): n is a, c, g, or t
  misc_feature (107)..(158): n is a, c, g, or t
  misc_feature (160)..(404): n is a, c, g, or t
  misc_feature (410)..(435): n is a, c, g, or t
gcgagcggnnnnnnnnnnnnnnnnnnnnncttatattatcatcattacnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggnnnnnnnnnnnnnnnnnnnnnnnnnngtttataga

SEQ ID NO: 16461 - DNA, 589 bp, Diabrotica virgifera
cattacagacatttaaaccaacaatttctaaagaaatatcgacagcatgtcttatatcaagcaatatttcgaataataggctaatcaaccaaaacgtacgcctgttcagtagtgatcaaaataatactcaatccagcaaatcgaattttaatactgtatatagacttccttttataaaatacttttcagttatcaatagggtaaagttttaccaaacagttttaacaggaatcacaatacctacttcatttgcgttgaatttaatgaacttgattagtacagaaacttttcaagtcatttcgataataggcattactggatgcatttcactttacggagcaggtcatgtaacatccaagtttataggatttatatattatgatgaagaacgagatgtagccaaaatagcgtatgtcgatttttggggttggagaaaagatgtagaaatgcctgtttcggatattgttccaagtgaagacataccgttttctgttactaataaactgtatatgaaatttaaaagatattctacaccagaagtgttaaagtacaatttgaggctaggcattatttatgatggtgaacaatt

SEQ ID NO: 16462 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16463 - DNA, 142 bp, Diabrotica virgifera
  misc_feature (5)..(115): n is a, c, g, or t
taagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttttggatataagaataaatta

SEQ ID NO: 16464 - DNA, 52 bp, Diabrotica virgifera
  misc_feature (16)..(51): n is a, c, g, or t
cgagaagacccctatnnnnnnnnnnnnnnnnnnnnnnnnnnnnnnnnnnnng

SEQ ID NO: 16465 - DNA, 930 bp, Diabrotica virgifera
  misc_feature (730)..(730): n is a, c, g, or t
ctttttcagtaagtttgtgcaaagaaaacgaatctgaataatttgcctaacgggggcagcgatacagcagggtctaataaatatcagccgttaatatatcgtattcaatgcacttaaactattacctagaattctttgaaacgtcgttcggggtcggatactcaaaaaaggtcagagtgtgccgttgcatatgcccagatgtgtatacatatttgggattgaaagcgtagaacgagagggatcctagggcataataatttttgagataataggtttattgaaatcaattttttacaataatttgtttacttacacaataaacttaaaaaagtcttaaaagaataaacatgctttttgacttatctatctaatgtttacagattaatatttacagttttttgacaaatcattttttctagtataattttttgttaaattggtacacaaatcccttttttatttattccaattagtaaatcattttatatatataatctatatctaaacctttcttaaggtgtttgaaaaatacatttcatgcatctatatcatatacaaatcgtctccactcttgcttattcttggaccttcgtttcgcttcagtccaagttgtatttttcttcagaattcttaccacttcatcgttccaggttttctttggtctccctttttctcccttgttttgtactgatgcctcccatacgcgttttacttgtctattgtcgttatntctacacaaaacccaaaaagatttaagcttgttcttatctagtatttgtgtttttggttcgacttgtagttcttctctttacatgctgtttcttattctatcgcgtcttgtaattccttttacttttcatgagtacttaatgtccattgagtttattctatttttcgatgatttgtgtagcacccagctctcactaccat

SEQ ID NO: 16466 - DNA, 586 bp, Diabrotica virgifera
  misc_feature (326)..(348): n is a, c, g, or t
ggcactgcattagcaggaaaaggtggcttagcagtttcaagtccgcaagcaacagccattgcaggaacaaagaaagaagagaagccagaaaaggcagagaaagaaaagccagagaagcaagaaaggaaaacaaccagaaagccaaaaaattgattaatgtaaatagtttaatttaacttttttactttctgcagtagtagtgagatatcttcggatagtttggtaagaaaattcaacatacttttcttagtagacataaagttacggtttatgcacaataacttgctaagtatgatagaaggacttaagtataagtacctagtagnnnnnnnnnnnnnnnnnnnnnnntaatttatatttgtacctatacgttttccgaaatatattaaaaacattgtgtaaattcaacaaaatttcataaaatatctaaaatcaaattatgttagcttgatctcgatgtgtagaaaaatacaaaatgtaaattaggtttttaaaatcttactagttatttctgttgagaataaactgtattaaatataaaatgaaccatccattgtaaatatagatgtagggttttacattacac

SEQ ID NO: 16467 - DNA, 880 bp, Diabrotica virgifera
  misc_feature (559)..(577): n is a, c, g, or t
  misc_feature (804)..(804): n is a, c, g, or t
  misc_feature (814)..(814): n is a, c, g, or t
ggcatcataaccctagatgggtctttgcctgtgtggttatgtccttccgttcagatctctcttgtgtccttctcctccattgtcttatattcatggtgttcaggtcgtcttgtacatcatccacccatctcattctgggccttcctttttttcgccttcctaccgacttcgattataatattttctcagtcgttttgtatcttcttgtcgctgaacatatcccagccatgacagtgttatgacttttcacaaatcttacaatctcttcttctttaagttccatcttctatcgaaggttggaaatcatcatggcaatgcggaccctgttgactgccgctctaaatatctctgcactactgcattcgaaccattcccgtaagttcttaagccaggatgttcttcgtcttcccacatttcgctttcctcggattttgccttgcataataagttgtaataatgagtatttttgccctctcatcacatgtcccaagtactcaagttttcgtcttttgatagttagtattatttccggttgatttcctatccttctagttacttnnnnnnnnnnnnnnnnnnnaatccatgatattcgtaggattcttctgtaacaccaaaattcaaaggcggccaacttattcaaatggacttgtttcaacgtccacgcttccaagccataaagaagagtagagaacacgtaacatcgaagcatccttaggcgtagttctaaccttatatcccgacaacaaagaaactttttaagtttaacgaatgatgcacgtgctatttcaatacgtgtcttaattntctttggttnggtctatatttgatgttatccatggtcctaagtatttgtagttatccacacttttcatcacagtat

SEQ ID NO: 16468 - DNA, 856 bp, Diabrotica virgifera
  misc_feature (685)..(703): n is a, c, g, or t
  misc_feature (742)..(742): n is a, c, g, or t
  misc_feature (797)..(814): n is a, c, g, or t
  misc_feature (840)..(840): n is a, c, g, or t
  misc_feature (851)..(851): n is a, c, g, or t
aaataaaaaaaaaactaccaaatttcatttgcatatctcaaccggttttggagcaataaataaatcatcagtttataagaaaaattttaacattccatatctcggaaacgaagcatttgcggaaatatcgtttataaagcaaactcgtcattattttttcatcgcagaattatcccttaaagtttgtcgcacctatttataaacaccctgtattgatgaagaacatcggctagttgttaaagtacctaacttttttattatccaacataagcgaatgaatcaaaaattagaatgtgaagaaaacctgagggtatagttgggttttaattttagtattttataaacgttagaatattccacagcgtgtggtgaactttgagcaaaaaacatagtttgattggtacacccggtataccgtatacaatgacaatttaactttctagcaacaatattattatagcgatattgttaaagaataaggctataacatattaaaatcacttaaatcggacaacaggtttaggaaatttgagacatcaaaaatgaaccatttttaaggtggtgcgtaatttcttggagtagtatatattatgtagtaacaaaacaacagaatataccacaaaaataaaagtcggaagtttacaggatgactccacaagatacctattccaaaaaacttataacnnnnnnnnnnnnnnnnnnncataatatcacagaaaatgatgaagtcgaagaaagctgngcaaaaaataagtctaatatcttaatctttagccaggaaagtattggtaaaaggnnnnnnnnnnnnnnnnnncgttcccagggtaagaactccatggnttttacagaantgagg

SEQ ID NO: 16469 - DNA, 468 bp, Diabrotica virgifera
  misc_feature (231)..(265): n is a, c, g, or t
cgcacgagtagaagcactctctatacaagagcgaataagagatcggcgtcattgtagtcagaactcatccctgcataagatctacagaacaatacaaggacgccacccactaacacgatcaaaatccgacccaggatacagtcaagaagcaacggcgttacgcagaacatccatgaaaaaaaaatgttaaaatatcataagcctataatctggtatcaataacggcaatannnnnnnnnnnnnnnnnnnnnnnnnnnnnnnnnnngccgcctcaaagttatcaaaattaatttcgctagcattcattgctaccagtatattttcctttctccttaactattattactctgatgccgctaacagccccgaaacaacccatcgcatattacaacactgcttacacaaatggctaagaatcacactttgaccatttgtatgaaaaaataaaaatgcatattgccatcgata

SEQ ID NO: 16470 - DNA, 460 bp, Diabrotica virgifera
  misc_feature (238)..(255): n is a, c, g, or t
ctttacgcgtccgcattgtactaacacaatatttatgtttgcttttcttgagtagttacaccccttcgccatggaggactgtgtttggtacaaaccactgacttcttctatccatttgtggatgacccctacatgatgggaaaaattgcttgtgctaatgttttaagtgatctttatgcgatgggagtcactgaatgtgataatatgcttatgttactgggagttagaacaaaaatgnnnnnnnnnnnnnnnnnngtagacattcctctgatattgataggatttaaagactcagttcatgaagcagatataactgtataacgtagatctaaccgtatataatccttgatgagaaatagatccctattgttaaccaaaaatgatacatctatttattttgctgacctaagatgataataccgatagatgtattaacctacacaaatatgttatacttatg

SEQ ID NO: 16471 - DNA, 925 bp, Diabrotica virgifera
  misc_feature (4)..(21): n is a, c, g, or t
  misc_feature (452)..(469): n is a, c, g, or t
  misc_feature (912)..(912): n is a, c, g, or t
gagnnnnnnnnnnnnnnnnnncatactttgtcaaacctatataatttaatagttttacgttttagtatcgccttttgcacagtattaaaacttacaaagattggatctatttgtttctgattaatttctatgaaatcttaattggtacacagattatttgaaatacgacacttcacttaatatatggtatcacttttacattaaaattgtaataattaaagtccctgatattgaaaactatttctaaagtcgcaccatataataatacgagtgtcttctccagcctgatcctcccctgctccttattttttcctggataatcaaatgaagtagacggtacttcttcttgttcttctcaaatcaggcaagacttgttaatctctgccacttggctgtaaggcctttgtatcgtactgtaatattcaaacgagcgttcgtatttatgtacgacnnnnnnnnnnnnnnnnnncaagttttctttacaaatctctagcttaaactaaactcgaataaaagcgcggtccgcttacatagcaaataacgttattctcgatcattccagacttcgccacctctagatattgtgtgaccttccacataccgcacgtctttctccaccgattccacgtatatcgtgcttccgccagaatgttctggagatggaaccgtttggaactgctacttgcggccggtgattcattattttgctacagtaccttgttttttccttaaactcttacaagtcctgtggtctcaacgaaggccaacagttttcttattgatagttttaggatctcttctggtgcaaatctcagttgacaagtgaattcctgcctcacatctctaagcacattgcaatggcataggatgtgtatggcagtatcttcttccatttcacactttctgcaccangattcattcacct

SEQ ID NO: 16472 - DNA, 828 bp, Diabrotica virgifera
  misc_feature (317)..(353): n is a, c, g, or t
  misc_feature (682)..(711): n is a, c, g, or t
  misc_feature (764)..(764): n is a, c, g, or t
  misc_feature (814)..(814): n is a, c, g, or t
atggtccttaggatcactgctaagtttgtcaacatgctttcatgctattttcgcaactatgtgtcatgtctctgttttttcaaggtttcgatccacttttcctttctcggcttgactcatatcgttgcagtactcgctactctcgcagtcaactcgtttcttcggctaaaagagtaaccttatagaaggtttcatatcgttctcattagttcttcggattcgccagttttatcgatcaaaatttggctctacaattctatcgtgaatctcggctcgcgtttactactcccctacattgttgtcggtcctaagcagcnnnnnnnnnnnnnnnnnnnnnnnnnnnnnnnnnnnnnccttccatctctttcttcgggcgaccaactcgactttttcgccatcgggcctttcccagaatgtggcgttcagaagtctttcgttactcgatcttagcacgtggcccgtccatattattcggtttgctgtagcgtactatgttttcatctccatctacggtctggagttcatcattgtgtcttcttcttcattctcctgtttattcgccagtttacctttttgaatttaaatcttaattctgaatgggacagcttgtggtccgaaaattggaaaaataattagagcaattggtctaagttgattttttggtaatatagtacttaagtannnnnnnnnnnnnnnnnnnnnnnnnnnnnntagatatccaggttatactttattttttcaacttagttctgaaaagatggtgnacgtttaggatcatggattaatgtgagactattagctttactccatgttnctactatgtctctg

SEQ ID NO: 16473 - DNA, 70 bp, Diabrotica virgifera
  misc_feature (2)..(69): n is a, c, g, or t
cnnnnnnnnnnnnnnnnnnnnnnnnnnnnnnnnnnnnnnnnnnnnnnnnnnnnnnnnnnnnnnnnnnnng

SEQ ID NO: 16474 - DNA, 812 bp, Diabrotica virgifera
  misc_feature (2)..(18): n is a, c, g, or t
  misc_feature (20)..(62): n is a, c, g, or t
  misc_feature (70)..(743): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagcttaatttttttaaagacgagagacctatagagtttataaattataatagttttttagtata

SEQ ID NO: 16475 - DNA, 871 bp, Diabrotica virgifera
  misc_feature (474)..(488): n is a, c, g, or t
  misc_feature (797)..(815): n is a, c, g, or t
ttttgattgtttaaacagtgttccggacctttttgagggggaggatgactcaaatattgttgtttgagttgttttcgggcaatttctgcaaagaaatttgagtaacctctcaacgtccaaatgtactaatatttttacagatgcgccctggtctataactccctctaaacatatctaaaatattataaatcagaaatgtttcttagtgagatatattgtaaaacagaaatatttttgattaaattaatgttgtgcttttcttttcctcaatatctctgtgtttcttgaacggtttttatgcgatgttaatttgatgataaggttaccatactatattatcttttcttcttgtaaaaactgtatatttcgttaaatgatacatcttaagacgctgtatatacaaatatctggacgatagtcgagtatatctgcgtctttacatctcttgttaacgatccttttttaaactaggtnnnnnnnnnnnnnnnctgtagatgttgtacaactcttatttaacacagaaactatttataatatttgttaatcaatatatccgtgttatgttatgaaacactccgtaaaatattgtcggatgtaggaccgatgtgccgaggaggaatcaggcgacagagttacctatactttaaacctagctaaaaatcggatcgctaacaggagcacttaacagtttttctaatggacagatattattaatgccagcctattatcacataatgcatataaccagttcaatagtaaataataagctagtcaattttatcaatagtaataatggnnnnnnnnnnnnnnnnnnnctcgtgccttaatctttgctcataattttttcgacaatatctgttttaaatttact

SEQ ID NO: 16476 - DNA, 402 bp, Diabrotica virgifera
  misc_feature (56)..(74): n is a, c, g, or t
  misc_feature (193)..(213): n is a, c, g, or t
cttcctttattttcttcttcttcttctatcgcagctgaacgactacttctgagagnnnnnnnnnnnnnnnnnnnttctttagaagggaataaaacaaaaaagggcggaggacgcgtggaaagggacgggaaaggcggaccggaaccagaaggcgaacaagatgtccccatagtgcgaagtgtgagagagtgannnnnnnnnnnnnnnnnnnnnatcctgggaagagacaactattgaggatgaggacacagtcggtagaagggctaagcatgatgaggaaggcaatgaaagagccgaaacgatgaactacacacgatacgcaatcatggagcgcggacggggaaggagcccagagccgtacggaggatggccgatgggagccaaaggatgaaagagacgcta

SEQ ID NO: 16477 - DNA, 906 bp, Diabrotica virgifera
caattttccgttcattggatacatgaaaagagatcaaagttcatcactaactggtagagatcaaataaatcgataatgcctctaacggacattatccgacgggcatcgacctacattcttggccctgaagaggacactttaaaaactccagaatatgaggacaatgagatcctcttttgtaagaacatctgcgtgcatcctcctgctacagcgagacatgacaatgatctgcataatcccggttatctaaccatcactacaaaggttttcattgatcagtataatgatactcgcaggcctacgcttttcttgacgtggataccgaattcgtctatcacgaaaaacacgaacttaattggtacacctctaaaacactacaacaagagatacagtttggaaagtttaacgtcgaatgattccaacgactttggcatcgagaggcatcccgttgtggagtttaagagtactaatcctttcttaaactacgatgacagagatcgcctggatatgtctgatttaagctcagagggaagcgacaagcagggaatcagcattaacgtggatatttctaatcctgagatagaaataatacaaacacccgatagcgttaaggatcctggagactattttgagttttcgagatcagcatcagtaacttcttcagacagccaatcaaactggctatcaacaccagaatatttaatgcaacagcacaatctatactttccagatagcgctagtaattcacccattttgcagccgaaacagattcacaaatgtagaagatttagcgtagacctcagccaaatgcggtctcttagattattttttagtgacaatagttgcacatgtggacaactcgtcgtagcttccagagaatctcagtacaagatcctccactttcac

SEQ ID NO: 16478 - DNA, 862 bp, Diabrotica virgifera
  misc_feature (485)..(502): n is a, c, g, or t
gctgcaacagggtctcctcttacgacgtttggaaaacggactccagtactaccaacaccatccaaagaaccagactcttaccagcccttccaaactcagttaccaatggaactagaattaccaaaagaagaagccaatcctgtaccattctacgctcctgagccatccacggatcttaaagcaccacaagaatctcaagagccggactattatcaggtaccaatacccaaccaagaactcgcggcacccatagacaccgagtggaatcccaataatgatcctatttattactatgaggtcccagctataatcaacaaccaggaatcgcctacgagagagttccctaagaaatataacgaagatattcacgacaaaaagaagccttttgcgtcccagccaaaggttgagattattttcgaaccgatcagcaagcagcagtacgaagaaaaacaaatagaattaaccaaaaagtttgataaactcgnnnnnnnnnnnnnnnnnnagatcattcaggcacaacagactatttagattcgaagagcgagataaggaaggggtggtaaaaggtcactatggcttttacgacaaagaggggaagctgcaagtagtccactacgatgcccacccgcatacaggattccaaactcagttaccaatggaactagaattaccaaaagaagaagccaatcctgtaccattctacgctcctgagccatccacggatcttagagcacccacagaatctcaagagccggactattatcaggtaccaataccctactatgaactcgcggcacccatagacaccgagtggaatcccaataatgatccctattattactatgaggtcccagctataatc

SEQ ID NO: 16479 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16480 - DNA, 755 bp, Diabrotica virgifera
  misc_feature (202)..(235): n is a, c, g, or t
  misc_feature (239)..(258): n is a, c, g, or t
  misc_feature (268)..(569): n is a, c, g, or t
  misc_feature (581)..(635): n is a, c, g, or t
  misc_feature (639)..(652): n is a, c, g, or t
  misc_feature (654)..(681): n is a, c, g, or t
  misc_feature (709)..(740): n is a, c, g, or t
gtgagctggagtaacaatagttcttcacctttcaatggcttgtttattatttataatatatgtaccatctatctatttgctcttgaaatatcttgttttcgtttctttttaaataatccaaatgaattcgagatttttagttccactgacagattattaaattgtcatgaattaattatgtgacaatagctaaaaaaccacnnnnnnnnnnnnnnnnnnnnnnnnnnnnnnnnnnatcnnnnnnnnnnnnnnnnnnnnatttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatataggannnnnnnnnnnnnnnnnnnnnnnnnnnnnnnnnnnnnnnnnnnnnnnnnnnnnnnatgnnnnnnnnnnnnnnannnnnnnnnnnnnnnnnnnnnnnnnnnnaatacgataatttgatcgagctaagggnnnnnnnnnnnnnnnnnnnnnnnnnnnnnnnntaatgaagggcttgc

SEQ ID NO: 16481 - DNA, 932 bp, Diabrotica virgifera
  misc_feature (90)..(108): n is a, c, g, or t
  misc_feature (655)..(692): n is a, c, g, or t
  misc_feature (807)..(807): n is a, c, g, or t
  misc_feature (860)..(860): n is a, c, g, or t
  misc_feature (871)..(871): n is a, c, g, or t
  misc_feature (882)..(882): n is a, c, g, or t
  misc_feature (899)..(899): n is a, c, g, or t
gaaataaggaactgtttaagtttgatcccttatattattaataccctgtcactgtttatgcaaaatgacgatctattatgaattagaccnnnnnnnnnnnnnnnnnnngcattatataacggctcaactaaaatgtattctatataatacaaaacgttaaaacacaaactagccaggattttcgtcatagaaagacatgttactgattgctccattgtagcagtaaaaaccagagggggccggggagagtgagagagagaggcataaatatatttaccgaaccattcatgttctttttctccctctgtcaatgctaaccggtagagaatttcattttgtgcccatatcattcaaaatcacaattaacacaaattttgagttgagcccttatattactgagggtacgatgtgattactttattcaaaacaatctgcgtatgtgctcaagaaaagtgacacatttatcacttatttgtcttttttttttcagtactttgtgtttaatgttgttatgtacttatatttaaagttacatcattaaaaagtataagtctgttaaccagataattataatgatattatgttctctactgcaagagccacttttgataaataacatttcgtaaatgtttcggtattttatctgtatagtgtnnnnnnnnnnnnnnnnnnnnnnnnnnnnnnnnnnnnnncagcattaatcactattttgtagagcttcaaaaacctttgtacctgactaaaatagttacactaattttaatagtttttgaactaaagccggaaaagttctagcacaaattttanacattgttttctatatacgttgcttttttgacttgtgacactggtttgagcgnaggtgcgatantgtagaggcgncttatagcaagatttgngcgacttaaaaacaaacatagactttttttcgt

SEQ ID NO: 16482 - DNA, 841 bp, Diabrotica virgifera
  misc_feature (797)..(798): n is a, c, g, or t
  misc_feature (802)..(802): n is a, c, g, or t
  misc_feature (805)..(824): n is a, c, g, or t
gcagaaactttgaaaaatcacactggagaaaagtctgacaaatgcgaaatttgtattaagcaatttagtcaaaagggaagtttaaaaaggcatttaaggctgcacactggagaaaagccttacaagtgcgaaatttgttttaagcaattcaatttagaaggaaatttgaaaaagcatatgagaatacacactggagagatgccttacaagtgccaaatttgttctaagcaatttagagaatcaaataatctgaaaagacatttgagaatacacactggcgacaagccttacacgtgcgacatttgctgtaaacaatttagtcaagagggaaatttgaaaaatcatttgagaatacatactggagaaaagtctcacaaatgcgaaatttgttttaagcaatttaatcaagaaggacatttgaaaaagcatatgagaatacacactcgatagatgccttacatgtgtgaaaattgttgtaagcaatttagtcaaaatggactattgaaaagcatttaaggatgcacattgaagaaaagtctaagttaaatcaacgtatatagaggttatggaagaattctgccctgtaactttccagtattagttcagagaaataagggaaaaaatatcctgttggtgacacaaccccctccaggccgaggccagattttttgagtggtatggacatctatgttaataacctgtatgtttcctgcagccgattttgatgatatacatggttgtaaacaaatgaaggtcggaaaacggtgaatttttgcttttttcgtctataaccgaannagtnagnnnnnnnnnnnnnnnnnnnnagagtgagaaactcatg

SEQ ID NO: 16483 - DNA, 871 bp, Diabrotica virgifera
  misc_feature (45)..(69): n is a, c, g, or t
  misc_feature (109)..(136): n is a, c, g, or t
  misc_feature (144)..(256): n is a, c, g, or t
  misc_feature (267)..(444): n is a, c, g, or t
  misc_feature (458)..(644): n is a, c, g, or t
  misc_feature (646)..(865): n is a, c, g, or t
cggacgcgtgggtttatctcttaaaataataaaatatctttctcnnnnnnnnnnnnnnnnnnnnnnnnncttaacgatagttaattagtatcgtgagagaatatcttcnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttaaaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttata

SEQ ID NO: 16484 - DNA, 370 bp, Diabrotica virgifera
  misc_feature (25)..(43): n is a, c, g, or t
gagttggtggtaatatgatggttgnnnnnnnnnnnnnnnnnnngccatatatagatagatgatatataaatagatgtaagttggagtatgataaatgtagaggtaggagtaaatgttttttggtgggataaaatatgtattataatagggaatgttaggaagaattgaaagaaggagtgaataggtggtatgaagaaattaagataatgattatagaggtaattgataatttattaaaaggaagataagagattggttatttttataaagatatatgggtcagaaaaagttaggtaggatgtggtctctctagatgtgtacgatctgaagaatacgtagaagttgaatactacataggttgaaattatgg

SEQ ID NO: 16485 - DNA, 237 bp, Diabrotica virgifera
tcttttgcgagcagaagcctgcgaatcttttaccaggttacccctatagtgcgaatctttagaactacctgattatgcaggcctatgttggattgctgttgctaggtgtgaaggctcattcttatacaatactggagaaacatcctgtctgatacattctgatatacagttgatgatagctgaacaaatagataaggaaatatgctgtgacgacagcctatggccactatttacaag

SEQ ID NO: 16486 - DNA, 605 bp, Diabrotica virgifera
tctcgtgcggcaaagttgtccatggacccaatagagctaaaccattatggcatgtaggtggtagcttcagattcccacgatcaccaaagccagaatgggaagtaaatcctggagctaacggtgatggaaatggtaacactaatgctggaatagaagtaagaaataacggcaaagatcatgacttccaggctggatggagcaaagttgtccatggacccaatagagctaaaccaacatggcatgtaggtggtagcttcagattcccacgatcaccaaagccagaatgggaagtaaatcctggagctaacggtgatgggaatggtaacactaatgctggaatagaagtaagaaataacggcaaagatcatgacttccaggctggatggagcaaagttgtccatggacccaatagagctaaaccaacatggcatgtaggtggtagcttcagattcccacgatcaccaaagccagaatgggaagtaaatcctggagctaacggtgatggaaatggcaaccctaatgctggtgtagcagtaagaaataacggcaaagatcatgacgcctaagctgaatggatcaaaggactccatggcccccaacacaaa

SEQ ID NO: 16487 - DNA, 263 bp, Diabrotica virgifera
  misc_feature (58)..(58): n is a, c, g, or t
ctttaagggccacaataccgcgaaacccagggagcacccccttaaaaacgaaacagcncgccccgccggaacaaccagcaccaacaaagccaaacagcaccaaccggcacccgaccccctccagcggaacagcacccgaagcagacaggccaagcgcagcgagggaggaacccaacgcagaaccacgacgaccaacccccggaggcaacgaccccagagaacgagaaaacgaaacgagacgaacgagggcacagcgagaggac

SEQ ID NO: 16488 - DNA, 785 bp, Diabrotica virgifera
  misc_feature (17)..(61): n is a, c, g, or t
  misc_feature (82)..(111): n is a, c, g, or t
  misc_feature (119)..(182): n is a, c, g, or t
  misc_feature (195)..(244): n is a, c, g, or t
  misc_feature (247)..(275): n is a, c, g, or t
  misc_feature (277)..(296): n is a, c, g, or t
  misc_feature (305)..(350): n is a, c, g, or t
  misc_feature (355)..(462): n is a, c, g, or t
  misc_feature (467)..(524): n is a, c, g, or t
  misc_feature (526)..(547): n is a, c, g, or t
  misc_feature (549)..(567): n is a, c, g, or t
  misc_feature (569)..(593): n is a, c, g, or t
  misc_feature (603)..(622): n is a, c, g, or t
  misc_feature (654)..(679): n is a, c, g, or t
  misc_feature (710)..(732): n is a, c, g, or t
ggaaagtaattaagaannnnnnnnnnnnnnnnnnnnnnnnnnnnnnnnnnnnnnnnnnnnngaccctggggaaccgggaatnnnnnnnnnnnnnnnnnnnnnnnnnnnnnnccaaattnnnnnnnnnnnnnnnnnnnnnnnnnnnnnnnnnnnnnnnnnnnnnnnnnnnnnnnnnnnnnnnngaaaggtaatccnnnnnnnnnnnnnnnnnnnnnnnnnnnnnnnnnnnnnnnnnnnnnnnnnnccnnnnnnnnnnnnnnnnnnnnnnnnnnnnncnnnnnnnnnnnnnnnnnnnngggaggacnnnnnnnnnnnnnnnnnnnnnnnnnnnnnnnnnnnnnnnnnnnnnnggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagnnnnnnnnnnnnnnnnnnnnnnnnnnnnnnnnnnnnnnnnnnnnnnnnnnnnnnnnnngnnnnnnnnnnnnnnnnnnnnnncnnnnnnnnnnnnnnnnnnncnnnnnnnnnnnnnnnnnnnnnnnnnccctgccccnnnnnnnnnnnnnnnnnnnncgggatttttgaccgtgctaagggagcaaaannnnnnnnnnnnnnnnnnnnnnnnnngaggaagggttggaggaaaaaaaaacggccnnnnnnnnnnnnnnnnnnnnnnnctatttttcggccaaaacccccaactcttcttcaccacccgacaaccccccct

SEQ ID NO: 16489 - DNA, 211 bp, Diabrotica virgifera
aactcgaatattgacgaaattttgtaaaaatggaaagtgttatttctgattttctaacaagcacggcgtttgttttttcgctacttattggtgccagtggtttacttatactgtactatatcaaaacgtttaaacaggaggcagttatctagaataaccaaatacgaataattaaaccgtctattctgaagagaaaaaagatttgccgcca

SEQ ID NO: 16490 - DNA, 246 bp, Diabrotica virgifera
ggggttctgatcgcgaccgcccttaaccggggcagcccttcccagatcaccgccgacctcaaggtcacggagcgcaactacgagaagctactcaagaagatgcaagactgcgtccaggccgagagcggcgagtgcctcttcgatccctatgagttgaacgagccgttgcagcgcgcggggcccctgatgtacgcggctgacgtgtacccggagctcaagccctccctcacccacggtttcgaggag

SEQ ID NO: 16491 - DNA, 913 bp, Diabrotica virgifera
  misc_feature (21)..(42): n is a, c, g, or t
  misc_feature (45)..(563): n is a, c, g, or t
  misc_feature (565)..(588): n is a, c, g, or t
  misc_feature (590)..(627): n is a, c, g, or t
  misc_feature (630)..(677): n is a, c, g, or t
  misc_feature (680)..(700): n is a, c, g, or t
  misc_feature (704)..(725): n is a, c, g, or t
  misc_feature (788)..(808): n is a, c, g, or t
  misc_feature (851)..(887): n is a, c, g, or t
ccttttgcgcggacgcgcggnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnncnnnnnnnnnnnnnnnnnnnnnnnnnnnnnnnnnnnnnncgnnnnnnnnnnnnnnnnnnnnnnnnnnnnnnnnnnnnnnnnnnnnnnnntgnnnnnnnnnnnnnnnnnnnnntggnnnnnnnnnnnnnnnnnnnnnngccccctgattaatttgaaagggccgcggggattttgacccgggccaaggcaggaataacccnnnnnnnnnnnnnnnnnnnnngttggcgaccgaagggcgcgggttgaaaaaaaaaaaccgtccnnnnnnnnnnnnnnnnnnnnnnnnnnnnnnnnnnnnngttaaaaaagcctttacaattttttt

SEQ ID NO: 16492 - DNA, 291 bp, Diabrotica virgifera
  misc_feature (8)..(8): n is a, c, g, or t
  misc_feature (22)..(22): n is a, c, g, or t
  misc_feature (32)..(32): n is a, c, g, or t
  misc_feature (40)..(40): n is a, c, g, or t
  misc_feature (50)..(50): n is a, c, g, or t
  misc_feature (125)..(125): n is a, c, g, or t
  misc_feature (128)..(128): n is a, c, g, or t
  misc_feature (134)..(134): n is a, c, g, or t
aggcaacncaacggcaagcccncaggaggggnaaaaacancaacacgacnccgccggacaccgaaccagaggcagaaaacgaagcggcacacaaaccaaccaaagaaaaaaaggaaggcgacagncancggacnccaggaagcagaacaaccgacggaaaagcccggccgagcgaaagaaccggcaaacaaaacgagcaaaccaacagggacaaggggcagcgcggaacgaacaacgaacattgttttgagtcgaaaatcgataataaccgcaaactagggattctgggat

SEQ ID NO: 16493 - DNA, 382 bp, Diabrotica virgifera
ctttagggggcaagacagagggcctcaaccagagggggaacccctttagactgagactaggtctattcttactagtaatataccactaattttgattggaagtatctccgatttattattctactaatactggattaaaaactgacggtatgttaatatgggcaataaattccggggacatggcacattatgattgtgaagatcggctaacgtattcgaatggataatcggcgtatggattgtttgaagtggagatggaatactgagtgagagatgctcaagagagcgaggaggataatgtgtagctgctgcatcgtgcgttggcgagggtgatggcgatagaaaagaggggaaggacggtattaatgtgagttgggaagaa

SEQ ID NO: 16494 - DNA, 628 bp, Diabrotica virgifera
  misc_feature (58)..(92): n is a, c, g, or t
  misc_feature (613)..(613): n is a, c, g, or t
cctttgtgcggtacatgaaaactctgaatacagcacaccaaaggccttatctcagacnnnnnnnnnnnnnnnnnnnnnnnnnnnnnnnnnnnttctttggagttttttaaaaaatcaccctaataagaaaattatggtatttttttccagctgtaagcaagtgaaatatttttttgagatattttccaaattaaggcctggcaccagtttgatgtcactttatggcacattgcatcagcttcgtaggatggagatttatgaaagtttttgccgtaaacaatcagcaatattattttgtactgatttggctgcaagaggactggattttcctgaagtacactgggttgttcaagtagattgtcccgaagatccggaaacttacattcacagggttggtagaactgctcgatatcacaggggaggggagagttttcttatgctattgcctagtgaagtgaagatggtggataaacttaaagaaaagaaaataccagtagagaagattgaaattaatccaatgaaattaaacaatcctggtaaaaaaatggaagcatttctggccaaggacccgtccttaaaggattcagctcaaagagcctttcgtttcataggntaggctggtatttct

SEQ ID NO: 16495 - DNA, 505 bp, Diabrotica virgifera
  misc_feature (35)..(35): n is a, c, g, or t
cctttgtgcgcaaaacaacaataactaagaccagnagctcaagcccttttgaagaaaccaacaagaatatagttgacaatgagagtggcaaagatggttcaaaagtaattcacaaaactattaccacacacctaggtgaacaaaataacggtgagagtcagcaatcactcttaagtggtcatgcaaatgaagagcttggttatggcagcagttccacaaaaactacaattattaaaaccagttcttccagttccgatgttccaagcactttgattcatggaacagataatcaacatctatttgaatcaggtagcggttcaagagttatacaaacaactgtaactaaaacaagcagctctggttcagaccatgttggagatcgtggacaatatatcttaaatggtcatgaaaaaaatggcattggttatggtaacggctctaaggtaattgaaacaactgtaacaaaacccccttggagggagcaatgaaaaaaaaacttggtacc

SEQ ID NO: 16496 - DNA, 94 bp, Diabrotica virgifera
catcaagcgcaacacagaagacttgctggaaaacgaagtaacaccttcatagggaatgaaagatcctgatgacccaacgactgacgccctcaac

SEQ ID NO: 16497 - DNA, 124 bp, Diabrotica virgifera
tgcttataaagctcaaataaacatggcaaatagaagaatggcctgccggacctggcggtggccttcgggacaatccttcttttattcaaccaccatttcaaggccctagtgccgtcacccctct

SEQ ID NO: 16498 - DNA, 413 bp, Diabrotica virgifera
tcttgtccggaaacatttactaattttcatcgtttgtttaatttccactcaacttattacttgtttacctacgtcttccaatgatggccagcatgatattatagaaggaaattgtgccaatccagacccagaaaaaatagtatacagagatcacgtcgaaaaaatggccataccttttatagtaagggacaacactaatgaatggcgtggggatgccaatattttctgtgtgatggttattagtgaacaggacgaatcgaaaggttcaactgctcgcatcaccgaaggaggagtggaccatcactttataacaattgaactagaatctggccgtggaaacgccttggactacaatattaaaatatatgctgaataaatctatacttttttatatctacctttatatttttatg

SEQ ID NO: 16499 - DNA, 417 bp, Diabrotica virgifera
  misc_feature (23)..(23): n is a, c, g, or t
  misc_feature (26)..(26): n is a, c, g, or t
  misc_feature (29)..(29): n is a, c, g, or t
  misc_feature (31)..(31): n is a, c, g, or t
  misc_feature (60)..(60): n is a, c, g, or t
  misc_feature (85)..(85): n is a, c, g, or t
  misc_feature (106)..(106): n is a, c, g, or t
  misc_feature (108)..(109): n is a, c, g, or t
  misc_feature (111)..(111): n is a, c, g, or t
  misc_feature (142)..(142): n is a, c, g, or t
  misc_feature (377)..(395): n is a, c, g, or t
ttttaaacggctgacaggagggnggncancnggccagggagcctttttaaaacaacacanaccaagcggacaaaaaacgccggcnaaaaacacggaagcagcaagnanncncccggcaccagcacaaccgacacgggaccgngacgaagaacgacgcaaaaaatcagaatttttatcgtctaaacagctaataagcacccaaaacgttgcgcccccatatggtcaaagacgtggctgggttcccagaagtgtaacagacttcggagatggatgtgccttcacacaccatcctgtagcgtctcccctcatccatattcctcaccacaaaccattcttcttcatcgcacctcccttttttttttctgatgctcccctannnnnnnnnnnnnnnnnnnaagaaataataaatttcttttt

SEQ ID NO: 16500 - DNA, 206 bp, Diabrotica virgifera
gtacgattcaaactgaaccgttgctttgctacgcttcgctacgacttgcttacgctttcgctataaaagttatagagtcccactgctgtgtttgtgtttgcttttgagtacgaatttcattttcttgacaacgaaaatgatcggtgtgtaatcaataatacgtgcgagacctgcgtaacgaggaatcctcataatactgtatttag

SEQ ID NO: 16501 - DNA, 498 bp, Diabrotica virgifera
tcttaaaggatcatattaaacgacttacctactcaggagcagcccttgaaacaaatcagaagacttggaagagtcccaatcgagaaggctacgaccgaatttggtttacgaatgaaaaatcaccctttcaacgagcactgaagaagcggaagaaatagaagatccagaaacccgaaaagaaagagaaagattagccgaaatcgaaagacttagggccgcagaaaaatttatggaaattgatgaaggtaaatttgaatgccaagcatgtggttatatgtatgagccagaaaaaggagatagatttgcaggtgtcgaacccaatacccagtttgctgatctggccgaggattttacctgccctgcgtgtcgatcccccaaaagccaattcaaaagtgtaaaaaaagtaatcgcgggatttgctgaaaaccagaaatatggactgggaggaaattcattaacttcaggacaaaaaaacagtcttatatttggattattgag

SEQ ID NO: 16502 - DNA, 480 bp, Diabrotica virgifera
  misc_feature (11)..(35): n is a, c, g, or t
  misc_feature (57)..(58): n is a, c, g, or t
  misc_feature (86)..(86): n is a, c, g, or t
  misc_feature (99)..(100): n is a, c, g, or t
  misc_feature (107)..(108): n is a, c, g, or t
cctaaaacgannnnnnnnnnnnnnnnnnnnnnnnngggccgccctttaaacagcatnnccggggcaggagggagaaaaggaaaaanccgggagaggagnnacaaaanngggcccaggccttcgccagaatgaggaaaaaccaaacactctatgtgttgcccagccaggaaaactcgtctataaagaacctaatctatattgggtcgaaggaaataggagaagatacattcccaaaaaaggtgatttggtggttggagtgatcattaaaaaatcaggagatactttaaaagcagacattggcactgctgagcatgctgccctatccttactagcctttgaaggagcaaccaaaaagcagaaacctgatgtacaagttggagatgttgtgtatgctaggatgaagaatgcttacttagacacggacccacagctagtgcgccgtacacacgcactataaagctgctcccctctaagaactcc

SEQ ID NO: 16503 - DNA, 182 bp, Diabrotica virgifera
  misc_feature (14)..(14): n is a, c, g, or t
  misc_feature (16)..(16): n is a, c, g, or t
  misc_feature (18)..(18): n is a, c, g, or t
  misc_feature (25)..(26): n is a, c, g, or t
  misc_feature (32)..(32): n is a, c, g, or t
  misc_feature (41)..(41): n is a, c, g, or t
  misc_feature (61)..(61): n is a, c, g, or t
  misc_feature (76)..(76): n is a, c, g, or t
  misc_feature (78)..(79): n is a, c, g, or t
  misc_feature (84)..(84): n is a, c, g, or t
  misc_feature (104)..(104): n is a, c, g, or t
  misc_feature (132)..(132): n is a, c, g, or t
ctttagaaggcgantntnaggggannaggagnggggagggngccctttatgacgtttcgtnttagagtatttggantnnaaganattaggtggggagggattanttagagagtatttgttcccctgcagagnaagtctattcttactcctattcttctgagtcttataatcgctccggctat

SEQ ID NO: 16504 - DNA, 460 bp, Diabrotica virgifera
  misc_feature (305)..(341): n is a, c, g, or t
tcttaagggggcaaaacgctttgcactggcctttggggaggcccctttcaaaaaccgagaagctattacagctttacacagagcaggcattatatttgccgtgacagcttcagagaatatatcagatgatcccactggtccaccgcccaacttatcatttttggaaattttaacggaatttacaaataaattgttgaagcaggacaaaagagttgtcatgggctttttggataaaagaattacaacaggaatgcctagtagtagaggcgaagactggcaacctcttcttttgtacagaaattccnnnnnnnnnnnnnnnnnnnnnnnnnnnnnnnnnnnnngtaaacgggcttacggaagaaaacgtcataagtctcccgattctgatgttgaaccagatgacttgtcccgatcaagaatttccaggaaatttgtatggctaagaacatgatttatttgc

SEQ ID NO: 16505 - DNA, 637 bp, Diabrotica virgifera
  misc_feature (33)..(33): n is a, c, g, or t
  misc_feature (569)..(598): n is a, c, g, or t
accccctaaaggccgagtaagagttgcatcggncaaaactaaataccctttcttcaagcgctctattaataaattgtgtcctctaccaaatgactgttaaaattaagttaagtttagtgttttcgcttaagaacgttgtaagttgatttatgttaggttaggtttatgttaaagccagtgcttcaacgcgggggagtatgttgtgaaaacaacagttatttacattaatttgcttttataaaaatatcgctctgtaaatctgttgggacaatctgtattgtgtttaaaatatttaattctctgaaaaacttgagtgtagcgttgtgtgtttcataaaatatacatctgcattttttatagtttcggggtaaaagcaggtcattttgcccaaagaagtgtaacatgtgtttggccctttttcagggcgaatggtgtaaactaaacctatcaaagataatagggcagagattttgataaaattttcagagtctcttttcttgatggcaaaatgaaaaccttgttcgcttgtggcggtctttttttcgccggaaaaaatattctcctccgcnnnnnnnnnnnnnnnnnnnnnnnnnnnnnntaccttcctttccgttcggctaattaaaaactataattt

SEQ ID NO: 16506 - DNA, 655 bp, Diabrotica virgifera
  misc_feature (449)..(470): n is a, c, g, or t
gataaaagtaaaaagaattaccagtaggactataattttaaatatgttttaataatactacatgcaggaaaaatgaaggaatacccatgaacgaacgtgtgtagcacgctgtgtcttcctgtaaccctggcacgcattacttggagcaggaatgctctgtgatggaggaataagatgattgtataagaaacactcttttgtctataatttcctgcgattgtaaagtttcttatgaaacgattgtatttttaggttcccggttatctcctaattcttcatattcagatatttttggattgatttctttatcgaatgaattttctttctttcaaattaggaaaggagaaaaaaacgaactttcaagactagaaaggttggttcttttccctcctgaaggagattttttaaattcttcatttaaggtgaatattcttttgcagtcttacatnnnnnnnnnnnnnnnnnnnnnnttgtctctagaagctgattcgatgttcatcgggagaacagcactaagaatatcgagagttttatttcgaaatttccatgtcaaaaaggctggcaaatctttcccaattttgttttaagaatttacaaggcaataaaaaatacagctttgggacaataataattttttcctttccaggttttaaaa

SEQ ID NO: 16507 - DNA, 762 bp, Diabrotica virgifera
  misc_feature (29)..(29): n is a, c, g, or t
  misc_feature (31)..(31): n is a, c, g, or t
  misc_feature (71)..(83): n is a, c, g, or t
  misc_feature (85)..(105): n is a, c, g, or t
  misc_feature (131)..(154): n is a, c, g, or t
  misc_feature (224)..(243): n is a, c, g, or t
  misc_feature (248)..(268): n is a, c, g, or t
  misc_feature (367)..(387): n is a, c, g, or t
ccttaaaggtagatattagaccatgaccntnatgaggagcttccatagcaatattaacaatattaggaatnnnnnnnnnnnnncnnnnnnnnnnnnnnnnnnnnntaataattggattattaattacaagnnnnnnnnnnnnnnnnnnnnnnnnagatattgtacgagaaggaacttatcaaggccttcatactttagtagttactaaaggtttacgttgaggnnnnnnnnnnnnnnnnnnnncagannnnnnnnnnnnnnnnnnnnntttttgaggattttttcatagatcattagcaccaactattgaattaggaatactttgacctcctaaaggaattcaagcctttaacccattagaaatccnnnnnnnnnnnnnnnnnnnnnttttaacttcgggattaactgtaacttgagcccatcatagcctaatagaaaataatttttctcaaggacttcaaggattaatttttacagtaacattaggaatttattttactattttacaaggatatgaatatattgaatcaccttttgcaatttctgattcaatttatggatcttcattttttatagcaacaggttttcatggattacatgtaattattggaacaaccttcttattaatttgtttaattcgccattattttaatcatttttcctccacacatcactttggttttgaaagcacagcttgatactggcattttgaaaatgtaatatgattatttctaatatatttcaattttctgaatgaaggag

SEQ ID NO: 16508 - DNA, 682 bp, Diabrotica virgifera
  misc_feature (11)..(43): n is a, c, g, or t
  misc_feature (46)..(543): n is a, c, g, or t
ccgtcaagggnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatggtgataaatattagtattaacaaaattgcatattttagtaacaaatatcggtttaattacggcattcgggcaactttttttttcctctggttattaaaaaaatggctcttcttgtattaactatcaatgtttc

SEQ ID NO: 16509 - DNA, 488 bp, Diabrotica virgifera
  misc_feature (12)..(12): n is a, c, g, or t
  misc_feature (14)..(16): n is a, c, g, or t
  misc_feature (26)..(30): n is a, c, g, or t
  misc_feature (53)..(53): n is a, c, g, or t
  misc_feature (60)..(62): n is a, c, g, or t
  misc_feature (72)..(72): n is a, c, g, or t
  misc_feature (74)..(74): n is a, c, g, or t
  misc_feature (78)..(78): n is a, c, g, or t
tctttggggctngnnnaggggggcannnnnaaggaaggaaaccctttgacagnacaagannnggggcagcgnanattnggagcattacggattggtgcttaatcttggaaatattggaggaaatctatacattaactcggctctacaaggcgtagtcgagatccctgcaatagtaatcagcatctattttcttctcaagaaaggtagaaggtggccactttccctaacaatgattacatctggaatagcctgcatactcaccttgcccatatacttcctggacagtaatctccagtgggtaataacttcactaacgatgattacgcaagttctgtatcagttcgtcaaatgctactacccctgtttttgcagcccgaactgtttccaactcctatccagaaatattcggcgctcgttctgcccatgtctcaccttgggattgtttttatgttcggtactatatttgggcgctaccgttttcctttcca

SEQ ID NO: 16510 - DNA, 593 bp, Diabrotica virgifera
ttttaggggacgctggacgctgggaccgaggttggcttcctgttcgtgctcccctcacaatttcagggaccaagaccacttactcggccctctcaccggcgtcgaggaaaaaattacagtcccagagagggacccttttcgaacttgcatttcgcgttaatgtattgactgttgcttctgccgcgtattttataaccaggtctccgggcattccttccgctatatacgctgttttcagttgttctaccaattcttctatttctgtagcttatgttgtcgcgtccctatgggcttgtttcttcctattcagcttggctattaccaatttagggctatctccttttatatttttcttcaatgtgtctataattttctcgatggaatcctctgtcgtgattagacttcttgcttttccaataagccttgattttaccagtgttattgctgtattttcgtgcccttcttgtatcgattttacgaattctaatgcatccacgaatgcttgcagcttcccgatttctccatccgaattctctgggtaacaccctactcgttgtaattaaaaagtcattcatatttaaggccatgctttc

SEQ ID NO: 16511 - DNA, 1171 bp, Diabrotica virgifera
  misc_feature (436)..(457): n is a, c, g, or t
  misc_feature (539)..(556): n is a, c, g, or t
  misc_feature (558)..(580): n is a, c, g, or t
  misc_feature (648)..(660): n is a, c, g, or t
  misc_feature (663)..(677): n is a, c, g, or t
  misc_feature (995)..(1015): n is a, c, g, or t
  misc_feature (1124)..(1167): n is a, c, g, or t
caagctgttaaagcaaataaaattgtaattgaccattcaattaatttaggtatgtgaccagcactcttttgcgcaaaatacagcttgtgtaacatttttgggaactgtagaaagaatgtttaattttttttctgctttgactagccgctgggtagtgcttaataacccggtattggtcgctatatgagattttctctcacggtttcagaatattgcacacaactttttccctggtaaattacacgtgctgtattttcttatagtcttctaattatacttctacaatcgaatagactcgtcagcttagatggtggttgagttgacttagtatagcttgttaagtcagtgcgcttcacgtgagatattctctcatcgcgcgaccaccgtgtataatattatttagcattattttatagcattatcctatattgtagcnnnnnnnnnnnnnnnnnnnnnncaatatgaatcgtgcaaagataattttagaacttgctctgttgcaggacaataaaataaaggtactaatagtacaaatttgnnnnnnnnnnnnnnnnnngnnnnnnnnnnnnnnnnnnnnnnnctacatttttagattaaaatgtacaagctcattaacagtcacattgtgtaaagctaataataactttnnnnnnnnnnnnntcnnnnnnnnnnnnnnnattccgtaaaaaagggcaaaagttggatatgtgagacaaagtctcacccgcgacctctgacgtaaaagccaacatagcgaccagtgccgggttaacaccagcaaagcatttgttaaacgactctcccaccatgcgttggaatgctccactatgatgcaattaaagtattggcagaacatttttgatagatatgatgccattaaggaattatgtcaaccaccaacaaaattttagacccccaggggtgctgcacctggccccctgggggtaaatttccactttctttgttattttcttttttggaaggatggagggaannnnnnnnnnnnnnnnnnnnnctcaaattgacatggcaaagaaaagggaaaaaattggttgaaaaattcaaaaaaccacaaaaaaacaaggctctccctcttttaatctggaaaacaaaaaatgggggcnnnnnnnnnnnnnnnnnnnnnnnnnnnnnnnnnnnnnnnnnnnnaaaa

SEQ ID NO: 16512 - DNA, 398 bp, Diabrotica virgifera
  misc_feature (3)..(3): n is a, c, g, or t
  misc_feature (57)..(57): n is a, c, g, or t
  misc_feature (61)..(61): n is a, c, g, or t
  misc_feature (75)..(75): n is a, c, g, or t
  misc_feature (96)..(97): n is a, c, g, or t
  misc_feature (145)..(145): n is a, c, g, or t
  misc_feature (150)..(150): n is a, c, g, or t
  misc_feature (174)..(174): n is a, c, g, or t
  misc_feature (178)..(178): n is a, c, g, or t
  misc_feature (226)..(245): n is a, c, g, or t
tanaggggcacccagaagggagattgagtaagaggggagacgcttttgagggtaggngttntttgggtagtaaanattagtgtagttggatagtanngaagtagtggtaggtaggtgattttaggagtagttggaaatgtgaaantagtnggatttgaaggttgggagattganattngtagaagtaattagaagggaagaagtgtagaagttattttaagaagtnnnnnnnnnnnnnnnnnnnntatggaaattgatgaaagaaggagagtgtaatgttttggttatttaaatattgttgagtatgtattatttagagtgagtaatgtgagtatatgtgaaatgatttataaatgttagatattattttagtttttagtattgtaaaataaaatgtg

SEQ ID NO: 16513 - DNA, 299 bp, Diabrotica virgifera
tttttggcgggttggctcaggcccagggcgctgagcaaatccgcggtgccgccaccggcgctgaggacgatacgctgggcgcggatctcgcggccatcgacattcaggcctgccagggtaccgtcttccatcaacggttcgatcttctccccggcgagcaagccgtcaccggccagttgcgccaggcgctcgatcaggctcgggacatcgatcaccagttcggccaggcggtagaccttgcccttgaagcggcggtcttgcagggccggtggcaggtcatcgcccttcacttgatccac

SEQ ID NO: 16514 - DNA, 890 bp, Diabrotica virgifera
  misc_feature (760)..(779): n is a, c, g, or t
tttgtccggatagcacttatttacttatgaaagtagttttaataataggaatttcaggaggttgtaattgtgaagaactaaccaaattaactgtagacaacatcgaagataaaggatcacacttattagtaactttaccgactcatacggaaaataaacctcgtaaatttattgttatcaacgatacttttggtatggatgttctaggattttactataaatacctttctcttcgtcctgctaatcttactcataacagattatttttgagttataaaaaaggcaaatgtacagttcatcctgttggcgtcaattcgctctccaaaattcccagagagattgccacgtatttaaaattgccggatgccgatatttatactggccatagttttaggcgttcggcagtaacccttttagcccatacatagatgcttatattttccgtgtctgctatttgaaactatcagtagtaattacacgagtctctaaaattatcgatttgtatcccgagtgacactttgacagttttaatttcacgacctgaagggaagcactaatgcaccctgtgcctagggactaatttactcctttcttaaaaccgcacccccttacatggtagcactctgcggttttttcatgtttaatggtttattcagagcccccgtaagaggtactggcgcctgtgtgcaaaaaaggattttggcattttagatcatggcattaaggcattttattaatgcttaaggcattttggacatgnnnnnnnnnnnnnnnnnnnnggaaaggaggcgcttgaaataaacaaaaaattgaactttataaaggcttgtggagtttcccccgttttcggggtggaaaaaataccctaaaaaaaaactttttataacccc

SEQ ID NO: 16515 - DNA, 70 bp, Diabrotica virgifera
  misc_feature (32)..(32): n is a, c, g, or t
cataagaaggcccacgcgctccggcaaaaagngggagagggacgccttttaaaccaacgcacgacgaggg

SEQ ID NO: 16516 - DNA, 712 bp, Diabrotica virgifera
  misc_feature (56)..(69): n is a, c, g, or t
  misc_feature (71)..(84): n is a, c, g, or t
  misc_feature (86)..(103): n is a, c, g, or t
gatcgtgcatttgaataccagtgaaatagtgaattaataaaatgagtgacaataannnnnnnnnnnnnngnnnnnnnnnnnnnncnnnnnnnnnnnnnnnnnngcaaccggctcaaaatggaggtgattcaactgcagccaaagaacttaagcctcgtccagaatttatcgataacaggttagcaatatgggataaattaaaagcccagtatgaagctgaattggcacaaaaaccagaagaatctatcaaagttactttaccagatggcaaaataattgagggtgtcagctggaaaactacaccatatgacattgctaaaggaatcagccaaggtttggctgataatacagttattgcaaaagttaatgacgtcttatgggatttggacaggcccttagaagtagattgtactttgcagttgttaaaattcgacgatgaagaggcacaagcggttttctggcattcatcggcccatgtacttggagaagctctggagagaatatatggtggttgtctttgttatggacctcccattgattctggttattattatgatatgttcttagacagtaaaggtatatctcataataaaaaccagaagaatctatcaaagttactttaccagatggcaaaataattgagggtgtcagctggaaaactacaccatatgacattgctaaaggaatcagccaaggtttggctgataataca

SEQ ID NO: 16517 - DNA, 960 bp, Diabrotica virgifera
ctgtaaaggaatcgtcaaagaataagtaatgtacgtatttttcccctttttgccatattctaaatttgaaaaaatgtatatggaataatcagaattttttgacatgccattcctatacagcgaacatttcattggctagaaactggaatatctaggccacataatgacaatggaaaagtactccctgctaaggctcataatccaaggaagaatctcgggaaagagaaatgtgggacgtagaaggattttttggttgcgaaatttaaggtagtggtacgggcgcagctcaatacaattgttcagagctacagccaacaatgttaagattggtgtgatggtagccaacccccgataggagacggtactgcaagaagaaagaagatgaccttacatttatagcaccaaatcaacaagaaatactagatctcctgcgaaaagttgagtataaaaccattaaggttgatcttaaaattaatcaagataacaccaacataatggtgataggcagattcaacaccactcagctgcttcggcttccactagctcggatctagtataatggcaataaatgctcgcgtaaataaagtttggaaagatagatcgttctctcaaattatcaagatgagtttggtgactgcaataattgtattctcaacatttctatactatatttctatataaacttggacttttctcatataagaacgccaaaattgatgcctttgagatgtagtattagatgctggacataccttggacaactcatcggaccaacgtttgcattcttaagtaaatgacatttaaagaaaggctgtccaaaacatatctgcaccgaatttgaacagttctttggggacgtagttcccaaaaggtgatgataatttccttctttttaccccttaattcctcccaggtttggaaaaaaaactaaagcccccgggtcccttccctttccccctt

SEQ ID NO: 16518 - DNA, 186 bp, Diabrotica virgifera
  misc_feature (12)..(12): n is a, c, g, or t
  misc_feature (15)..(16): n is a, c, g, or t
  misc_feature (23)..(23): n is a, c, g, or t
  misc_feature (25)..(27): n is a, c, g, or t
  misc_feature (30)..(30): n is a, c, g, or t
  misc_feature (58)..(58): n is a, c, g, or t
  misc_feature (64)..(64): n is a, c, g, or t
  misc_feature (102)..(138): n is a, c, g, or t
cttaaagcgagnagnncggcggncnnnagncgcagggagcgcccttccaccaaccccncagggnagaaccgcgcaggacaaagaagagggaacggacactcnnnnnnnnnnnnnnnnnnnnnnnnnnnnnnnnnnnnngagtgttgccgatccctgtcaagtcaaagttgtttttttaatttattt

SEQ ID NO: 16519 - DNA, 871 bp, Diabrotica virgifera
tttgtccgcctggcggacaaggatactatagtttgccccatttttacaacaaatatttgtttattgattacaacacagtgaaagatgtctcagtggaataaggagcaatatcctccacctcctggcggacaaggatactatggcggtcaaccgggatatggtcaaccaggctaccctcctccacaagccggctaccccccacagggcggttacccaccgcaaggcggctatccaccacaaggcggcggctaccctacggctccacagccgggctaccctccagcgggacctcaacctggatttcagccacctcctccgcagtacggagcagattacgcagcaggtgatgaacatgtacccttctctagtaacgccactgataactatggaactggttacaatggtggtgaagatcccgaggtgaaaggattcgacttcaacgacgcttcgattcgaagaggattcatacgaaaagtttattcgatactctcagtacagctgttaataaccttggccttcatctgttggttcgtctatcacgcgccgactagaaaatacgtccaaactcaccacgctttgttctacatttctttagtgatggttatagtggctttgatcgctttggcttgctgcggagagctgcgcaggaaagcccccgccaactacatcttcctgctgatattcactctggctgagagcttctgtctagcctgcgcctcctccacctacaaagccgacgcagtagcccatagcagtgggcataacggctgctgtatgtctgggcctgacactctttgcctttcagaccaggtgggaatttaccatgatgggtggcatactttttggtgccgttttgatactttttcctctt

SEQ ID NO: 16520 - DNA, 78 bp, Diabrotica virgifera
  misc_feature (10)..(52): n is a, c, g, or t
ccttgatgcnnnnnnnnnnnnnnnnnnnnnnnnnnnnnnnnnnnnnnnnnnnggtgctacttacgctctcaacgataa

SEQ ID NO: 16521 - DNA, 757 bp, Diabrotica virgifera
agcatttattagcaatcataattacatattatataagctaatttgataacaagtacaataacatatatcaatgtattattgtacactaaaatggcgttatgaggtacatcacccagcggtttcacctcagtttcagcgaagatctatgggccataatcttcgcaatcttctgttgtttagtggctgcagtaatggtaacattaattggttggggtggtcttccaatttctcgtgatgtctgttggctctttcttgaattactgtgctgactaacgggatgtttaggtctgtatgaagggtttggttggaaatgtaccacggggcatttgcgatggtgcatagaatttttgattgagttctttggataatttttgtgtttgatttgctggcacaactccatagttctataccgtacgtccatataggtttgatgactgttttataaatcagcagtttgttctcaattgagagtcgagattttctacctataagccaatttatttctttcactctcaactcaatttgtttcttcttctttaaaatgtgttgtttccagtttaatttagaatcaagatgaagccccaggtatttgacgatgttctgatggggtatgttgacttgattaaggctaatattttggggatttgggctttcctttagtgtgaaaagatatatgtgttgacttagtttcattagctttttattttccatttctttaaccacctgtccccaacttggtccacggggttttttcgca

SEQ ID NO: 16522 - DNA, 840 bp, Diabrotica virgifera
  misc_feature (239)..(260): n is a, c, g, or t
  misc_feature (778)..(798): n is a, c, g, or t
cttcgaccgcagacttagtcgtccatagaacaggggattaaactgttgatgatcgcagttctattcttgtgcatagtagttgcaataaatgcagttagcgagtgtccagactttcctggtgtaggagttatgaaagctggagaacagaaaccagtccaaggaacctgcaacattgccacctgccatgaagatggatctatttccatgttaacgtatgttttgaaaaaattacttcgtgnnnnnnnnnnnnnnnnnnnnnncataagtttaaaatgctttgcagttaaaaaacaacaaatgttggttgttgccaatcagatgtaaatctttaactttttacaattcgcgtgtttttgtaatataataatagtacattgtttaccgggtaggaaaagcttaacattcctggacgactgtgaagattgctaagtcgaggcgcaagccgagacttagcaacacagagtccaggaatgtggcttttcctacggggtaaacatactatttttcccaaatcgtttaaaattcgacagatattgattgatttaaaaaaaacgcgataattttattcccaaataaatggtgctttgaaattcctaataaaattacttgggttactatggaaacgcattgaggttgaattgtcaaacttgacgcttattaatttaattgctggtgttctccaaagtaaaatgataattgatgatgaaatttcccattcctgggactcctccagagctggttgaagcagtgaaatactgctttcattaaattattgccnnnnnnnnnnnnnnnnnnnnngaaaatgcttacagatggtttatggatattcccatgaataaa

SEQ ID NO: 16523 - DNA, 978 bp, Diabrotica virgifera
  misc_feature (384)..(405): n is a, c, g, or t
  misc_feature (714)..(735): n is a, c, g, or t
  misc_feature (787)..(808): n is a, c, g, or t
  misc_feature (863)..(892): n is a, c, g, or t
  misc_feature (894)..(917): n is a, c, g, or t
  misc_feature (945)..(962): n is a, c, g, or t
ctttagggtagtagttgaataagagggtaggatctttacggctatgaaatttatatcaatgaattctgcttcatttactgatgattgtgcaatggacttttattggggacaaatgaaatattttaggtaatttccatttaaaatatcttatttttaaaagccaccgccagtagataccatgaaacaacaagaaatgacagtaatgacaaccgttcatatgctcattctaaccagtgttgccatagttatataaaatgttttcttatgaaaaaaaattgacagatcatgaattaaatattttattcttaacaaaaaaattactagtttactcgtagatttggttgggttaggttattagattaaaacattttattcttacctacnnnnnnnnnnnnnnnnnnnnnntttgttggcagttttaggttagatatggttagatcatggttcggtggcagtgggaatgtcaagtggtagatataaacaccatagtcgattagaaagagatgcatactctatttacagtcatttttttcggcactggggaaaaagttttagattgcagcgcgcagtctagttatattttaaaagttaaaattggcaacagtgtcgaatgtagatacaactttactttacgcgcatgtccgccatattattttggtatcttgaaaattttaaacaataagtattatgtattttttcataattattatgttnnnnnnnnnnnnnnnnnnnnnnccttaatatgcttttgttggcttttcacgtaaattttgttttttggttactnnnnnnnnnnnnnnnnnnnnnnccctttccatattgcattccttggttttttgggcccttttaatttacaaagtttnnnnnnnnnnnnnnnnnnnnnnnnnnnnnngnnnnnnnnnnnnnnnnnnnnnnnnttttctccaaaattccccacaaaatgannnnnnnnnnnnnnnnnncctaacccctttattc

SEQ ID NO: 16524 - DNA, 716 bp, Diabrotica virgifera
  misc_feature (26)..(27): n is a, c, g, or t
cattaaaggattgcacgcaatggagnnatttcttagaaaagtgaacccttttatgtaacattttctccaaaattattaaatattgatagtaagaatattaatattcatgaaagttgtaaagataatccacatcgatctgaaactttggaccattcagatggccaaggttgtatattatctgaaataagtggtcaaaaagaggaaaacgaaatatttcctgattatacgaatggtgatgttagtgagggtgaagatttaatctcagtccatgatgtcagtgagggtgaagattcagtcacagtccatgatgtcagtgagggtgaacagatagctcccacatttggtggtcggtatcctaataggattagaacagctagaagggatgaagattttgagtattcatttctttctgttgggcctaatgacccaaagacctatgctgaaatctgtgaaaggtcagataaatccttatgggaaaatgctatggctgaggaaatagaatctttaagtgaaaataatacatgggaacttgtcgatagaccaataaatagaaacggtgtcaagggcaagtgggtatataaattgaaacatgcaatagatgggtctaaacgttataaagcaaggcttgtaacccacaaggttttcaccaaatccctggcaaaagaactatgaatcaactattccgccaaccagtaagtgaagaattgtccttcatt

SEQ ID NO: 16525 - DNA, 271 bp, Diabrotica virgifera
  misc_feature (16)..(41): n is a, c, g, or t
  misc_feature (139)..(157): n is a, c, g, or t
tccgtagaaaggcaannnnnnnnnnnnnnnnnnnnnnnnnncccctttaaagttaataacataaaggattttaactttcattataaaccagaagaggataaaatctaaaagaactaattttctttcctattgcaaatgnnnnnnnnnnnnnnnnnnntggcgaccaacatctaaggcaacttacctcacgctgattaacaacagtattaccccctattaattattccaactagactttgaataattcccctctcttgaacatgatttattg

SEQ ID NO: 16526 - DNA, 487 bp, Diabrotica virgifera
  misc_feature (29)..(29): n is a, c, g, or t
  misc_feature (31)..(31): n is a, c, g, or t
  misc_feature (34)..(34): n is a, c, g, or t
  misc_feature (42)..(42): n is a, c, g, or t
  misc_feature (71)..(71): n is a, c, g, or t
  misc_feature (77)..(77): n is a, c, g, or t
  misc_feature (102)..(102): n is a, c, g, or t
  misc_feature (113)..(113): n is a, c, g, or t
  misc_feature (124)..(124): n is a, c, g, or t
  misc_feature (135)..(135): n is a, c, g, or t
  misc_feature (142)..(144): n is a, c, g, or t
  misc_feature (165)..(165): n is a, c, g, or t
  misc_feature (178)..(178): n is a, c, g, or t
  misc_feature (183)..(184): n is a, c, g, or t
  misc_feature (194)..(195): n is a, c, g, or t
  misc_feature (215)..(215): n is a, c, g, or t
cggacaaggagaagggagccaccgccaanangcnggacaagnaggaaagggcacgcccccgggacaaaacncggaanacggaaaccacagaaccagggcccncgaccaagggncgccgcaaacncaccccccacncagacannnccaaacaccccccggacaaanccaacaacaacgncaacnncaacaagggnnagggagccaacaacaacaancgccccaacaacacccatctggagaatcccttcttgaagatcaaatgaacactaacccaaatcttgagccaaatctacagacaacaacctgggacaatcctccattgaaaccgttatttgggtaaaacatgaaaactttgcaaaacgggagaagcaaaggaatacgaaagtccccgaaagaaatttcggttaccggttcaaccttctccgaaaaaacctcttcccccaaacaagaaaactggattcaacccacagaaattggacctggaaat

SEQ ID NO: 16527 - DNA, 266 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(190): n is a, c, g, or t
  misc_feature (219)..(238): n is a, c, g, or t
  misc_feature (241)..(256): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnaacgaaaggaccaaatatataacaatacnnnnnnnnnnnnnnnnnnnnctnnnnnnnnnnnnnnnngtcggccgct

SEQ ID NO: 16528 - DNA, 592 bp, Diabrotica virgifera
  misc_feature (44)..(64): n is a, c, g, or t
  misc_feature (94)..(124): n is a, c, g, or t
  misc_feature (502)..(520): n is a, c, g, or t
agaagaggcgtcctgccgctttttttccggtaccgttttcatgnnnnnnnnnnnnnnnnnnnnnctcgagattattctatttgcttataagccnnnnnnnnnnnnnnnnnnnnnnnnnnnnnnncctgaggccgcacaattctgtggagtgcattagatgggtacagtttctttgtgtacgggaatcatagttattcgtatgtatcgtaattattgtggttattatagcgaccgtaaattaacaattcaattgttgctaaactgttcattcaatttccatcggcttcttgaattgtaatctgtacgaagggagcttttatattaccaggttatttaattgttcatgaacagttgcttatctaaaattttagttgaaaattaaagattttatctttcccgattaaatcgggaaaagacgcgtctctgtgcagaatttaattatggtgaatttttgtttgggtgttttggtgtaaagttgaaatctttggagttatagagcggnnnnnnnnnnnnnnnnnnnccatttttgggcgcccattttgtttcttaaaaaaggagcacactatctgcgcattctgtatgcctttattat

SEQ ID NO: 16529 - DNA, 684 bp, Diabrotica virgifera
  misc_feature (496)..(520): n is a, c, g, or t
  misc_feature (565)..(584): n is a, c, g, or t
  misc_feature (620)..(639): n is a, c, g, or t
ccttttccggctgaaggagactatcaattcgatatctacagatcgatgcaggagaaaaacagaaacaactggaaagactttgagccattctccaatctcttatggctacactacattctagacaaggcgattttgggtctaaggtacaaagccccgaaaagtaaactccacaagacttacttaagaaaactcaaaaacgtaaaggatgacattttgtcctatcacaatgtcaaagattttatagttgctaatttgttagacatataaattaaaagtttgtattttgttatatattgtgtgttatttttttttacatacgtaaattaatgtttagataaggtagctagatggagaataaaagtaaaaaatcttgaatttcgttttatcatacaatatcaagtatcaaattttccgaaaatttttagtggattgattttcgtctgctagtttatgattgaagaaaaatcaatgtaactaggttccaaaaatttatttnnnnnnnnnnnnnnnnnnnnnnnnngattacaataacatatctgtataaaaaaatatgtaaaacattgcnnnnnnnnnnnnnnnnnnnntatgaattaggtgagcaaacttagccttgatatggnnnnnnnnnnnnnnnnnnnntgcttacccaacgtttgattatattagtatatagtgtatatttat

SEQ ID NO: 16530 - DNA, 484 bp, Diabrotica virgifera
tctgtccggttagatgcgagcggccttactttttaaggtaaatttaattttccatggaaaacatattgggaaggaaaggggtaagaattttttcccctggatatccggaactactccaaatccataccccctggcattaaaaaaagaattgaattttgattcctggattaatggcccctataaccatggattccaaaccgaacccctaacgggtctaaataacatcctccacaaaaaaccactttaccgggaattggaaagaagaagggtccttccttacctataataaaaaaataaccctggcagctaatttaataaatttcctaattcctggataaatggtatattggaataatttccataaaatttatcctggaaaataattggcctggaatggaaccaaggcctaaattaccttttggttggaattcctggtccatggccgaatattcaccaaataaaacacgacaaaaggttttcgtga

SEQ ID NO: 16531 - DNA, 695 bp, Diabrotica virgifera
  misc_feature (391)..(409): n is a, c, g, or t
tgtaaacatattcaaaaatatttcaaaaataatatcgaatttatttatttagaaattaatgtcataataatgccagaaaaaatggaaacagaaagaccaacattaaaatatcagaacttttctgaaaaatttggtgaacaaccagaagactacaacagacagtattgtagtatatatttggcccgtttaaatgaaatggaaataatacttaaaaactcaattaagcataaatggggtgatacttatccaatcataaaactgcataaattaacggaagaagacaaagataagtgtatagtaataggaactctctttaaagatcagaaactaaaaccctcaattctcaaggagttgtctgaagctaatcaactcgtggcagaaaccaatcccnnnnnnnnnnnnnnnnnnncagatgattctgataaattatttatagaggatgaagttcaaaggtatgagatagatggtgttcctttaagtgatgtagtaaccggaataacaattgctcttctagggtcagatgctggtaaagggaaatttatagctgaagattatgtgtttgcaggactaagagaacaaatagaaaagcctttatttcaggaggacaactacatagtatttttaagtggcttaaatcttatcaactgtgaaaaaataatgtggaaacttggaattggttaaccatttcgggttga

SEQ ID NO: 16532 - DNA, 971 bp, Diabrotica virgifera
  misc_feature (86)..(105): n is a, c, g, or t
  misc_feature (657)..(677): n is a, c, g, or t
aacaataaaaaaatagtttaattgtttactaaatcttacacctatcttttaattgtgaaagtttataataaaaacggataaacacnnnnnnnnnnnnnnnnnnnntctcaacaatatttatagtttatttttttacgaaaacttcctaaagtacgttcgctcaactctgacgcattttgacaaattcagagttaggaaatattgaaatatacaacacaaaaattcctgcctcatactattaacagctcaaatatacttactctttcattaaaaaagaagaattattagaaatagtatgtatactaaactcataccattttgtggaatttatttcctcaaaatgtttttattctgtacaataaataattttctcatttgttatcaacacattataatattgtgtcaataaataattactgattagagagattttgcaccacttattttgcaattccgttatggttatcgttgtactacgtctgcgcagtagcgaatatatgatccgatatcgttattaaacataagggattccgtaatttacggaggtttaaagtagtgcttatcgttatcgttatagtaatggttaaattgctttgttgccagaatgtaaaaaaatcagtaaaattacatttacatagattctaattttgattaccnnnnnnnnnnnnnnnnnnnnnctgttcaactatatgcttaaaattacaataaagttgtgaagtgaggttatgtttaaataacgataaggatgacacgaaaaacctacttgacaggctgcaaaactctgctttttaacgttgccgtaatcgttatgcttaataaagtttaaccatagcgggagccaaaatcagcgggttatttcaagaggtgcaaaatcctctctaagggcttaagaattatgttatttagggtttgttaactcctaaaagggggttttccttcgaattgtcctttgctttttgagctttccccaa

SEQ ID NO: 16533 - DNA, 728 bp, Diabrotica virgifera
  misc_feature (11)..(36): n is a, c, g, or t
  misc_feature (61)..(92): n is a, c, g, or t
tttcgtccgtnnnnnnnnnnnnnnnnnnnnnnnnnngggtaatcatctctaaatacaatcnnnnnnnnnnnnnnnnnnnnnnnnnnnnnnnncatttcgtgctcaaggaagcattcgtcaagttgttaagctcctttaaaatatcagtcatctgaagctctccattagtcttatttctattggaagaatttataaaagttttatttcttaagtgagtgagtcttaaatttgtcagttttctttcttgcaacggtagtttattagtactaggttgtgcctgaagactccgttcaggaattttgaatgtagcgtttcggacagtagtcttatataaaatactgcggccttttaaaatatcctcgcccctagaaataatatggtccaggaagacatttccgaatattggttttgaggcttgttctaaagtagttttttcaacatgtgacacgtctttactacacaaactttgattttccgtattctcatccgcaaaacacatccataagtttttaattgaacaaagaagaattttacaacgcttaataatccgtaaatggctgcttctttcgtcgggtaacacatcaaatgctgtttttacttcgtttaaaacagatttaaaaatcagagtaagcgattttaatttcactgacatttgcttctggttgaactccataaccatttccataaattgtccaaaattctaaattggccgaaaggtttttaaataa

SEQ ID NO: 16534 - DNA, 377 bp, Diabrotica virgifera
  misc_feature (30)..(30): n is a, c, g, or t
  misc_feature (73)..(210): n is a, c, g, or t
ctaaggggaactggcgaagaggaagggagnagggcgctttccttttgttgcactcagcggtgctctaccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccgataggatccaaagggggagaacaactgaggaaatgtgaaaaagtagcgaacgtggtgcgccgtaggtgggagttgaaggggatgaagatgaaatagaggttgcagacgaagaggtagtacagggtgagggcgttgaagaagattatgttgatgacgcataa

SEQ ID NO: 16535 - DNA, 393 bp, Diabrotica virgifera
cccgttcgaacaacaatgatggctgctaaattaatttatgtgtccagtgtaatctacctctgtatcgctacatgctatggagccatcccagatcctcctatagaggtagaaataactacagatggtaaactggacaacagaattgactcacgaggtccttttgaaagtatgcttaaatcgactgataaatctcatcaaacattctgtcccgaagtttgtcaaaatagttactgcaagaacttagttggagtgagtaaagacaaatcttgtccgatcaaaaggctaccagaaaggggagagcgaactcctaaaaattgtagggaaatttttgaaacagggaataatgtctccggcatatatgacacattaccccaccacagcctaaccccatta

SEQ ID NO: 16536 - DNA, 89 bp, Diabrotica virgifera
  misc_feature (28)..(28): n is a, c, g, or t
ctcgtgcggataacagatggatgaatcntgaggagaatcccctttaggtctttaggaaaactggatgacagagatttgaacaatctatt

SEQ ID NO: 16537 - DNA, 208 bp, Diabrotica virgifera
  misc_feature (26)..(26): n is a, c, g, or t
  misc_feature (30)..(30): n is a, c, g, or t
cctcaagcgaacggaggacatccggnaggngagagggaaccccttttgaatcaaatttggagaagataacgatggaaacccaaggtgaggcaggtttgatggagatggttacttcttccctcactggcaacagatcatcaactgatacagtttacagggcagaaaaatgaaacccacactattgttaataatcgctctgataacatgc

SEQ ID NO: 16538 - DNA, 149 bp, Diabrotica virgifera
  misc_feature (29)..(29): n is a, c, g, or t
  misc_feature (70)..(88): n is a, c, g, or t
  misc_feature (102)..(127): n is a, c, g, or t
tctaaaccgctaaatttaaataatttagnaatggaggggatcccttttaagaccccaacattgtatatgnnnnnnnnnnnnnnnnnnncaataaaggaatcnnnnnnnnnnnnnnnnnnnnnnnnnnccacaacacgccatcatggatc

SEQ ID NO: 16539 - DNA, 1255 bp, Diabrotica virgifera
  misc_feature (452)..(474): n is a, c, g, or t
  misc_feature (706)..(706): n is a, c, g, or t
  misc_feature (731)..(750): n is a, c, g, or t
  misc_feature (932)..(949): n is a, c, g, or t
  misc_feature (960)..(995): n is a, c, g, or t
  misc_feature (1020)..(1040): n is a, c, g, or t
  misc_feature (1043)..(1057): n is a, c, g, or t
  misc_feature (1080)..(1099): n is a, c, g, or t
  misc_feature (1150)..(1186): n is a, c, g, or t
  misc_feature (1206)..(1241): n is a, c, g, or t
tttgtccgaaaacgaaaatttttgagttatttgcagaaaactgattaaaagcattgattttttcgatataaagcagcactttcgatagcgagtgggtcgagaactgttaattttatcaaaaaaatgtgtgggaccttttttgcttataattaatgtttttaccaacttttgcggtcaaagtgtaatgaagggttgccaccccgtctcggggtggaaattttttattacgttctgaccgcaaaagttgataagaatattcattctaggcggggaacgttctgcacattttttttgatagaattaatagttttcgatttgttcgctatcgaaagtgttagttttatatctaagaaatcaatgtttttctatggtatactcttttacgattcactcaatatttgtcgtagaaaaaattttttcaaaccaagttcttgggaattaaataacctacnnnnnnnnnnnnnnnnnnnnnnncgtagctgtgatgccaatctttctattctgaagagaatggcattttttaccaaattataaaaattctttattcgctttaaactccagttttttaaaaactagtcattctaagccagttagacttctagaatctattaatattacatagataaagaagaatgaataaggccagtgactaaaatcactgctaacctacattattatgcttcaattggatttctcctttttttcnaaagaatatattgatttttaaccgnnnnnnnnnnnnnnnnnnnncttaaaaagtttggtaaaaataattttgtaggtttttacaagatctatacggctattaatattaaatacttttaaaatcctcagccacaaaagaggtgacattgaaagggttggtaaaggtggtttttgcatgtgattaccagttttaattgtccatagctccctcaatttttggccgcagnnnnnnnnnnnnnnnnnnaatttcttggnnnnnnnnnnnnnnnnnnnnnnnnnnnnnnnnnnnntctcctgatggctattcctttctannnnnnnnnnnnnnnnnnnnnccnnnnnnnnnnnnnnnctcgtttattcccctttttaacnnnnnnnnnnnnnnnnnnnnctaattctttttaaagcccgagggcccgatctacaactttctaaagagccnnnnnnnnnnnnnnnnnnnnnnnnnnnnnnnnnnnnncaaacccagggccacagggnnnnnnnnnnnnnnnnnnnnnnnnnnnnnnnnnnnntttttagggggggg

SEQ ID NO: 16540 - DNA, 302 bp, Diabrotica virgifera
  misc_feature (27)..(27): n is a, c, g, or t
  misc_feature (30)..(30): n is a, c, g, or t
  misc_feature (33)..(34): n is a, c, g, or t
  misc_feature (43)..(43): n is a, c, g, or t
  misc_feature (57)..(57): n is a, c, g, or t
  misc_feature (60)..(60): n is a, c, g, or t
  misc_feature (62)..(63): n is a, c, g, or t
  misc_feature (65)..(65): n is a, c, g, or t
  misc_feature (74)..(75): n is a, c, g, or t
  misc_feature (77)..(77): n is a, c, g, or t
  misc_feature (81)..(81): n is a, c, g, or t
  misc_feature (113)..(114): n is a, c, g, or t
  misc_feature (117)..(117): n is a, c, g, or t
  misc_feature (119)..(119): n is a, c, g, or t
  misc_feature (127)..(127): n is a, c, g, or t
  misc_feature (129)..(129): n is a, c, g, or t
  misc_feature (136)..(136): n is a, c, g, or t
  misc_feature (143)..(143): n is a, c, g, or t
  misc_feature (146)..(146): n is a, c, g, or t
  misc_feature (149)..(149): n is a, c, g, or t
  misc_feature (152)..(152): n is a, c, g, or t
  misc_feature (174)..(174): n is a, c, g, or t
  misc_feature (179)..(179): n is a, c, g, or t
  misc_feature (185)..(185): n is a, c, g, or t
  misc_feature (221)..(221): n is a, c, g, or t
  misc_feature (239)..(239): n is a, c, g, or t
cctacccggggggacgacgatgaaggnatnagnncggcgggcnttctttgaggcagngcngnncnaccaacccnncngggnagaaccgcgcggggcaaagaagaaggaacggnnacncncattgacncnagagganaccaacncgnaanccncaagaggggggccgagcccagncaagncgaagnaggccgcagaaggccaaacacaagaacccagaggcnccaagccggggaaccacngagaacgggagaagccaccgaccgcacccacgcaggaggcacacggaaccaaaacaacaacca

SEQ ID NO: 16541 - DNA, 415 bp, Diabrotica virgifera
  misc_feature (2)..(23): n is a, c, g, or t
  misc_feature (45)..(84): n is a, c, g, or t
  misc_feature (102)..(133): n is a, c, g, or t
  misc_feature (149)..(204): n is a, c, g, or t
  misc_feature (217)..(266): n is a, c, g, or t
  misc_feature (269)..(320): n is a, c, g, or t
  misc_feature (324)..(372): n is a, c, g, or t
  misc_feature (377)..(402): n is a, c, g, or t
gnnnnnnnnnnnnnnnnnnnnnngaaagtaattaagattgggggnnnnnnnnnnnnnnnnnnnnnnnnnnnnnnnnnnnnnnnnaccctggggatccgggannnnnnnnnnnnnnnnnnnnnnnnnnnnnnnnccaaattaaaaaaagnnnnnnnnnnnnnnnnnnnnnnnnnnnnnnnnnnnnnnnnnnnnnnnnnnnnnnnngaaaggtaatccnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnngagnnnnnnnnnnnnnnnnnnnnnnnnnnnnnnnnnnnnnnnnnnnnnnnnnggatnnnnnnnnnnnnnnnnnnnnnnnnnntaattattacttt

SEQ ID NO: 16542 - DNA, 787 bp, Diabrotica virgifera
attaaagtgaggtaaaacccgataggagactcatttattattttcgacaacaaaaatagtgtttgtagacgtgtaaatagatgtgtatggtttacaagatgttgaattttagtgttctaaaggaacatagcagtctagcacctagtcaagtttttaatgttttaacaaaagggttgaagaaattgggagcagattctttttcttctcaagaaagcgtggaggattcttttaaaaagactgaagaggatgcagaggtcttaagatctttagtcgaaccgttgaacgaccaaataaaggccctgaaagagaaactgagagctacagatgagcagttacaaaaatgtagagaatgtggtcatagacaagatgagctaaataccagcgagcaatccccccaccataccaacctaaacgccaccactgcaacgaatacatcgttcgagtccaacaggctgttcatttgcgacatgtgcagcaattacgaggctcagttggtgagggaacagaagatctccaaagaactggagaccaaagtaacggcggctgagaaagcagcggagcggcataaggaagaactcctcaaagagatcggatttaggaaagatatggaggaaaagtggaacgagaaaaaggaggagcataagagacaggtggcagaactaacacggacaacagaatgtacagagcaagattctgaatgagctgcgccaggtttttaaacagacatgttcggagatgaaaatgagtataggaaaaactaacacacgaacggggaactggcccttca

SEQ ID NO: 16543 - DNA, 512 bp, Diabrotica virgifera
gatcctaagaagttcgtcaaaggcaaaggacaaattcgcgtcagcctgtctggacgggatcttcttagcccggatccgaacttaccacacatcggtccaaggtttccacctgcaggaagcgaaccagaattccggtcaccaagagtcaaattcttatacgacaaatggcgtcacgtatggatgctatcatgggaaagacaaagagaattgtacgatcatctggcttatctgaaggaaaaggaaaaggccgacaacttctcttgggacgattggagaaaacgcttcttgaaattcatgaattacaagaagtccaggttgacagatctctttaggaagatggataaggataacaacgaactgattcccagagatgacttcattgaaggaatcatcaagaccaaattcgacacctcccgccttgagatgaaacacgtagcagacatgttcgacgagaacaaccgaagactgatcgactggaagaagctcctagcacctctcagacccgattggca

SEQ ID NO: 16544 - DNA, 498 bp, Diabrotica virgifera
tctcgtgcgggacatattaatgttaatacatgaacaaaaatcacattatatacatttgttataaacatattacgatgtgatcgctgcaataagttccttttgtcattatatattgcaaaaattacccttatcttcaaaaaactgcttgtttcactgatgttagagtcttactattctctaactgtttctccatagatcactgtggctgttaaaaatgttctatatttacaaccagttaattaaattagagcgagaacaaataagtggaagtttaaatttacgttctactttttctcatctagaccattgttaattgcttttaacatgcaccaaaaaaggaaattaaaactgcgctgcatttaaaactgaaattgtcatcagtgtaatttcttgaggttatgaataattaataatgtacttcaacgtcaaaaaatgacgccatcgtaatgttataactagcaagctatacatacttaccgccctccacaccgtaacgta

SEQ ID NO: 16545 - DNA, 207 bp, Diabrotica virgifera
atttgtagtaaaaataatagatttagtgtgttcaaatgactgcgaaataaattcacgggaattattaggaatgtgacagtacagactccttttatagtaaaagtgaaaaagagcagagtgtctgtggcggctatctggtgacgtttctctctgaacctgtgcctcgaccctcgaccttgtaaggcctatattgatcatcttctagga

SEQ ID NO: 16546 - DNA, 488 bp, Diabrotica virgifera
cttcgtccgctggattgtcaccacaattgtcacatttgctacctggttcttcgaaaaatgaaaaactcaaaagttctgtactgtctgccttacaatttttcaatgagaatttgcagaaccccaactttttggttaagaattggttgactgctgtagaaatagctatttggggtactgaatgagatcccagacaatcggacggagatgagcaactattgtaactagaaattaggaaattaccaaagagtggagatgcggccggttgtacaatactagcacaccagttagagcagcttcgtaaacagaaacaacaaacatacacagctgcccgcaaagctcaaggaatagcgacctattatcttatctatgggagctattgctacacccggccagggcgaggcccaccccccaaaacacccttgccccacatgacccaaatcctgacctcttctacatttatcctttacttttaatgcacgtctctacag

SEQ ID NO: 16547 - DNA, 199 bp, Diabrotica virgifera
  misc_feature (2)..(135): n is a, c, g, or t
  misc_feature (146)..(175): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaattcacnnnnnnnnnnnnnnnnnnnnnnnnnnnnnnccataaatattttacataactttt

SEQ ID NO: 16548 - DNA, 311 bp, Diabrotica virgifera
  misc_feature (26)..(26): n is a, c, g, or t
  misc_feature (29)..(29): n is a, c, g, or t
  misc_feature (31)..(31): n is a, c, g, or t
  misc_feature (48)..(48): n is a, c, g, or t
  misc_feature (106)..(106): n is a, c, g, or t
  misc_feature (145)..(145): n is a, c, g, or t
  misc_feature (161)..(161): n is a, c, g, or t
  misc_feature (178)..(178): n is a, c, g, or t
tctagggggcgcatcgaagagagcgnacngngggagcgagcactattnaggcaagacaggacagaaaccaaaaagagggaaaccgagcacatccaagctggacaangcggcaaccaaacaggagccaaacccagggaaaccatcnccgaagaacacggaancgaccccaccggagccnaccagggagacccagaccgccaacgagaaagaaacaacggcaacaacaacgaggcccccggcggaaaagacgcaccccgcgccatccccggcgactcggaacccggcaccatggattcagtaacgtcgggccc

SEQ ID NO: 16549 - DNA, 679 bp, Diabrotica virgifera
  misc_feature (60)..(661): n is a, c, g, or t
cagacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttttggacgctaact

SEQ ID NO: 16550 - DNA, 275 bp, Diabrotica virgifera
  misc_feature (16)..(16): n is a, c, g, or t
cctcgggggaaccagngcgaaccggggacagcaggggcagccctttgcaagagaacaaacgagggcgcaacacgcacaaagaaagcaaaaacgaaccaaacaacacgcgcgaagaacaacgcgccgcaacagccggagacaaaggacccgggaggcgcaaagccggggcggccggggacgaagcaccccaaggccggctggcgacaaagggaggaggcccacaacaaccggccgacccaagagccgcgcgacccgaaaggccaaacgcccgcgac

SEQ ID NO: 16551 - DNA, 674 bp, Diabrotica virgifera
  misc_feature (8)..(44): n is a, c, g, or t
  misc_feature (47)..(517): n is a, c, g, or t
  misc_feature (519)..(533): n is a, c, g, or t
  misc_feature (536)..(551): n is a, c, g, or t
  misc_feature (569)..(589): n is a, c, g, or t
ccttgtcnnnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnngcnnnnnnnnnnnnnnnnacattcacaaaattggannnnnnnnnnnnnnnnnnnnngttaataaagggattccgcaacattttttcccctgtttataaaaacatgtccttttgtcataaataataagtctcccccgccccc

SEQ ID NO: 16552 - DNA, 465 bp, Diabrotica virgifera
  misc_feature (24)..(24): n is a, c, g, or t
  misc_feature (54)..(54): n is a, c, g, or t
  misc_feature (57)..(57): n is a, c, g, or t
  misc_feature (63)..(63): n is a, c, g, or t
  misc_feature (78)..(78): n is a, c, g, or t
tcttgagaggcgaagaaccaaggnacaaagagacgaggaacgcctttaaagagngancgaccnccaggcaaggaaagnccccccacagggcaaggcgcccgcgacagggaaaaccggatcaacggcaagggcatcacggaaggggaaggagaaacgcacacggacaagaccgacggaccgccaccacacgggcgccccagagcaggcacccccgaagaacagcccacgccacccgccgcaacccgcaacacggcgcgccacgcacacgcccccccccacccgcgaccacagaccacccgccccaaaccaccccacgccccacaccgcaccccaccccagacagggaccgccacgcaccaccacaccacaccgccccaccaacccgccaggcgcgccaagcccccaccgcagcgccccccgaccgcccacccccgcccccacgcccagacacaggccacacgcccc

SEQ ID NO: 16553 - DNA, 295 bp, Diabrotica virgifera
  misc_feature (36)..(65): n is a, c, g, or t
  misc_feature (276)..(276): n is a, c, g, or t
  misc_feature (279)..(280): n is a, c, g, or t
  misc_feature (282)..(283): n is a, c, g, or t
catgtaacaacgtgtattaactttgaaaacagtgcnnnnnnnnnnnnnnnnnnnnnnnnnnnnnnttaacctacttttaaagatatctaaaaagtaggtgattttgtacaccacctatttctattaatctttctatgttatattttattgcagtacgattattactatccgaagtaatttactaaatttgtgaatccgtgggagattgaggttagaatgccagattcttctgcttggggttgaaacactggcctatgtaatggaggggagggttgntanngnncttctttcctct

SEQ ID NO: 16554 - DNA, 261 bp, Diabrotica virgifera
  misc_feature (26)..(28): n is a, c, g, or t
catagggggcgtcagacggggaggannnagaagggggggaaccttttattgaagaagaggaagagacgggcgaagaagacgtagctgaaggggatgatgaagaaatagaggctgaatatgcttacgatgcacaggccgagggtgtacaagaagaagaggatgatgacgcttacccacgtggccgccgcctctccctgtgtcccttactcgccgcactatcccagcgacacgtctccagttatcttgcggagcttttatctc

SEQ ID NO: 16555 - DNA, 371 bp, Diabrotica virgifera
  misc_feature (50)..(50): n is a, c, g, or t
  misc_feature (52)..(52): n is a, c, g, or t
  misc_feature (101)..(101): n is a, c, g, or t
  misc_feature (160)..(160): n is a, c, g, or t
  misc_feature (162)..(162): n is a, c, g, or t
  misc_feature (170)..(170): n is a, c, g, or t
  misc_feature (202)..(202): n is a, c, g, or t
  misc_feature (281)..(281): n is a, c, g, or t
  misc_feature (300)..(300): n is a, c, g, or t
taaaagggcgccggacaaggaggaacaaccgggggggccccttttgccangnggaccggggaagacacgcaacagagcgcgaggacgaaaggggggcacangccggcgcctcgcaggagaaacccacccacagacacaaggaaagacgaacaggaacgcngnagcaccancaaaccaaccgccacagccacggcacccgagncagacgacaaacacccggcgcccaccaccaacgcggacccacgcgagaacgacgcgaaacgccccccgaccacccccanagacccccccgcacaccangcacccccaccacaagcaacacccgaccccccagccaccgacggcccccccccaccccccacccccgcacc

SEQ ID NO: 16556 - DNA, 317 bp, Diabrotica virgifera
tcttgtccgaagatttttcgtaccttgtgtataccgaaggcatctaattttataccagatttgctccatggaccatgagcaatgtcgaaggacattactaggaagcatgagggagactaaaagtagaagctgaactacctggatctctggtagcggtagaggtggtaacataagaccttccatttgcactagaggcacgtcgagagtccagaggagtggtataatatagatgaggatgtagacaatattatagagggacagaataaaacctttgtacattacgtggtagagcgcaatgattataaaatagacactgt

SEQ ID NO: 16557 - DNA, 1136 bp, Diabrotica virgifera
  misc_feature (110)..(130): n is a, c, g, or t
  misc_feature (176)..(200): n is a, c, g, or t
  misc_feature (582)..(605): n is a, c, g, or t
  misc_feature (680)..(698): n is a, c, g, or t
  misc_feature (895)..(913): n is a, c, g, or t
  misc_feature (916)..(930): n is a, c, g, or t
gaacgagtctgatattacgagaagagcgagcgtagcgagcgaggcgagtaacagacgagttcgataaggagtctttactgacgtggtatatacaaaattttatcgccaannnnnnnnnnnnnnnnnnnnngtcgtccgaaccactggggttataaacgacaacaatgaataatacnnnnnnnnnnnnnnnnnnnnnnnnntattaagtaaatacgtaatatatactaacaaaaagtatacctgaaagatttgtgatacaattaaatgtcttttattcctatttccgttaaaaactgtatgatattgttgatatttgtattgtctctaagaagctcagatatgtccctgggaaggttgagtttacttcccgtttgctggtatatttgacaatcggttaagatatgttttattgatataaaataatatttgccaaaataatttgatattggttttaccacttgggtacttggagtttacaatttaagaacattttaaattttagacgtcataataatttcatgacagtgatgacagataacttgcaagatggccgctttcgatttttaatatactataaatcgnnnnnnnnnnnnnnnnnnnnnnnngaatataattacaaaatactacagaatttcactttttgacataaatttaattggtaatatcgcaaattgcgtacnnnnnnnnnnnnnnnnnnngtaaataaattgtaagtccactcaaatactcgccattcgattacttccatcgaccacttacattcaatctaagctaatttgattaatcgcggcaggtaaagtaaaattcttctttgagtacaataaagtgttactttactgccgcaaatgagggcaaatgagtacaagattgaatgactttagtgacggttgggcgnnnnnnnnnnnnnnnnnnnaannnnnnnnnnnnnnnttctcattttttcttcacacccgtgcaaaaatttttgaaaacacttttcttggttttccccaagggggtttaaatttttttcctggttttaatggaaatgaaaaatttcaaattctttgggcttaaggaaagggtttcctttttttaatttaagtaattttacccagcaaaattttaccaaaattgggttttaatattgtggccaa

SEQ ID NO: 16558 - DNA, 863 bp, Diabrotica virgifera
  misc_feature (717)..(732): n is a, c, g, or t
atatttttcgagatgaaggtgattttgatttcgctcctgcttggtttaagcttggcagaagatccaatcaacaataaaaaatttcctgatgactttctattcggagtagcaagttcagcgtaccaagttgaaggagcgtggaatgaagatggaaagggagaaagcctttgggatcatagagttcatactgatcccaactttattgaggacaattcaactggagatgtcgcctgtgactcatatcataaaataaaggaggacgtagccattttaaaggaactaggtgtcaaccattatagattttctttgtcttggacaaggattttacctacaggtctcgctgatgaaatcaatgtaggaggagtaatatactacaaaaatctgatcagtgaacttaaggccaataacattataccgctagttaccatttatcattgggacttaccacaagtatttcaagattatggaggttttttaaacagttccatcgtcgattggtattccaactacgccagagttgttttctcactgttcggtgatgacgtcaaacactggatcactatcaacgaacctcagcagatctgctctggaggatacggctacggatatttccctccgacaataaaatctgaagatttgctggaatttcaatgcatacacaatcttgttaaggctcatgctaaagcgtggcatatttacgatgatgagtttaggtcnnnnnnnnnnnnnnnnatttctattacacttgacacttcttcctatatcccagcatctaataagtctgaagacatagaggcagctgataggatgcagcactttacactaggtgtatatgccaatccctatttacgttggagactatc

SEQ ID NO: 16559 - DNA, 199 bp, Diabrotica virgifera
  misc_feature (7)..(30): n is a, c, g, or t
  misc_feature (40)..(40): n is a, c, g, or t
  misc_feature (66)..(66): n is a, c, g, or t
  misc_feature (80)..(102): n is a, c, g, or t
  misc_feature (116)..(116): n is a, c, g, or t
  misc_feature (135)..(135): n is a, c, g, or t
  misc_feature (170)..(193): n is a, c, g, or t
taacagnnnnnnnnnnnnnnnnnnnnnnnntcgataatanagattgcgacctcgatgttggattanagtttataattggnnnnnnnnnnnnnnnnnnnnnnntgttcgacttttanaattttacatgatctgagnttaaaccggtgtgagccaggttggtttctatcttnnnnnnnnnnnnnnnnnnnnnnnngaaagg

SEQ ID NO: 16560 - DNA, 939 bp, Diabrotica virgifera
  misc_feature (433)..(499): n is a, c, g, or t
ggacattacaatctgatcaaataatgtgatcaatgagcaacttatttctaacctaaattactactaaaaacttaagaatagggacaaactcaatagtaccccttaggttctgttaatatattgcacaaattttaacttgtaccatcacttgcaccgtgcactatttttcacttcaataactcgaaaggtttcttcatcttgagttttctagctagatccgtgttgtcgaggagctggatggcctcaacattgacgtgttgaagaagtcgttgttcgtgactcttggcaaatttttctactgcatcttgattgtaaatttagtataacttttattacagttacaatcattaaaattacgtttatcaatttaacgacccagcatcaggttaaacatttttaacacaaaattggagagaagtcctttgtagaaggnnnnnnnnnnnnnnnnnnnnnnnnnnnnnnnnnnnnnnnnnnnnnnnnnnnnnnnnnnnnnnnnnnncatcacacctcattacagtaaacaattctgatatcaaatcacaaattattcactaccttctaattttacacatattgcttgttttccaatacaccttcatacatccatccagttttaaaccttttcaattcaactcgataacttggtataaaaaatagaaaaaatccctatttcataaacatgtttagccctagatgcttatgttacataaaaggacctcatacttttgccaggttattagttcaattgatattcttcttcacttccaatatcaacactcaggtaccttaaccaattaattcacatatcattatatcatatcagtttcctcctgtgactcatacaacttatcttaatttcaacactactttaatatcagactttcatttaccacagactctctaatttactctgccatgggtacaattaaaccaaacact

SEQ ID NO: 16561 - DNA, 662 bp, Diabrotica virgifera
  misc_feature (559)..(573): n is a, c, g, or t
  misc_feature (603)..(627): n is a, c, g, or t
gcaattggttcacaattattgtttatgttccatactgaattatttttttatcttggacacataataccacgtcctccatcaattcggaaattatttccagttacgaaactagcatcagtacttgccaagaaagtgataccggaagcaacttcttcagcggtacctgcacgtccaagggcatgtgtcagtctacttttttccaagaaggctttgtactgctcgtcattaagccctgatcgtttgtgcaaaatggtgtcgatgactcccggattcacgctgttgcatcttacttgttttgaagccaattccaaagcaacgcatctggtcagttggtctaccgctgatttggaaatgcaataagctagcacacctggaaaagccctcaaaccagtaacgctgctaatatttacaattgctccttgagttttgatcagatgaggtgtacaaactctaatcatttcaaacatacctggagataccatcgaggaagtcgtagctgagattttccaattttcgacgccactggtaatcgaatgtgatttgactgattccaaacatnnnnnnnnnnnnnnnttaaacagaccgtaaagcattttggaaaannnnnnnnnnnnnnnnnnnnnnnnngtttttggataatgtataccttgaaaatacaactt

SEQ ID NO: 16562 - DNA, 416 bp, Diabrotica virgifera
  misc_feature (2)..(21): n is a, c, g, or t
cnnnnnnnnnnnnnnnnnnnncaaacaatatggacaacaatcaaatcaacaaggactacacggttatggcgaagatgacttaggaggtgttgttggaggacataacagtcaacgtaacgtaaaagtagtaaaaaccacacacaccagtggcagctacggatctggccaacaacaaactggtcaagaagctttcgaagacgctgatgaagatgttggaggacatagtgggcgtatcgttaaagtagttaaaaccactcataccagtggtggctatggatctggtggacaggaacaactcggtcaaataaaatcatatctgaggagagaaccactactaacaggacaacaagcttttgacgaacaatattaaggtgaatcagtgcattctggaagctcctctcgtatcggaaaaacta

SEQ ID NO: 16563 - DNA, 591 bp, Diabrotica virgifera
tcttgtccggcaatttgatccactaaattaattgagtaggcatactgagctggggcagcgtggtaggccaaagatggcgcagagtagctgcaccattagccaaggcagtaatcgctgaagacttcgaccacaacccacaatactctttcggttatgatgtacaagacagcctgaccggagacagcaaaagccaagttgaaaccagaagcggaaatgttgtacaaggttcttactctttgaccgatcccgatggcacccgccgtaccgtagactactccgccgatgacgtcaacggtttcaacgctgttgtccgcaaagaaccattggtagccaaagccgtagtagccgccccagcagtagccaaactcgcagctccagcagtagcttacgccgcacctgtagctaaactcgcagccccagcttttgcttaccaggctcatgctgctcctgccctcgcctactctgcaccattagctaaatacgctgcccccgctgtagcctacactgctccagctggatcgaaatactccttacgctgttccagctctttccgactcagcattcactgctcgcagctcgatcttacggcgt

SEQ ID NO: 16564 - DNA, 436 bp, Diabrotica virgifera
  misc_feature (185)..(202): n is a, c, g, or t
catttaaaattggggaaaaaagttctttgggtaaaaaccgaaaaagtttttaccggggaggactcgggggaaacctttccccccccaattggtcccccaggggttttaaaggaaaaggggatttttaggggatccaagggaaaaaaaacggggatgggggggggttccaaaattttggttatggnnnnnnnnnnnnnnnnnngggggccagggatcgggatcaaaagttaaaaaaatgggaccgaatttaaaaagaggattaataaggggggtttcggttctagaaaaatttacaaacccccggggggaaaaaattggttggggaaccttttgggaacggccccggttaccggggtatttaaatttactttgggggggaaaacgagggggttaaaggaaataaaggggatcgggaataaacccccctttggttccc

SEQ ID NO: 16565 - DNA, 493 bp, Diabrotica virgifera
tttattaaccacaaaagacagcatgcgcgatcacttttttgcggatcttgtcccagaaatgaatcctgtatgagccaagctgttttccacggagatgacacacatcgcgacgccttcccctcagtcaccaagacgcccgagcggatcacgagtgacatggaccgcaatgaagcaaaaaaactcatacatggtggagaagacggacaagagaggattaagttcctgcaattgaaaataccccactgaaaaaggaatactcaccaactgagaagacatgtgaaaagatctgacgatcacacctacgactgtagatctccaagaagcacaagaagaaggtgcagtcctacctcatgatgatgcacagtacaatcacagtggaagccgagaacacatggaaccttaacttggttgaaaatctcagcacaaccgctctggatactttcgcatcacatttcatcttctttttgaactagtcctggtgcaccgctgctta

SEQ ID NO: 16566 - DNA, 931 bp, Diabrotica virgifera
  misc_feature (19)..(37): n is a, c, g, or t
  misc_feature (162)..(182): n is a, c, g, or t
  misc_feature (784)..(784): n is a, c, g, or t
cggacgcgtgggtaagagnnnnnnnnnnnnnnnnnnngattaattgataaaatccgatgcctagcagcagcctggatcataccaacagccatattttgcgtttggaacacctaacttccttctttccatatttatatactaaaaaacttcgaaatgctaagnnnnnnnnnnnnnnnnnnnnntgacacagataaaaatgtactgataattttttgtgaataaaaaaacgatttaataggactgtttatttccacttgatatgaaaataaccaaatttcttcgacagcaaaagttttatttgaatgataccaatatccttaacttttgacgagcagtttatttctgatttattggttcctttggcctaagtctctttaatcttaaattccttttcgtttttccaaatatttcagttgcagtatctgaaataacactagtcatattttctaaattttgttatagtttcctttcttgtttcaacttgtttttactgtttttgctctgaataaaccttcattctcatcttttacaaccgatctagccgtttcattgtttactcttattagagtgtattttgagagatatattactatattcaccgttattaggcgtcaaggcccttcggtagggatctatggaggagtatcaccaagccgcaagcccttatcccttgccgtaccgctcctccataggccgatcagacaccagttattacagactaagtcgtagattctattgaattttatactaccgacgttggctttttatttatttcatgacctgnctgaggctcgaaccgtcgatcgcaaatccactaaacttgtcgatcaactgcgcctcttcaactgagccgtcgtgaccgacgaattgagagattatacttgagagattttagtggataatatttaagaattggtaaacattttaggta

SEQ ID NO: 16567 - DNA, 705 bp, Diabrotica virgifera
  misc_feature (22)..(109): n is a, c, g, or t
  misc_feature (130)..(200): n is a, c, g, or t
  misc_feature (218)..(253): n is a, c, g, or t
  misc_feature (265)..(402): n is a, c, g, or t
  misc_feature (406)..(448): n is a, c, g, or t
  misc_feature (454)..(474): n is a, c, g, or t
  misc_feature (489)..(530): n is a, c, g, or t
  misc_feature (536)..(536): n is a, c, g, or t
  misc_feature (538)..(612): n is a, c, g, or t
  misc_feature (655)..(676): n is a, c, g, or t
ccccccccccccggaaaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcgggggggtgggtttcnnnnnnnnnnnnnnnnnnnnnnnnnnnnnnnnnnnnnnnnnnnnnnnnnnnnnnnnnnnnnnnnnnnnnnnttccccctctctcccccnnnnnnnnnnnnnnnnnnnnnnnnnnnnnnnnnnnnccacccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgnnnnnnnnnnnnnnnnnnnnnnnnnnnnnnnnnnnnnnnnnnnctttcnnnnnnnnnnnnnnnnnnnnncgcccccccctcctnnnnnnnnnnnnnnnnnnnnnnnnnnnnnnnnnnnnnnnnnnggaaanannnnnnnnnnnnnnnnnnnnnnnnnnnnnnnnnnnnnnnnnnnnnnnnnnnnnnnnnnnnnnnnnnnnnnnnnnnagaagagaggaagagagagggggagaggggaggagggagggannnnnnnnnnnnnnnnnnnnnnaagagaaattagtgtgttttttttttttt

SEQ ID NO: 16568 - DNA, 797 bp, Diabrotica virgifera
gacaatacagtttttatgctgaccacagcacgagtctttgaaaattgtgagttggcatactatttctgatagtacgtcatctcacttcagtgaccgctgtacatttaaaaaacagaacattaagaaaattttagctccttcatttttttttggtaatctatgaggatccctgcaattaggaataacgggatgaactacatcccacgactggttctggaccaaagtaggaatttgacctgatcccctcacaatctaaaatgagaatcttaatcttcctttttctcgcgaccatccaagccatcgcgaccatcttaaccttcgactttctttctctctcccgattgcgcagaactcagtttttagatgcatttgttactgaaaacaaacaattggagtatgtttgtttttgagacgcaattctaaaactgttacataggaacttattggatttaaagagagaacgaattcgaaagtagtgctacatcccgagacaagtttggctatgtaaataaacatttggattttgtttattgtcgttctgaagattttgagatgcaattcgaatgtttataaaaaaactctctttcaaagacttggaagaggcaaattaaaaccttatacaggatgggaaaaaatgctacaatatacataaaagtcaggttacagatataaactagtcttcaaaaatattagaagttagttttaatgttgctaactaattccgtcttgtgcaaatttaactataaaacttagtaatttttcacgcatttacagttttgaggtgcatatcgatatta

SEQ ID NO: 16569 - DNA, 764 bp, Diabrotica virgifera
gaattattgaaaaaatatatacctggcatgtattccattgtgagaaatctagaccttctattatgcgaaatatgctttacaaacattgaaaccctcagtgcgtttgtgggcacaataaatgataccaacgaaaagatcaaagcagctaaagaggcaactgcagataaaattgatttaacgaggttggtacaaacaaacaataactgccaaggaaaagtgagttctgcttgtagactctgcttgaagattatatttatgcctcaaatatttctttatgaaaatgaatctaatgttttacgccatgatttaattctcgaaatgtgccagatatgcatgatatcaatggatctggaactgtctgaacatccagtgatgtgttgggaatgttgggaaaacctgcagatatgctacagctttaaaaagagctgtctagatatagacaagaaaattacatcataccgtacaattttctgtctcaccaagaaagacataacagaaaacatttttacagaaatgtgcaattacttttcccaaaatctcgatgatgatctgataaaattgagtaggattattgaaaaagaggatgaactgttagaaaattgtctagatgtgagcaggtatactttaagaaacaatgtgaagagggaatataaacgagaagactgtagcaataatgataaagtttgtgaaaacaaaataatgcccaaaagtaattcaaaaagacgtaggaattgttttacagaagaggatgataactttttact

SEQ ID NO: 16570 - DNA, 1073 bp, Diabrotica virgifera
  misc_feature (197)..(215): n is a, c, g, or t
gacgtcactggtgcgatatgtgtgtcaaggggtcatagtttaaagatcgaataacttttgtattttgcattttttttttctgattctgtaaatggagcagtttacaagggggtcgaaatgtagtgggtggccctgtgcattcactgggcccgaccgaccggctctgtcccgtcgtgcagctggccgactataataannnnnnnnnnnnnnnnnnngtttaatttgcaatgtgtgtactgattttcagccttggtaggtggattaattgccttcgtgggaaagcagctttgatgccctctcagtggcccctgttctgcgtttcgcttgaccgaccgcagtgtgtttctctgcacagtcgcagtggtcaactgtgaaaagtctggctttggtaaattcatagagatttttcggcgctgcctcttggactattaggtcttttcatgtacaaagggaaacgggaagctgtgctttctgttgtgtatgctaaagattggagtttagttttcgtattcgaaaaatgcaaatagacgtagatttatcggtgaatttcagtaaaactctattataacattactacattggctttcgcagtgaattgactgtaattgtaataacttgaataattcggtaagatcattgttcagatcgtgatattctatgacaaatctatcagcagagagcgaacttatagatcttttaaagtagaacaaatgtaagatccaagaaagtaaagtaatagccaaataattatgagggaccaacgtagcgacaaaaaaatccacaaatatgtcgtatagctattaaaaattgtactgggctgcagggcacaaacaaaaaatatcttttggtcattgttgtctggggttataacccttgggggggattttttcttccgggttttcctctaccattgagggaaaattggggttaaaaattcaaaactttttcctttgaaaaaaatttcttaaacacttttatacgcccaaaaaaacccggatttttttatataagacctaactttccttcctccttttaatacaaaaaataccccccaaatcctctccctctctatc

SEQ ID NO: 16571 - DNA, 399 bp, Diabrotica virgifera
  misc_feature (264)..(287): n is a, c, g, or t
tttttgcgaataacaaaaatgtcgtgtccctaagatgctcttcgctattggtgctatagcacttattagcctcagctgaaaatagaacttgcagctatggtatggaaagttttggagatagcggcaatcaaatcaatgagcaccacggagaacctcgaattggagagctccacaacgtagatcccttccgcgcctttaggaagaacatatcctggcatggaaacatcgaagttgatagcacctcaatagacaccgacacattgnnnnnnnnnnnnnnnnnnnnnnnnaaagttgctgttagccccaccgatgatgacgctgattgtgtagagctctatgatagattcatatgatggcctgttttcataatctccggctactaccgataaaccgatagag

SEQ ID NO: 16572 - DNA, 692 bp, Diabrotica virgifera
  misc_feature (89)..(109): n is a, c, g, or t
  misc_feature (399)..(418): n is a, c, g, or t
  misc_feature (649)..(667): n is a, c, g, or t
actcagcaatggaactatcagctacagtgatggaagagatagctgaaagggaccaaggatatactgaacatctggcatttacatccgcnnnnnnnnnnnnnnnnnnnnntgaaccctaggaagatgaaggtttttcgcagaaccgaatggaaataatgaatgactgaacgtgcatgcactgcacaacagcaaatacggccaacctctgaagacacaacaaggcattctattagtacatgcattatttgttttactcaatcttaatctgaaaaattatttgaaacggcatatgatagcacgcagtggagcttaccggtgtgaagtttgttttaaacaggttactagtgcaagaaatttgaagaactcattggagagtgcactctggagaaaagccttatnnnnnnnnnnnnnnnnnnnnggaatttattcaagcaaatattttaaagacacatttgagactgcacactggagaacaaccttaccagtgtgaactttgtttcatgcagatctttcagaaaggtagtttgaaagcacatttgccagtgcacactggagaaaagctttacaagtgtggaatttgttttacgcgggtttttcacagaagtagttttaaatcacattttagagttcacactggagaaaagccccnnnnnnnnnnnnnnnnnnncaagcaattttctcgagtaaacgta

SEQ ID NO: 16573 - DNA, 1137 bp, Diabrotica virgifera
  misc_feature (842)..(842): n is a, c, g, or t
  misc_feature (988)..(1008): n is a, c, g, or t
  misc_feature (1047)..(1090): n is a, c, g, or t
gtaacgccatggtttctcaaccattccatggaagtcttggccgtgtgacaggacgctccatcctgctgtaagtcgcattgttgagcatcctcttcaaacgaatctctgataatcagcagaagtttggcttgaagtatttcttccggacagttttttgcattaatattgctctaaattaaaacgtccaacttcgctttccaaactttcggttttctgcatgttttttttgctgattttttggactactcaatttgtttgctatttcagcatgtgtaaccttctttatcaagagtacttgcgaaccctcgcgaagtcactaataaacacgaagtcgcacgaatgtgcttccaattggacgactaaatcatgtcactcgtggtatacattgacagactcacaagtcattcacaaatctctttttccgtttccacattttattaaataattatgtaaatatagagtgagaaatagataaaataaggagaaatataaaacaatacaataccaatgtaattgtattgataaactatataattcacgatcatgaaacatgataagaacatgagtgttactgaaaatcaattcttgtcaagttttcagaattttgaccactcctatatgtataccaggaaccggggtagcaacacagttgtcactaattattcaatagtttgtagacattccaatatttgcaatataaacatatggttatattttgctacatttttttgtagaaacgattaaaattcaatgtcattcaaaagctaacaaacaagtaaaagtattcattattttgtttaccaagttatgaaaaacacgtgcaaaaaattaaacttattcanaacaacacatcactgaatcagttctgattctatacatattattttagcctccctaattgtggcagtaggcgagcggttaccccccctaaacaaaacataaatccatttttttttggctatctatcaacctttttttatttcatttnnnnnnnnnnnnnnnnnnnnnccaaatggatggttttttatttttctccagggggccccnnnnnnnnnnnnnnnnnnnnnnnnnnnnnnnnnnnnnnnnnnnnccaaatcccttattttccgaaaaaaacctcttttttttcttccccgg

SEQ ID NO: 16574 - DNA, 1187 bp, Diabrotica virgifera
  misc_feature (468)..(468): n is a, c, g, or t
  misc_feature (1049)..(1083): n is a, c, g, or t
  misc_feature (1089)..(1112): n is a, c, g, or t
  misc_feature (1121)..(1160): n is a, c, g, or t
  misc_feature (1167)..(1184): n is a, c, g, or t
gtgtggaagattttttattttcaaacattaatggaaacctaaacaaaatgacgaagctttatgttttatttgaacatgccgcggggtatggggtcttcaaagttgaagagtttgaagaaatcggaatgttgcttccgcaactggaagccgcagtttacgatataagtcgatttaatagcatcgtgaaacttgttggattttgtccatttaggtcagctgtaacagccttagaaaatgttaacgctatttccgagggtattctccctgaagagctacaacaatatttagacgtaaccattcccaagggcagcaaaaaggacaaagttactttgggcgtgagtgacccaaaactatctgctgccattactgaagctctgggaattaattgtagccatattggtgtagttccagaagttataagaggtatacgtgcacactttcatcacttaatcaaaggttttaccttanaaagttcaggagttgctcaattaggtttgggacattcatactcacgtgctaaaataaagttcaacgtccacagagtagataatatgattattcaatctattgccctattggatcaacttgacaaggatattaacaccttttccatgaggatcagagaatggtattcctatcatttccccgagttggtgaaaattgtaccagaaaactacacatatgcccaagtagcccaattctttagaacaggaaaattctttcaaaagaattctggaagctctgaaaaattaacatggactctggaaagctccggccatcttagatgcttccagatttagtatggggatgggaataaagtgacataaatttcctgaaatttgaaatgttccctaccaaggggtgaattttttgccaaatttccgaaagggggttagcaaaaattttaggaccaaaatgccgaaggtggttcccattctcccaactttgattggaagacaagggggggggcaggggggattggctccggcgggggtccccctccaaatttttggcaaaaaaaaacccccctttctacacagatcaaaaannnnnnnnnnnnnnnnnnnnnnnnnnnnnnnnnnngggacnnnnnnnnnnnnnnnnnnnnnnnncctcccccnnnnnnnnnnnnnnnnnnnnnnnnnnnnnnnnnnnnnnnnttttggnnnnnnnnnnnnnnnnnnacc

SEQ ID NO: 16575 - DNA, 1239 bp, Diabrotica virgifera
  misc_feature (75)..(95): n is a, c, g, or t
  misc_feature (234)..(263): n is a, c, g, or t
  misc_feature (600)..(631): n is a, c, g, or t
  misc_feature (930)..(952): n is a, c, g, or t
  misc_feature (1012)..(1025): n is a, c, g, or t
  misc_feature (1028)..(1044): n is a, c, g, or t
  misc_feature (1151)..(1200): n is a, c, g, or t
ctcacattttccatcgttgagaccagaacaactaaaacacttccaacatggcggacgatgagagaaagaaactgnnnnnnnnnnnnnnnnnnnnncaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccnnnnnnnnnnnnnnnnnnnnnnnnnnnnnngcagccgaaaggaggcgtatcattgaagaaaggtgcggtaaacccaaacttgtcgatgacgcaaatgaaggctcattaaaacaagtatgtgagggatatcacagacgtattgaagacctagaaaataagaaatttgacctcgaaaaggaagtggaattcagagattttcagatctccgaattgaacagccaagtaaacgaccttagaggcaaattcgtcaaacccaccctgaagaaggtatccaaataccaaaacaaatcccccaactttcaaaagaaggcagctgaatttaacttcccgaaaccaactcaaagttggcaagaagaaagaattcccnnnnnnnnnnnnnnnnnnnnnnnnnnnnnnnngccgctccaaaaggattccaggcttaccgaagccggggatgggcaacgcaaaagctccttctaaaaggggcccccaaaattcaattcccctggcccggcctttttaacaaaggggggggatggggaaaaaccccgggggtaccccaaatttaatgccctttggaaaaaaatcccccttttgccaaggggggggaaaaggggaaaaagcccccccccatcccccccctccccccacaattgggcgccccctgaaaggggggaaggggggcgctccccccgctagggggggtattataacnnnnnnnnnnnnnnnnnnnnnnntcccccccagggggcaccgctaactttttgtgcacgcgccccattggcccccctctctcnnnnnnnnnnnnnnctnnnnnnnnnnnnnnnnntcagggaggctcggggggtttttttcctccccgaaaaacgttttaaaaagtgggggggtctttcttcttaggggggtgccttatttttcggttgttctatggccctnnnnnnnnnnnnnnnnnnnnnnnnnnnnnnnnnnnnnnnnnnnnnnnnnncggctctccccggcggggggggccccctctccccccccc

SEQ ID NO: 16576 - DNA, 827 bp, Diabrotica virgifera
  misc_feature (662)..(662): n is a, c, g, or t
taaagaattattttgataaattgaacactttacaatgtacgctacaatattttaaagttgttcaacgtatagaaggtttaagtgatgagttacaagtagaagtaggaaagaaagatgacgaaagatgtgtaaccatttttgccaatttaacagaaataagtaggaacctagcagatttttgtggacagaacttgaggaattacctaaaagataatatttatttttggcataatatattaaaagagaaacttgcaaaagatttcgatgaagttctgaaactgattaaatggccatttgtaagtgcgaatttctctttggttctaccattaccaacacacattcagaaattacagactgtttgtgagtttttgcttcagatagaaattccaagtgagagcagcgttcctgtagtaactactgccttattgtcaaatttccaaccgctgtgtctaccaatacatttattagtacaaccattgagaaaaaggtttatgtatcatttttatggagcaaggcaaacgaacagagttgataaaccagaatggtatttaactcaaattcttacatggattagagatcatcaagacttcgtagagaagtatatacagccaatagtggaaaaattaggattgctacatattgaagctaagaattcatcaggngactggttcagatcgcagtggagaaactgttttcagacctaccaaatttgcagttcgatgatttcacattttcccatttcatagatgaagctctaggttttgataaggagttgagggaaacgtacgaatatccccgccatcagccaagtattttggtagtcctga

SEQ ID NO: 16577 - DNA, 936 bp, Diabrotica virgifera
  misc_feature (197)..(212): n is a, c, g, or t
  misc_feature (236)..(257): n is a, c, g, or t
  misc_feature (760)..(777): n is a, c, g, or t
  misc_feature (818)..(835): n is a, c, g, or t
cgtcgcgatagtgtcgcaaagaacggtgtttaataccatgtgatgataagagattaaacgacagtgagtgcatttctaattaatttgaacgcgaaggtatgccgcaggccattttgccaaggccgcttgagaatccttgctttgaagatgacaacaagaggcagttgaagagttaccacgaaaatgaggtggacacnnnnnnnnnnnnnnnngtcaacccagacgatgatgaaacnnnnnnnnnnnnnnnnnnnnnngttgactacgacaatgcaatcgtagttaacgaccaacctcatctaccacactttggcagtgtttccgtagtcaactcaaatgatgttcattttggtaacaaaacagtgtacaaaggtcctgtgactataaaacaatttgtatcccaaaagtgatgtaactagtgaggtatttagtaatttaagtgaagtgaccggattaaacgaactcaacccaataactggcggtaataaggtgctacatagtgaaggagtagataatgcgagttttgtcaaagaagacctcgaaattggtcgtgacaaagcagaggagagggaacaagagactgattctgtaactgatagaataagaaaaagtattacgtatgtcaaggcgtttccatgtaaaaaacctaagcaaactttattgttagtatttctgctaatattgtctcttactacaatttctgctatcctgatatggaggaatcctactagagttatacagatcgatcaaaataaagacnnnnnnnnnnnnnnnnnnaatgagcccatagactacacagctgatactaatgcggctcnnnnnnnnnnnnnnnnnntgtaccaggataaattggctcgcgaaacctcctcgggaccgataaataactgaccctccctgtttcttagtagtaatcaacattcagcaactgaatcctgc

SEQ ID NO: 16578 - DNA, 410 bp, Diabrotica virgifera
  misc_feature (11)..(207): n is a, c, g, or t
  misc_feature (233)..(292): n is a, c, g, or t
  misc_feature (330)..(355): n is a, c, g, or t
  misc_feature (357)..(371): n is a, c, g, or t
  misc_feature (373)..(405): n is a, c, g, or t
cataattatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatgagcttcaaaataaaatttcnnnnnnnnnnnnnnnnnnnnnnnnnnnnnnnnnnnnnnnnnnnnnnnnnnnnnnnnnnnntatcattcattcttatatattattattctcatttttcnnnnnnnnnnnnnnnnnnnnnnnnnncnnnnnnnnnnnnnnncnnnnnnnnnnnnnnnnnnnnnnnnnnnnnnnnncatat

SEQ ID NO: 16579 - DNA, 630 bp, Diabrotica virgifera
attctcgaaaaacaagtatttttcccgcttttaatggaatgtcctaccgactactgccaccataagatttatattaaatggataagttggatcgatttatcaagctagcaaaggcaggagaaggtacatatggagtggtttataaagccaaaaataagttaactggaaaaaatgtagcacttaaaaggattaaattagaaaaattctacaacaaaggagattcagagggagtgcctccaacagctatacgagaaataagtctacttaaaggtcttagacattcatctatagtagaacttctagatgttatgcaaacaactgataaactatatttggtatttgaatatttagatttggatttaaagaggtatttagacaatactagacgacctatggaagcagaacttcttaggaattacatgaagcagctgattgaagccctagcatatttgcattctcacagaatactacacagagatctgaagccgcagaatttacttgttgataaggaaggacatattaagcttgcagattttggtttatccagatcattttcccttcccactcgaacatatacacatgaggttggaaccatttcataccgagctcctgaattacttttaggggcta

SEQ ID NO: 16580 - DNA, 212 bp, Diabrotica virgifera; identical to SEQ ID NO: 11509
  misc_feature (20)..(57): n is a, c, g, or t
  misc_feature (77)..(90): n is a, c, g, or t
  misc_feature (93)..(115): n is a, c, g, or t
  misc_feature (123)..(145): n is a, c, g, or t
  misc_feature (175)..(206): n is a, c, g, or t

SEQ ID NO: 16581 - DNA, 601 bp, Diabrotica virgifera
ctttatttcttaaccaagttagtcaacaagtttaccttcagatcgtgtacttgtaactttttaaatataatattgcttctgacgctaaaagagctttatcaaaattgttttatttgattcaattaaagtttcatcactagcccaagaaaatatgccaataaagtgaattgatataaaatcattccacacttttaaagaatatcagttgtgatggtgctctcattctgataatacattagaatttttatgaaatatattgatgaaatatgtaatattgagaccctttgctcctgaacttttcttcgtcagtaattcaaatagtttcaaatagtttgtcattgtcatgttattctattcaataatagaacaagtaaaacagcatagggttacgtctatcccctacatcttcactactttcttcatttgtaccatctgttaaggtagtttttgaacaaacggtgtacgaatgtatttaatgcgaaagccttgcttttaggaattaggtttgcattacataacctaagaagtagtgataagagagaatgattaaacattcactaaataagaaaactttatattatttccgggagaattaattata

SEQ ID NO: 16582 - DNA, 307 bp, Diabrotica virgifera
aagaatattatgatcgatatacttaaatgtgccacaatgcttctctttccgagtaagtatattataaaagtccaattccatctgcttctgtcaagaacttcgtcgagacttgcaatcaacagactgcccgaaagaatgttaaaatgtttcatcggatgaagaaggatcgtgatatagatcctatgactgctgttggaccattatggactgatctgaatggtccatcatccatataccgtactacggacatatatagacttgaatgtatgctcctataatgacatattgcagatcttatcgcaagagt

SEQ ID NO: 16583 - DNA, 726 bp, Diabrotica virgifera
aaatggaaaaaagtaaataaaatggcattacaaaaagaaagattcagtaaaattcctgaagatgcagttattttaacagaggaacaggctttaatttatcaaaccaaattaatgagcaattggccaaatagaaaggatgtgcttggttttaaatatggatcattagcaatagcctctgctagcatgttaacaggaatttattttaaccaacattttagaggaatgttcagactgctcaactatggtcaaatgtcgtcctaccttccaatagctgccgtaccaacagcaatatctttattttctcaccaacagtttgttctaggctcactgttactggaccgaaaacaatgtccagtatgcttacaaacaagagcctcagcgatacaggcattaggtggatgcttactgcccttagttttgtcaccaattacctcattggcgctagtccatcgataccacacatacgacatgccttacataacgaaagaaccacgaaaagccttccaggttctagcaaaaatgttcaaaccgatcaagaatgtgacgttttacttgtttttggggcatgcgttcctcgccagtgtggtgacctacttagaggctgattcgatcaacactgttgacatgaaattagcactggcagaacaagaagaagagtttcgtagttgaacgacaatgaaatgcatcgatgtgataattgttttgtaaatatatttagtgtttttt

SEQ ID NO: 16584 - DNA, 74 bp, Diabrotica virgifera
ctcatgttttaatcattttactgcaaaaacttaatgaatttagacatgattttttcccaataaatttttttacg

SEQ ID NO: 16585 - DNA, 947 bp, Diabrotica virgifera
  misc_feature (48)..(84): n is a, c, g, or t
  misc_feature (133)..(162): n is a, c, g, or t
  misc_feature (247)..(271): n is a, c, g, or t
  misc_feature (289)..(316): n is a, c, g, or t
  misc_feature (836)..(858): n is a, c, g, or t
cacgtaagaagttatacgattatatgatttcaacgaaagcaatatacnnnnnnnnnnnnnnnnnnnnnnnnnnnnnnnnnnnnnctaattttaatactcactactttccaaaactttttattaaaacaatccnnnnnnnnnnnnnnnnnnnnnnnnnnnnnncacgcaaacacattgaaaaatgaaacaaagaaatgatttctgaacaataattgctgacaaaaattttaactaaatacgtattttnnnnnnnnnnnnnnnnnnnnnnnnncttacaatcataaaatgnnnnnnnnnnnnnnnnnnnnnnnnnnnngcattgggaattgaacctgcgtctataaggttgttagattttgaactcaccgcacgcagaacttagctagcgagacatttgaatgatgtgggaacattagcaactaaacgttttaaacttttttgacagctgcttattctcttagtttaattaaataagtttgattcttgcggaattaaaatattaacatacaacaaaatatagactaaaaaagcaatttattagatatgaagattggtagaaattgtattggtaatcaaattatgtaaatcaaagcattacctattaattggctaggtacctacattttccaaataggtatgtaggtcctaatcttttattacaatactgaaacatttaaaattacgttggttttgcttttaaaaactatttaaaaagtcactacaattataaacttgctttttgtgtctgtcctcacaacaataaaaactaatatactacatacaatttgtttacccataaccattgacgtattaataaataaccgacatattgaaannnnnnnnnnnnnnnnnnnnnnngtcagaagacgtataacgtttaaccctgcgcccggtacccaagattttgatgatttcgcgcacatataaaattactccccacgcgccta

SEQ ID NO: 16586 - DNA, 941 bp, Diabrotica virgifera
gataatggcatgggcctgctgggagttctccgcctccaggcagtcatagccggccatttccaacgcaacggcgatcatctcgcgaatgggcgcttcgtcgtcaacgatcagaatgctcctgccaaccatgctaaatcctcttgtcatttaactgtcttgcgccgcattagataacggaattattgcagtcgtgtgacagtaatttagtcgcttgggcaatccttgcctctctggactacgctttgggtccgaatcctgacaaccacaaaaggaaggttcccatgactcacagtactttttcctggaaagccctgctggtaacggccgcgttaacgctgccgacactggcgtttgcggcagacccggcgatgaccaaggacgggatgctggtggaccacaaaggcatgaccctctacacctttgccaaggacgctgatggcaaatccatgtgcaacgacaagtgcgccgccaattggccgccattgatggccgaatccaccgacaagcccatgggcaagtggaccgtcatcacccgtgacgaccagaaaagccagtgggcctacagcggcaagccgctctacaccttcgtcatggacaagaaggccggtgacatgaccggcgaaggcaaaatggacggggcctggaaggtcgccaagccctgagtcaacccgctagcggtgaggggcgtggcccttcaccgaaacccatagtccgccacaatcccgacaaaaatcgccaacccggcccagtggttgtgcaaaaacgccttgaagcatttgagccggtccttgtcccgggtgtaccagaactcccaggcaaaacacccggccgccgccagcaaaccgaggtgggaaccagccccccagctcaaaacgcatgcccgccagccacaggcaaaaccagtgccgggctcctgcaaacgtcaggatgatcaccccggc

SEQ ID NO: 16587 - DNA, 853 bp, Diabrotica virgifera
  misc_feature (52)..(100): n is a, c, g, or t
  misc_feature (352)..(376): n is a, c, g, or t
  misc_feature (453)..(470): n is a, c, g, or t
  misc_feature (794)..(806): n is a, c, g, or t
  misc_feature (808)..(847): n is a, c, g, or t
aaatttgttcgattcataaagttttgtcttcttcttgtagtgcctattcgtnnnnnnnnnnnnnnnnnnnnnnnnnnnnnnnnnnnnnnnnnnnnnnnnntctaaaaagagcaaaaagttttgtatattgttgtcccctcttatttttcgactgtattcatttcttaattaatttgtttgtatgaaaggtttaatcttttagtatctcaattttattttgagattgtaattgtgttttccagaccaatagtctttaatttgtgacatcacaaagcttcatgtcaagataattcaagaataacattcgttttaatgttttttatattgtggcctatttacgattttttgcaannnnnnnnnnnnnnnnnnnnnnnnncaaaattttaactggctaagatgattttaataattttgcaggacacttgcagtgttgtattcttatgttgtttatcnnnnnnnnnnnnnnnnnncggatgatttaaaacgtttaatttgaataaaacagttcagacttgcatttgaatacatctctgcaaacgtttcctgggcctttaccaatgtgaagaaatctgtagactttttaaaactgtagttgaaatattgagttgtgatcgtagtgaattctattcaatgctccaattgccaatgaatacttgttttgtaatttttgtgtattcgtttttggtatattgtgactttacttacttgtttttagagtaagttgtgggttgtaatatccacatcagaaatgtgatattataatctaagtagtgcgaattaataattttgtatcnnnnnnnnnnnnncnnnnnnnnnnnnnnnnnnnnnnnnnnnnnnnnnnnnnnnnccgctc

SEQ ID NO: 16588 - DNA, 884 bp, Diabrotica virgifera
  misc_feature (309)..(326): n is a, c, g, or t
  misc_feature (531)..(549): n is a, c, g, or t
  misc_feature (782)..(782): n is a, c, g, or t
  misc_feature (846)..(864): n is a, c, g, or t
caggaagatgagaatgaagaaagtgaacttaaaattaaaaaacccaaatatgacaattttgttaaagcgggccaaaataaaagttttgatggaaatgacaaggctaatgcaagaggatcctggggcgagaaggcaaattatgatttgaaacatactcgtggaaaatctttcagacatgagaaaacgaaaaagaagcggggatcctaccgcggaggcaccatcgatacttctattaattccattaagtttgactagattactctcaaattgtttctttatcatatttactgtaatttatatacctatagnnnnnnnnnnnnnnnnnnggtatctttaaactctttaattgagcggagaacacacatatactaaactgattgagaacagatttgttgaggtttggtttaaatatttctttgccatcgttgtgtcaattaaataactgctttgtcggtaacactcaaaagatatttcagatgtaatcgagatagaattgttcatttgagaatttaaattgatttaagaaaatgnnnnnnnnnnnnnnnnnnnccgtctcaatatttatgattatcctaagacctatcacttgtgggctgttatattagtcccccttgctatttaatcatttaaattaacgttgtttgaactaagagctccttttaatctagtatacaaaaagttctcccgcacttccatagatttcttatttttaatcataactcaattttcatcaacgttatatctacacaggctacaatgttatcgtgcaatcaggaattacnatcaccatagattttttaaccacgtctggtttgtgatgtgatggcaatgttttatccctgaacnnnnnnnnnnnnnnnnnnnttatacatattggcgaaaag

SEQ ID NO: 16589 - DNA, 784 bp, Diabrotica virgifera
  misc_feature (718)..(760): n is a, c, g, or t
catgtgcattttacttatagaacggttccatatggagatattgattattcgaataagaactacgtacagataaggacattgttttaatcgaagaacttgaattatcgagatggcttctagacgaagtagaattaaaggaattgctaatattcctcaacgacggaaagctacaaatgaagaaaataagttaaatttgacagaaagtgaggcaggtgaaaatgaaaaaccatccgaaaataaagatgcgcccctcgacaacagtaatactggcaattcaattagtaatgatgcaatcgaaattaatcttccgaaacctgaagcactgacgcaaatcgttaaagaaacgtttaataatggagtaacgaatatcaaaaatgaagcgcaacagaattcaaaggactgtgataaaaacctaaccccagcaacggaacctcccaaaccagcaactgaacctcccaaaccagcaactgaacccccgaaaccaacaaatatactcaaaagaaagtttattaaagctccagtgtccttaaacgcaattaaaaaccgaaagaaaccttaccaagaaagtttagagaaaggagtagatacccaagtaaatgaaactgtagaaacaaataagaataaggtattaggcaactttgaacaaaggtctaataatgatttggcttgtacagtaaataaagagtttattaaaaatgaagaaagatcagcagctcannnnnnnnnnnnnnnnnnnnnnnnnnnnnnnnnnnnnnnnnnnttgtttcaaaaacctgtaccttta

SEQ ID NO: 16590 - DNA, 899 bp, Diabrotica virgifera
  misc_feature (419)..(449): n is a, c, g, or t
  misc_feature (451)..(465): n is a, c, g, or t
gtgatacacatgtcaattattttgtttctgctagtatagatctctgtaacattcccctatttattgttgatgatattgtaaacctgaatgttatattgttgttcctactaatattttataaagctgactggaaattttgttacactttactaatactaatactaactagaacactgctagaaataaaataatttgacattagacagttgtcaaacgtcaaatgtcacacatcactgtttatattggtggaattacggcttttatttacaaggaaagcacctcttaacaagtgagaagtggcatcggaacctctcattgacctcttggatcaaacagaagaaagaataaaagaagacattaaatatgcgtgccactaatttaagcatcacacattcttaattttatgataaatacacacnnnnnnnnnnnnnnnnnnnnnnnnnnnnnnncnnnnnnnnnnnnnnnccaaagtatacacaatggcgttatgaattataatgtggtattgtgtactgttttatgtacgtttatttgttcgtttttatattgtctgcattttgttcttagcatagaagtgtatattatgttgtatatatcgttaacactttcagacctgtttttgtagatttttaagcatgtcaaaagtcatgtatcaaacgtcaaaagttatatgtcaaacgtcaattcaacaaaaattgcatatgtcaaaggatgtattcttaattgtcaaacctaacctaatataacctatgaatagtagtacggtggaaaaacgttaagtaatacttttcggatagtatccagccttgtattactctcattttcattgttgatttctcttttcttgtagttatgaacatgtactgccataaaggtatagggtatttgataactcttat

SEQ ID NO: 16591 - DNA, 588 bp, Diabrotica virgifera
  misc_feature (15)..(43): n is a, c, g, or t
  misc_feature (107)..(135): n is a, c, g, or t
  misc_feature (232)..(268): n is a, c, g, or t
  misc_feature (298)..(330): n is a, c, g, or t
gggccctttcgtacnnnnnnnnnnnnnnnnnnnnnnnnnnnnncccacccgggctcaccccggtttaaactcaaatctgggaaaattttaaaaggcgaacgggggannnnnnnnnnnnnnnnnnnnnnnnnnnnntcgggtgggaatttttgctcgattaattaaaggagggatattttaaattcgggttcaacgcttcagagctaaaaaaaaactaaaaaggacttatccnnnnnnnnnnnnnnnnnnnnnnnnnnnnnnnnnnnnnggtttctccaatttcaaaggggggggaaannnnnnnnnnnnnnnnnnnnnnnnnnnnnnnnngggggggggttataaaaagacgggggggggatttaataacgggagatttaataattttttcggggataacagttacaaaaatcgcaaggggggggggtatcaaaataatttcaacgggaacaatcaaggatatgggggcaacggggggttgagacagggcgaaggggttaacaaaaagttacgcccaggaaaaaaacccttctacgggccccatccttttgggggaagccgtactccctttggggggggggagtttcc

SEQ ID NO: 16592 - DNA, 539 bp, Diabrotica virgifera
atctcagtcaatacgccgcctaccaccgcgacccgcgcaacatcgccagccactttatcggcatcccgctgattgtggtggcggtggccgtgctgctgtcgcgccccgaatggacggtggccgggctctggctgtcgcctgcggtgctgctggcactgttctcggcgtggttctatttgcgcctggagctggcactcggtgtgctgatgacggtgctgatgggcctgtcggtgtgggccgggcatgtgctggcggcgcaaagcacgctggtgtggctgagcagcggcatcggcatgttcgtggtgggctgggtgatccagtttgtggggcattactacgaggggcgcaagccggcgtttgtcgatgacgtgtccgggttgatcgtggggccgttgtttgtggtggcggagttggcgtttctggtggggctgcggcatgacctgaagcggcagattgaagagcgttcggggccggtggccgtgcggcacaagaacgccacggcctgacaagcaacacaagctaaatgtgggaggtggctt

SEQ ID NO: 16593 - DNA, 912 bp, Diabrotica virgifera
tttgtccgaaacaatctattactatatgtggaacctcataggaaggaagctctagaaaaactggcccgtatgcgatttaaattgcagttgcacacggttgaagatcaaagaaaaccgatacaaaatcaacaaacgctagtaagaagtacacaaagtaagttaaggaggctcgaaaaagaaacgtatttggtgaataaagctttagaagaaaatcctgatgatatagagttgagacaagagtctgatagacttgaaagattgatgtacgactgcaaaaaccaactcaacgcacaaagcgaagaactagatatgatgctgtcctgtttcaaggagactcaactattggtaaattctaggctagctacaacaagaagcgacaaacctttaactgttgttagagccaatgaaatttgctttaagcatgcacagtggagattgactgaagctgatgggcagattggtatcgcagatttagtattaagcaactttttgtacactaaaaattccaaaagtgacgactcggtagaacatctcatggaattgggatatttgagaatgaccaatctgttaccgaatgaaatatacaaagaagtaatatgtccgactgaaattcaattcgacatgccaatagagcacaaaaaagtgttaaggatcttctgcagggagaagccacctgttggcggaatatctgtcaaggaaatatttgaaattaatttagtaccattaaccatagggttaactaaaaaattctataacaccatgatgaaattttgtttcccctgaagagaaagcgaacacaacgatttataacgatagagcaagtgaagatggtgaattagaacaaaaaggaaagaaaacgaaaaataaaacgaatcgcgattcaaacttttatgttcttattagatgatgttg

SEQ ID NO: 16594 - DNA, 832 bp, Diabrotica virgifera
gctttcagaagtgtgacatcgagtgtcagattttgctcattatattcgatttttattacttcaggtctataacgtcaacaacatggaagctccttttgacgttgtgatttccggaatgtctggaagattcccggaatgttataacgtcaaggaatttcaagatgctatcttccaaggactaaatttagcaactgaagatgacagaagattttctacagaactgaagggtttgccacattggatcgccaaagtgcccgagttagacaaattcgatgcctcatttttcgacattcactacaaacaagcaaattttaccgatccccgtcacagaatcctgctggaaaccgtctacgaatcgattgtagatgcaggatacaatcctgctgaactttacggcagcaaaactggtgtgtatgttggccttgcaaactacaccaacatggccgaaatgagaagcgtggaaagtaacggttatggaaacctgggaatggctctgtacggtgcagctaacagaatctcgcacgcttttaacttcaggggcccaagtctagcactggatgccgcgtgtgccagctctatgtacgctctgatagcttgtttcgagaaaataagatccggagaaatagagcacgccgtcgtttgtggtactcatttgcttttgagtccggatgaaaacagggactataaacaacttcgagtactatcgtcagatcagtactctagagtcttcagtaaaataagagatggattcgtgagagcggaaggtgtggctacattgttcttatcaagaaaaactaattgtagacgtatgtatgctacaatcttaggagct

SEQ ID NO: 16595 - DNA, 896 bp, Diabrotica virgifera
  misc_feature (143)..(161): n is a, c, g, or t
  misc_feature (163)..(175): n is a, c, g, or t
  misc_feature (210)..(228): n is a, c, g, or t
  misc_feature (250)..(274): n is a, c, g, or t
  misc_feature (285)..(308): n is a, c, g, or t
  misc_feature (321)..(348): n is a, c, g, or t
  misc_feature (519)..(550): n is a, c, g, or t
  misc_feature (717)..(734): n is a, c, g, or t
  misc_feature (773)..(801): n is a, c, g, or t
  misc_feature (810)..(837): n is a, c, g, or t
tttaaaatagataaaatagtttgccccctaaaaaaaaagagaaatattatttaatgaatgaggattaggagtgggagagaagatttgatgtttgtgaaggacccctttattatttgtaggttgggaataagggatgattatgnnnnnnnnnnnnnnnnnnnannnnnnnnnnnnnaagaggtaaaaagttaaaagttttgtaggaaaatnnnnnnnnnnnnnnnnnnntttgtaatgatatgttattggnnnnnnnnnnnnnnnnnnnnnnnnngaaataaatannnnnnnnnnnnnnnnnnnnnnnngataattagaggnnnnnnnnnnnnnnnnnnnnnnnnnnnngtgggtatgagggtaaagttaaggttttattatgaatttagtttttgaataaaaattaagattgaagattatcatatgtgaaaatatgttaggatgtatttttatagataatgattatgattgtttagaaggggtttattaagatatgtatttagagtgtttaaatttagnnnnnnnnnnnnnnnnnnnnnnnnnnnnnnnngaataattagtaaaaaatattttgggttaaatatagggaaatagaggatgtttttttttgaatgggttatgtagaagatgtttttttggattaaatgtatagtgtcgggtggtctttgattattttgggtgggagtggtgttaagaacgtggttaggaagaataatnnnnnnnnnnnnnnnnnnaagatgaaatgaggggtgaatgaataaaaaaaggattgnnnnnnnnnnnnnnnnnnnnnnnnnnnnngtaaaaagnnnnnnnnnnnnnnnnnnnnnnnnnnnnccctagaaaggattgtaaaattatatgtaagagtttttcggattaaatttgattatttt

SEQ ID NO: 16596 - DNA, 190 bp, Diabrotica virgifera
  misc_feature (6)..(179): n is a, c, g, or t
tttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttttttga

SEQ ID NO: 16597 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16598 - DNA, 600 bp, Diabrotica virgifera
  misc_feature (13)..(38): n is a, c, g, or t
  misc_feature (49)..(80): n is a, c, g, or t
  misc_feature (104)..(165): n is a, c, g, or t
  misc_feature (171)..(192): n is a, c, g, or t
  misc_feature (271)..(294): n is a, c, g, or t
  misc_feature (375)..(396): n is a, c, g, or t
cgaacccgaaccnnnnnnnnnnnnnnnnnnnnnnnnnntagaggttgannnnnnnnnnnnnnnnnnnnnnnnnnnnnnnnaacctaaaattgaagatgtaggannnnnnnnnnnnnnnnnnnnnnnnnnnnnnnnnnnnnnnnnnnnnnnnnnnnnnnnnnnnnngtacannnnnnnnnnnnnnnnnnnnnnaaccaaaccaatctggacaagaaatgctgatgatataacccaagaagaatatggtgaattttacaaatcattgacaaannnnnnnnnnnnnnnnnnnnnnnnaaaacattttagtgttgagggtcaacttgagtttagagctttattgtttgttcctcgtcgtgtaccttttgatttgtttgnnnnnnnnnnnnnnnnnnnnnncatcaaattatatgtacgcagagttttcattatggacaactgtgaagaccttatcccagaatatcttaactttattaagggagtagtagactctgaagatttacctctaaacatttcaagagaaatggtgccacaaaataagattctttagggcatccgcaaaaatttagttaaaaaatgtctggaacttttttgagagcttac

SEQ ID NO: 16599 - DNA, 522 bp, Diabrotica virgifera
  misc_feature (4)..(113): n is a, c, g, or t
  misc_feature (152)..(176): n is a, c, g, or t
  misc_feature (258)..(279): n is a, c, g, or t
tgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaagttttacatgattaccaaaattgaaaccaatcnnnnnnnnnnnnnnnnnnnnnnnnncctggactctaggacgttcctaaaatataaggggggaaggggaaacacgcttatagtcagcaccgatcgtcccaaaggatcnnnnnnnnnnnnnnnnnnnnnncaggggatatggtacatattttacaaaaaattagggggtcttaatattactttggataatttaagggactttggaaaaagtatgggtataaaacttatattttttggtaaaaagaacactcgggggaaaaatagggttaaaataaggggaaaaagaggtttctagggtttttttgttcagacaaccgcttggggaatacggattttatgtgggccccccccgggggtatttctttttttttcc

SEQ ID NO: 16600 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16601 - DNA, 164 bp, Diabrotica virgifera
ataattttggacctttgttaacagaagaaccgtctgatccatttattgcatacagagacttccaagacacgtccccgcaattggtatcaccgaatctatcaaaacactcagactgcagtttaccttccctcaatagaccttgcgataccctaagagatgaagat

SEQ ID NO: 16602 - DNA, 1158 bp, Diabrotica virgifera
  misc_feature (1074)..(1096): n is a, c, g, or t
  misc_feature (1109)..(1130): n is a, c, g, or t
  misc_feature (1145)..(1157): n is a, c, g, or t
ctgaatcaaaacgaaacccaactgtctattgtttttaagatttctccttgttttaaatagatgtcgctattgtgtccattagcaaattatttcgtgttaatttgcgtaatttgcgtaatagacagttgggtttagtttcgattccttcttccatccttctttccatgtctgtggtaccggttctccatttaaaaatctgttcattaatgttgttattattctaactaatttgtcagtaccatttttaagtagttctgcagatattccttcccgccctggggcgcggccgttttttaataaggatattttttccttttttggtctgttcttcgtttatatgaactggctgtctcgtgacctcgactatattttgtgatgtgatgtaggaggaaacatacgtaaatgaatggtggtggccctttgaaacaaaataaatcttacctctttccattaccttagatctactcctgcataataggaatcaaaattgttatattttacctagaacaattgacggctgtggatacatgttgaagatccctcttggaatccagtatcgtccatcatcatcatcatctttcctcaacctcttacatctactggtggattaagtctcctacatatttttccattgttccctattttgtgcattctgattccatttcccactgtttttcccagtcatccatccacttttttggggtctatctcggtgctttctttctctctcgtccccatttatgagtttttggtcccctgttatctttattcaaagggttacatgtcagtccctcttcatttggtttgggcaattttttcgggaatttgccattttgacccccaatatccatttgggacctattccttctcttatactacattgtctttcattttttttcggtattccaatttattgaaatatttttcaagtatggtttgaacccttgaattacggagatgatttgtgaaatttttgtccacaaacgggacgtcctttaaaattgcccttttgcaatgcgccctcccgcctacaccgcgtttcccgggtgtttgggtttttttctatttttgccnnnnnnnnnnnnnnnnnnnnnnncggcccccgtttnnnnnnnnnnnnnnnnnnnnnngggcccttcatgttnnnnnnnnnnnnng

SEQ ID NO: 16603 - DNA, 642 bp, Diabrotica virgifera
gaaaaagatagtgattttctagatagaagttctagtacgttctttaacgatttacagcaaaaaccgtcaaagaatgtactattcgtgttatcgtcaaatatgttatttttatctaaaagagtaaccatggtggctgtgatagccataattctgtattttgttcttgccgccagtggcaaggatccaaatatagaagaagaagaagcaactgcttataattttataagagtgactaataaaaagaatgaggaaaatctcaataaggcaacgatagctgaatggaattatgcttctaacattaccgattataatcttgaaattagtttaaatgtatctgcggaagtcgcccaacaagataaagaaacctgggagcaagtgaagcagttcgattggaaacgcttctcttctactgatctgaggaggcagtttaagtcttactcagttattggaagcgcagccttaccagaagcagaatttaaggctttgaagaaacatattagcgacatggaatctgtgtacgcccaggcaaaaatttgtgattataataacaaaaccaactgtgatctagctttagaacctgaattgacagctattttggcaaactcgagagatgaaaaggaattaaaaccgtatgggtagaat

SEQ ID NO: 16604 - DNA, 474 bp, Diabrotica virgifera
  misc_feature (2)..(17): n is a, c, g, or t
  misc_feature (28)..(89): n is a, c, g, or t
  misc_feature (326)..(345): n is a, c, g, or t
cnnnnnnnnnnnnnnnnttctttccaannnnnnnnnnnnnnnnnnnnnnnnnnnnnnnnnnnnnnnnnnnnnnnnnnnnnnnnnnnnnngggggggggccttatgttttgccccgggccaaaaaaccccaaagttggccgggggggacccccccgggggggattccctttttagggaaatccccaacgacttttccgaggggcccggaatggggggcggttttaaccccggttggaggggctccggggggagcctccccaaggggccccaaccccctaatttccccttctacttcttcaaggggccttttaaaggggaagtctttnnnnnnnnnnnnnnnnnnnntttttttggcgttttttttcccggcccataggggttcccccaggaccttttggaagcttccttggaaagggggggaagggaaaggttctttaagggtggctcggaagttgccggaaattgggaaaaggg

SEQ ID NO: 16605 - DNA, 480 bp, Diabrotica virgifera
acggtgtagcccagcgactgcgcctggctgcgctggctgatttcgatccacacagcttccagcccaaaagccggatctttggcggtaatcccgttgaggctgccgaacacctggcccgggttgatcgccagttcgcggtccgggtagatctcggcttcggccaggatcacccccatcagggtcaggcggtaggcgctgggagccaggtcgaggttgtcgcggatgtgcacggtaggcatcaggaagcccaggtcctgggacaacttcttgcgcacacccttgatccgcgccagcaactgcccaccctggttgcgatccaccaggggaatcagacggtaaccgacttccaggccgatcatgtcgatcggggtcacgtcgtcccagcccaactccttggtttcaagggcccgggccggcgatggcagcagttcctgctgacgcgccacttcctgctgggaaatcaccttgatgatgttttgc

SEQ ID NO: 16606 - DNA, 234 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (169)..(190): n is a, c, g, or t
  misc_feature (203)..(230): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntggtcgacttttaaaattttacctgatctgaggtttaaccggtgtgagccagggtggtttctatccnnnnnnnnnnnnnnnnnnnnnnaacgaaaggaccnnnnnnnnnnnnnnnnnnnnnnnnnnnnagat

SEQ ID NO: 16607 - DNA, 330 bp, Diabrotica virgifera
gtatttaacttacaaaattactgttctttaacttccctaagacgccttacagcagatctaactgatgcagccgctgtggttgagtatacccatgcacctccagctacaaccctcttacacctcttgcaggaccagattccaacacaactcctcttcatggcttctttgccgcaaaaactgcaggagtatttggagtgttgggtgatttccatttttttcaccattttacgcaaggaagcaccataacgggtaccgtatttaccagtgattccgaccttctttgtacgcttggccattttcgtgggttacttattggaacctagatttaac

SEQ ID NO: 16608 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16609 - DNA, 446 bp, Diabrotica virgifera
cccatctctccgtcttattccctcttcttccaacttctttctccgatctgtcgcgctctgtagatcactcctgggtagaagacgctgtacaatcagccgcgacttaatattgacgaaccctcccctgtgactatcacaacatccgctatatctgtttatgccaaaattaaatggaaatgtgatgaaagaaagatcatccgaaaatgttgttgaaaacacataatcttatgatgtatttgacctgtgaaacaatctgccgatattaagatttctaccattcccgtcgatgccgcttaccgggtgatcattaatatatccacacctgattgctatgccatactgaatgaaaaagaatctcctccagcaaacgctaatccagacgatcttactgggatactcttgctatatattcgagttcagaggtttcttatggttttatatatgat

SEQ ID NO: 16610 - DNA, 804 bp, Diabrotica virgifera
cccacgcgtccgaagtagtgaagttctcggtgtcgtttataagtattttaaaagtaaaatttcgtttttagtgattgtaaatataagtgataacttaaagacaatggcaatgttattaatggtcctgtctatagctggatctatcctcttaaccccttttttaatgcttttagtgtgtattatatttttggcatctattggcaagagtttaggagttcgacgactctatgtgaaaacattgttgatgattttcgagtacggtcgaaaagacatagaatcgtcgttaaatcataggaataaagaagtgccagaagacatagatgaaggatacagtgaagaaattacacaatctgaaaaaagcgcagaggaacctcctttagccaacggtctggtaaatggaggaaataatgtgataagccgagacgaaggattaatatttgtacccgaaccacccacgagtaagactgaagaagccgtcaaggaggaaaaattcaaagattatgagctttcaaacgtattcgagtatgttaaggctggagtagaagcaataattgaagatcaagtcacttcgagattcgaagccgaagaattgaaaaattggaacttgttgatacgcacaaatcgtggttatgaattcatatcatggaaacttacattcctttggctcggtggattcttcattagatatttcttcttatttcctttgaggctgataatttgctgctttgggtttctctcactgataatatcaacattcgcactatcagcatgcccggggcggatctggtcgaagatgggctcatg

SEQ ID NO: 16611 - DNA, 1216 bp, Diabrotica virgifera
  misc_feature (25)..(44): n is a, c, g, or t
  misc_feature (73)..(95): n is a, c, g, or t
  misc_feature (200)..(239): n is a, c, g, or t
  misc_feature (340)..(363): n is a, c, g, or t
  misc_feature (579)..(602): n is a, c, g, or t
  misc_feature (615)..(632): n is a, c, g, or t
  misc_feature (666)..(688): n is a, c, g, or t
  misc_feature (919)..(937): n is a, c, g, or t
  misc_feature (1111)..(1140): n is a, c, g, or t
  misc_feature (1149)..(1175): n is a, c, g, or t
agcagaattaggaaggcccggatcnnnnnnnnnnnnnnnnnnnntttataatgttattgttacagctcatgcnnnnnnnnnnnnnnnnnnnnnnnttatacctattataattggtggttttggaaattgacttgtacccttaataattggtgctcccgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattacgttttattgtttgagctcatccatatatttacagttggaatggatgttgatacccgagcttattttacctcaccaactataattattgttgtaccaactgggaattaaagtatttaaaatgatttaactacttatccatggaactactattacatatagtccagtaacactctgagctttannnnnnnnnnnnnnnnnnncgttggagggttacagggggtagttttagcaaacccctcaattgatattggaactctttgaaacccattatgttggttgcccttttttctttatttattatcttaaagagactgatattgctatttaaaaggggaattatatccaaaagattttccttttttttccgggaatannnnnnnnnnnnnnnnnnnnnnnnnnnnnnatctatttnnnnnnnnnnnnnnnnnnnnnnnnnnnagaattttacacccccccctcctcccccccactcttttttt

SEQ ID NO: 16612 - DNA, 332 bp, Diabrotica virgifera
  misc_feature (10)..(40): n is a, c, g, or t
  misc_feature (42)..(74): n is a, c, g, or t
  misc_feature (81)..(162): n is a, c, g, or t
  misc_feature (231)..(251): n is a, c, g, or t
aaccctatannnnnnnnnnnnnnnnnnnnnnnnnnnnnnngnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnnnnnnnnnnnnnnnnnnnnnnnnccttagggataacagggaatttttttggagaggttaaaccaaaaataaaaattgcgacccccaggtggnnnnnnnnnnnnnnnnnnnnnagacacttatttttttaaattctgtcccccttttaaaaattttatatggttctgggataaacccccgggggggagcccccg

SEQ ID NO: 16613 - DNA, 566 bp, Diabrotica virgifera
  misc_feature (288)..(307): n is a, c, g, or t
tgatttcgaggaataatacgaacttccatagattcaaatgaagtaaacaacatacgtttttcatttaaaatgaactcacatatgcaatgcattcaacattccatagattcagtgaaaacacgccatcgggttctattttgcgcttaggccttcacctcgtttcaaggctatccttaacatcttatctcgtctatgatatatcttctccaagtttgtgctgggcaaatcaatcaatttgcctcgaaatctaaggttatattacttttatgaatcgtgataacatgcatnnnnnnnnnnnnnnnnnnnnagttttttgcatttttattcggcttattgtaatattcctccatagttcttacatccttgtttatttccctttttgtggagaggtactatgtgtgtttggctagattctgtttgacattcgaaaagtaaacgtcagtttgcgtttcaatgcatcgataagacgaatggtaaagctgctaaaaaagcaggaaaagcccagaagaacgttcgactttcacttcattctatcggcctttcctctctttgccgtattttatttt

SEQ ID NO: 16614 - DNA, 333 bp, Diabrotica virgifera
  misc_feature (22)..(44): n is a, c, g, or t
  misc_feature (166)..(183): n is a, c, g, or t
  misc_feature (293)..(310): n is a, c, g, or t
ctctgcttaatctctcttatcnnnnnnnnnnnnnnnnnnnnnnnctcttcaaatatcgtcaatcaaagttgaatacttggaaagaaaaacgccagacaaagagggagggaggaaaaaaccaaaaacaccccgcccagaggaaaccgggagcaaacaacagaaatgnnnnnnnnnnnnnnnnnnggaaagagaaaaaaccccgatctcacaaaggccagacaacggacccaccccccaccccgccggaagcgagggggaaaacgacacccggaacacccgggagcaaccgcggnnnnnnnnnnnnnnnnnngcccgccccaagaaccccaaacc

SEQ ID NO: 16615 - DNA, 1277 bp, Diabrotica virgifera
  misc_feature (1009)..(1044): n is a, c, g, or t
  misc_feature (1061)..(1098): n is a, c, g, or t
  misc_feature (1101)..(1149): n is a, c, g, or t
  misc_feature (1181)..(1206): n is a, c, g, or t
gacatgttgttacaaaacattttggagagaagatcctgatgatgatgttgcagaccataaagtaagatacagtgaagattgtcaagcatttgttaatacgactgaagtaaaagaagagtttataaaagttacatgcagctacaacaatcgtgatatttatactgatttatttgcttttgtccctgtaaaaaacctatcggaaaatgtgaaaaacgatctgatccaagacgagtcctctttaaatattttagtgttgggcttagatgctatttcaagattaaattttcatagacaaatgccaaagacattaagttatttagaacaaattggagccgtagaaatgatgggatataataaggttggtgacaatacatttcccaatctaattccagcattaacaggaaaaactgtaaaggaaatcgagaacgattgctggccaactaaaacacaccattttgataaatgtccgttcatatggaagagctacaaacaaaaaggatatgtaacagctttcgacgaagactcttcttgggtgggaacatttaatcatataaaaaacggtttcaaaaaacaaccaacggactatgctttcaactattttgattttgaggctataagattactgggaaatactgggttggaaactgttgaaatttgtcaaggagcaaggtgggtatataaagttcatttgaactacttatccaatttcgttcgaacgatggaagataacttactaaagtattttggctttttctggcagaacagtatatctcatgatgatctaaatttacctagaataggtgatgatcattactactctatgtttaaatattttgggaaaaatggttatttcaatattacatttctcttcgttttgagcgaacattggaataaaaaactggtaaaaataagaaagacattcccagggcatggtgggaaaaaaagattaccgttacctttttgtatatttttcccaaattggtaataaaaaaacgatacccatcccggnnnnnnnnnnnnnnnnnnnnnnnnnnnnnnnnnnnncgtttaacaacaccccnnnnnnnnnnnnnnnnnnnnnnnnnnnnnnnnnnnnnnggnnnnnnnnnnnnnnnnnnnnnnnnnnnnnnnnnnnnnnnnnnnnnnnnncccacataaaagtctataaagagggggaaagnnnnnnnnnnnnnnnnnnnnnnnnnngggaaaacaataacaaattttttgggaatatcttaaatgggccttttttgttctaagcccccccctcgggt

SEQ ID NO: 16616 - DNA, 712 bp, Diabrotica virgifera
tatttctgtcatacgcaacaaaaaagctgtacctcggggtacgaaatgaaaacagttttattagctttttctgtcgttacagctatttctataagcgcattgaaagtcattgaaagacgactcctatactacatttatttccaaggtaagctcaaggtcacaatgaccgttgctgtgtcgtgtcgtctcagcttttcagtggctaaaagagacggtagattaaaaatgagaagctgtgacgacacgacacaacgaccgatcagttgtttgcaactatgacctcgagcttaccttggaaatgaacatagtatagttagtatattcacgaagataattacagcaaggtcctttatagtaatgacacgaaattacgaaatgattaaagacgtaactgcaaacaaaacaatcaactccaagagaagcattgtttcaccttgtgactacttatactagctcattactgtgtccaattcctagtagacaattttatttattcaaattttctgacccaaccattgtctctactatagagctcttgttataacttttttcctctaatttttttttagggacaatacttttaagaaagggcacaaaactagtaacttacagcttttatcgtatcattgaacttccaatagcaatggcttttagaaatttaatttcgctaattatggaacattaagttgttaccaattatattccaacccat

SEQ ID NO: 16617 - DNA, 222 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagactttataattggtgtagcagctatattataaactttaatccaacatcgaggtcgcaatctttattatcgatttgaactctccaataaaattacgctgttatccctaagggaatttattcttataatc

SEQ ID NO: 16618 - DNA, 894 bp, Diabrotica virgifera
  misc_feature (43)..(67): n is a, c, g, or t
  misc_feature (220)..(239): n is a, c, g, or t
  misc_feature (251)..(278): n is a, c, g, or t
  misc_feature (331)..(350): n is a, c, g, or t
  misc_feature (675)..(694): n is a, c, g, or t
  misc_feature (740)..(759): n is a, c, g, or t
  misc_feature (815)..(845): n is a, c, g, or t
ttcctactgtatctactattacttgtatgctgcttctatggtnnnnnnnnnnnnnnnnnnnnnnnnntagaaggttgagtgcttttatttgtaagtctggtataatttgattatttttggtaattaaaagttaattgattttttcagtaaactcgtaatgcgtaaccacagttaagtagagcatagaatatatctttatctacattagtttaaaaactgnnnnnnnnnnnnnnnnnnnncaatctgtggcnnnnnnnnnnnnnnnnnnnnnnnnnnnntcgagatgccatacaatgaaacaaattatgtcttgatacaatcatttttctgnnnnnnnnnnnnnnnnnnnngtcgtcataagcaattaaatatagatgagttactactacttaaaacacttgtgataatgtattcgaatattttacaaaataatgtatccgcttcatatacatgcttaaagacaaatatactgtgatattggtatggaatgtatgttgaagtacttaaattatgtggaatacctctatatttttggatttattttgaaaaattatgacaccttactaagcagcgaaaatttttaacccatatgtcttggaaaatcaatttttaactatgggattggttatttcttatcccaaacgctttttttgtccacattccaaattgattctnnnnnnnnnnnnnnnnnnnnctggattatacccccaaatttttagggggggggaaattttgaaacnnnnnnnnnnnnnnnnnnnnaacccccgggctatttttccatatttccggatggaattttttccaaatttttaccnnnnnnnnnnnnnnnnnnnnnnnnnnnnnnnttggactttgggccattttttccccctttttttttccctggatttcaaa

SEQ ID NO: 16619 - DNA, 783 bp, Diabrotica virgifera
  misc_feature (21)..(42): n is a, c, g, or t
aaatatgaggttatttcaaannnnnnnnnnnnnnnnnnnnnnctaaaaatataggacatagctcgctcaactagtcaactaacagtaaatagaaaaaccgtaattttagaaggatttaaaaatttctcaaatgttacatcaccttgtggaagaaaaccaaatttgagattttaatgacttacctaaatataaatatataactattttaaggtatcagactgttcaatgtcccgtgctcaagatcttgcttgcctgctgaaatctttgcaactaatcgcggaggcttgcgttaaattgcaagcagagaaagccaagttcatatggtcgaattcaagtttgagacatgccgcagagagctgctctactgcatgccaaaaggccccgcagttcggtgggacaaatccccctgatcttaaagacagcattgaccgggtatctaccgtcttgcatggattgagagtgtacacaaacgtggccttgggccagaaagatacagtgacagcaatttctgctgaaatattgaaggacacatcaaatgtattgaataaggaggattacaagagaccacctcagctcaaacctgaagttttagacagtaataataaagtatatactatagaattaacggaggatgacaaaaagctcctaaaaagattagatatggaacacagagcaaaattaatcaaagaaaaagatagggaagagaacaaagatttgtctacaagagaaaaagaagttaaagctaaacctgtgaaagaaaaagaagctgcccaaataacagct

SEQ ID NO: 16620 - DNA, 141 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaac

SEQ ID NO: 16621 - DNA, 726 bp, Diabrotica virgifera
atttaacgccataataataaccaaatacttctgaagttactgacaagttttggatagcggtaataacattctaaaagatgtggccttttggcctaatccactgcgaccttttcagatatattgtggtcctatagtcctagattacattctctagcctgaccctttttaaaaggtccaatagcttcgaaactgaaccttccatgtagctatttgctggtggattttcttctcctaatgcaaagaaccgcatatttgctagactgtcacactgacatagaatgtgctctgctgtttcttcttccaggttacagaatttgcacaggtcataatctgacaatcccatcagcttcaagtgcctattcagcttacagtcaggcgcggatccaaggggggttcaatggagttaattgccccctccttgagatctcgcttggtgtctactgagattttttttaggaaagaaataattacgattgaaaataaatagtgaattttgtctcctgttgataactggataactgaaacataaaacagaattccttggaatcgaaaattattaaaagtctttggaacataaacgaaaaattcccattataaatctgtttattatcatctaatgtcagagatcagataacaatagtaatttgttttttctttgtggcaattaatgagtcagtttcgtctcaaaaaatttcattctcacctgaggctatgttaagatctgaa

SEQ ID NO: 16622 - DNA, 699 bp, Diabrotica virgifera
gaccattcaagggtaggaaccggaatattggagcatttgtttaaacacagtgaagaaacgtgtagcgacgtcgttaggcttggtggtttggatgctttactattcgaatgcagaaaaagtgacgtagaaaccttaaggcactgtgctggagctttagcaaaccttagtttatacggtggtaccgagaatcaagaagctatgataaagcgaaaggttccgatgtggttattccccttagcattccacaccgacgataatattaagtactacgcttgccttgccataaccgtattagtagctaaccccgaaatcgaagctgaagtcttgcaatctggcactcttggtctggtcgaacctttcgtcactacacacaacccttccgaattcgcgaaatcgaatctagctcatgctcacggacaaagcaaaacctggctgaaaaatttagttcctgtcttaagctcaaaacgtgaagaagctagaaacctagccgccttccatttctgcatggaagccggaataaagaagcagcagggaaacactaacatgttctctgaaatcggtgctatcgaatcactaaaaaaagtagctagttgtcctaatgccgtcgcctcaaaatatgcagctccagccttaaggcttatcggagaggaagtgccacataagttaagtcaacaggtgcccttatggtctgtggaggat

SEQ ID NO: 16623 - DNA, 629 bp, Diabrotica virgifera
  misc_feature (42)..(59): n is a, c, g, or t
aggcgtaattttcatcggaagacctgttttcgaattcagggnnnnnnnnnnnnnnnnnnctggtaaagatgctttgaatacgctacttgcttttactctggacgaactttctttaaatgaaaatatacaaaagaggttaagagaagaaattacagaaaatgttcgaaagatcaatggcattacctatgacggactactagaaatcaaatacctaaaagggagtgtaaatgaaatagtcaaaaaatatccgcctataccgtacatcgacataatgcctctctccgaatacacgtgttgagggaccgacttgatagtacaaaaatacatgagccaaaaaataccatttaatgtcctatcaagacatgagaagcgtttgcctatccatgacgaatgaaatctatccaggctggtggtgaaactggtaaaatgatatgaaattacgaatagctgcagatctaaattcacatgagcaaacaatcgggggtaccctcgggtcaatcagagacacacttctagtggtaccgaaagatgtcaaagaaaacaacgatttggaattgtggtaccctccgggtgtcaggagattactacaaacagctatcccagaatcatgcttattacaaagggttttt

SEQ ID NO: 16624 - DNA, 847 bp, Diabrotica virgifera
acaagccatacatcacacaagctttacgaacaacgagatagacatgtacaactggagccttttccgttcaaaccagaaccagaaaagcctagggcaaaagtagctcctccaccaagcccatctaaattcataaaaggtgggttcagagaaagcgattatgagagcgactatgagagaagagtcaacaccacatggagctctaaccaagaacctcaatacaaaccagtacatccagttttaacaccaactaaacagcatggtcaacagtatggaagaacccctacaccaccaactgagtttgaacgtccacaagcctttggttcttcccgccccaagtttgaacccattaaacccgagactaaacctattccgaaacatgtagtttataaacctaaaccaatgtcagctgctccttccgattacgttgctcaaaaggggttggtccttcaacctggtccacctccagagtttggttatacacaaggaccgacgaaaacccagtactacaaatccactgtaagtgccccttacactaatgctattcaacatgaaacgtccaatttagtccattttaacgaatctactgaaaactgtcaccgtaccatgagcgttcaacagacccataaggtgattaaatttggtgacaaatacaagaaagaaggaaaactggaaccttttcctttccaagcaggaccggagaagcctcgaagagccacaagtgttcctcctccaccaactcctactaaattcataccaggcgactttagagaaagtgattatgaaagtgaggtagagagcagtagaatcaaacaaaaatggacaccacatggtgcagacgacagaaatc

SEQ ID NO: 16625 - DNA, 676 bp, Diabrotica virgifera
gaatgtttatgtttatttcaatttcaaattaaaaacattcgttcggattaaatagctttagctatggaatttaaagttgaaattaaggaagagtgtattgaatataaccaaaaagatatagagagccagctatccacatccatagatcttgaaaccttcaaaaatgaaaaggaagataattcagaaatgggactaaaagctgaaatcaaggaagagattgcagatggttgtccagaatatatagatagtcaacaatgtatatcccaagatcttgaagactcggttaaagcagatgaagttaactcagtatctgcagctccagtttcgaaagcagtagaaccattacctgttgcagtgatgcctccatcagcgacaatggctccaaaaacgcagtcaactattcttccaacctctgcaaaggatcaggatgtggatcttcgtcagttaccggcaatgatgactaaaaagagatcttcaacagaaatctctgaagatgtatcaatgccagccaagaagactaagacacaaatatttgacaaattgtttggagacgaagataccgatctaaggcaacaactggacattaataccgaacaacggccgaaaatccccctccaccgattatttcgaatccgctaccaaaccaaaaatgcttccccaaaaaggggctccccca

SEQ ID NO: 16626 - DNA, 408 bp, Diabrotica virgifera
  misc_feature (325)..(373): n is a, c, g, or t
ctaaaagtagatggacccaaacctatgccattttatggcaacttttatgatatagttaagatgaaatcaacaatagcgcaaagtttaaaacaattatacgactatactgatgctccgtatgtcggaatatatgtatttgacaaaccagtgttattacttcgttctcctgaattaatcggagatatattggtaaaagattcccatctgtttctggataaaacaatagtaatgcctaaacataacgtactcactcaaaactttttgttttttcaaactatgccaaaatggaaagaaaacagaactaagttcactccttgtttttcannnnnnnnnnnnnnnnnnnnnnnnnnnnnnnnnnnnnnnnnnnnnnnnnaactggaaccgatatattgctgattctcctgaaat

SEQ ID NO: 16627 - DNA, 600 bp, Diabrotica virgifera
  misc_feature (499)..(527): n is a, c, g, or t
aagatacatctggtccaactgtttttaactgccctctttttttcttcagataaaagctgagaaaatggattgtttgttggcgtattacaacgagaaattcaccaaaatcgacgggaatattttcgatgtgttttcgaaattttacaacctagacttaactccagtggactcttggcttgagaatcagtttaaaaataaagtggcaaaggataataggacatccatccattacaggaaggaaggaaacaaatgttatgctcaaaagaatttactaagaagtttggagttttacacaaaaagcttgtgtaatgccacacctggaagtagggagtatggccttgctttggctaacagatcagctgtttcttttgaaatgaaagagtatgagaactgcttgaaagatatagatctgtgtttcaaaactgactatccggtggatctcataccgaaaatttacttcaggaaggcggattgtttcgtcgagaccggccagaaagannnnnnnnnnnnnnnnnnnnnnnnnnnnnaaaagtttcttagtataacattagtcgacgatagagataaacactttgaaaaattcaaaacagatgaaaaagt

SEQ ID NO: 16628 - DNA, 688 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (381)..(397): n is a, c, g, or t
  misc_feature (399)..(419): n is a, c, g, or t
  misc_feature (421)..(437): n is a, c, g, or t
  misc_feature (440)..(452): n is a, c, g, or t
  misc_feature (560)..(601): n is a, c, g, or t
  misc_feature (639)..(679): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgcnnnnnnnnnnnnnnnnncnnnnnnnnnnnnnnnnnnnnncnnnnnnnnnnnnnnnnngannnnnnnnnnnnnctcccaccccttcattcccagttttcaataaaaaaactaaatgattatgctacctttaccccgggcaaaatacccgcggccattccaatttatccggggggcaggggnnnnnnnnnnnnnnnnnnnnnnnnnnnnnnnnnnnnnnnnnncggggaaaaaaatgttgccaaattcttttttaaacccnnnnnnnnnnnnnnnnnnnnnnnnnnnnnnnnnnnnnnnnncccccttcc

SEQ ID NO: 16629 - DNA, 233 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (168)..(194): n is a, c, g, or t
  misc_feature (204)..(227): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatcnnnnnnnnnnnnnnnnnnnnnnnnnnngaaaggaccnnnnnnnnnnnnnnnnnnnnnnnnctagat

SEQ ID NO: 16630 - DNA, 851 bp, Diabrotica virgifera
  misc_feature (163)..(183): n is a, c, g, or t
  misc_feature (298)..(315): n is a, c, g, or t
  misc_feature (488)..(505): n is a, c, g, or t
gctccttgtatccgaatcatttagtgacttgtaaccgttgacctgatgatgctctgcaacctatagagagcgaaaccggtcgtcggaagtacacaattaaatgattgagagtacgtctgtctttttcttcatttaaaatgaactctcacatgcaacccattcnnnnnnnnnnnnnnnnnnnnngtacagggtgtttttgggtcggaatatttttccaatattttttaattcggccctggatattttataattgtaaataaactaattgattgggcaccttaaacaatattctgtgttnnnnnnnnnnnnnnnnnncagtgtgtttaacaagttttaagtattatttcaatttttttctacttcgagctctcgcaattcgcataatttcagaattcaaattcaaaattttaccagaaaaatcattttgccaaaagttcaaagtataccaataaatttagtttttcatcatcttttcaaatacaaaattnnnnnnnnnnnnnnnnnngtacagggtgttgtttttgggtcggaacatttttccaatagtttttaatccggacctggattttttacagttttgggtaagttaattgattgtacaccttaaataatgtttgcttgccaagtatggggtaaatatacagtgtggttgaagagttgtgaaccaattaggaaggtggcaaaatagattaaacacccagtatctttgttattgatggggtaggactcattaagtgtggtatttttgagaccgcctaggtgtcctctttctacagttaaccttagtttattttcacaatgaaacatcctgtatagtaacatggccgtagaaacatggatcatgacagaaa

SEQ ID NO: 16631 - DNA, 554 bp, Diabrotica virgifera
  misc_feature (159)..(181): n is a, c, g, or t
actgaacgaaataatcatctctatgttgctgatgacgacgtcgctgtcaactaatgtttacatcttctgccaagcttatgtgaataaactgtagaaaaatatacataacattccaaattttatgcaaatcatagaagaaatatagacgtacgattttcnnnnnnnnnnnnnnnnnnnnnnngcacctaaatgcaaccataactattgttacagtgctcgatttatgaaaattctttgtgaacattgaaaatatttcgtctaaaagatgaactgttatcttaacaattgagctagtccttgactagaaataaacaaaacggaattttgagggaaattaaattaaacacttgaaaaaatatctgagtttgagtcataacgtctaaaagagtctaatttggtaagtagctagattcaagcgaaagtttgattgatttcgtttactagaatgagatattcttttcttttccctctctttcacttacttcttttctgatgtattttaaattacgtgtcattttctatcaaatcaaccattttcatcaccattcaaactt

SEQ ID NO: 16632 - DNA, 495 bp, Diabrotica virgifera
gaagaatttcctaaggattttttatttggaattgcgtcaagtgcttatcagattgaaggaggttacaatgcagatggaaaaggagaaagcatttacgattactataccaaaacaaaacatgcgaggttttataacaatagtaatggaaatatagcatgtgactcgtaccacaagtggagagcagatgtgaggcttctgaaagatttgggtgtccaattttacaggttttcaatatcatggagtagagttcttcccaaagggtattctaacaaagtaaatccggacggtctacgatattataatgatttaataaacgagttaaaaaagaacggtattgaaccaatggtcactctttaccataacgatctccctatgcctctacaagaaattggaggatggactaacccttatacggcatactactttgaagactacgctaggtatatgtttagttattttggagatagggtaaaatattggaataacaatggaaat

SEQ ID NO: 16633 - DNA, 583 bp, Diabrotica virgifera
  misc_feature (247)..(265): n is a, c, g, or t
  misc_feature (312)..(326): n is a, c, g, or t
attacaacattttttactaagtatatcttacggggtttcacagatgtctttgtttccatactttgcgcgcgcaacctaaccttgatttggagtgccttatcctaacatttcgtctacttcttcgacaattgacaaaagacattgtcaaatatgacgaggcgacgatcggagtgttcttttggctactcttgtcgactaaatctgcttctggagactcaggtggaacacagtttgtgaagatggagtnnnnnnnnnnnnnnnnnnnaacttcagtttgttattattgtttatatttatcttagatctgattannnnnnnnnnnnnnnatataaatgaaattgctggaaagagtagcctggtcattgccaatataaaccaacttaatttataagtaccttttaatttgtaattatttagtacaggataatatttcataaaataaaaatctactcttccacacctttcttattgaaagtaaagctaaagctttcctagatatttgtttactatttttctgacataattatcataaattgtacacttgctacatttctgaacagggttttttgattttatcagggtg

SEQ ID NO: 16634 - DNA, 133 bp, Diabrotica virgifera
  misc_feature (29)..(29): n is a, c, g, or t
  misc_feature (79)..(101): n is a, c, g, or t
  misc_feature (109)..(131): n is a, c, g, or t
taacagcgtaattttattggagagttcanatcgataataaagattgcgacctcgatgttggattaagtttataattggnnnnnnnnnnnnnnnnnnnnnnntgttcgannnnnnnnnnnnnnnnnnnnnnnag

SEQ ID NO: 16635 - DNA, 1177 bp, Diabrotica virgifera
  misc_feature (685)..(702): n is a, c, g, or t
  misc_feature (704)..(739): n is a, c, g, or t
  misc_feature (786)..(812): n is a, c, g, or t
  misc_feature (1101)..(1126): n is a, c, g, or t
  misc_feature (1128)..(1145): n is a, c, g, or t
attaagtatctattatcataattatctagaaagaaagaactaatctatattcacactcaagatgcagtagaatagtgcaattaataagatcttctgataaattattgttacattcaggtacagtctttggtttcttagatttacgtagagattctttaaaggggttcaggtctaatgtctaatggttacaaaaatggtaaaagcaccaacacggccttctgcgacaatggagaatattcatgttttatactgcaccagaattctgtcattatattttccataagatgtgtgcggtgtccataaaatttaatgaaggaatttccatatctaaacctctgaatgttaatatattaagcagtgggaaaatatcaagtaaatcgatgtagtaggatggaattcggaggccaataccctccctgactggtctacattggaggtattttattttggatgatacacgatcatattttcttatggcaaaggacaatggggacccatcgggggggacatcatcattgattcctctttgggggtacattgggaccacatccttccctattaatggcttctatggcataatctttcctttctcctggactaaaactttcatacaggtgcattaagtttctggtaaaaattttcccaagggtacagaaatgagaggatagatacaccttccccaacnnnnnnnnnnnnnnnnnngnnnnnnnnnnnnnnnnnnnnnnnnnnnnnnnnnnnncagggaaagatttttccgggacaaaataatctacaaattttttacannnnnnnnnnnnnnnnnnnnnnnnnnngctctaaaaggaccccaggtttaactacgcggggatggggacggctaacttccttttataggggcccccaaaattcaatttccctgggccggcggttttcaaacggccggggcggggaaaaaccccggggggtaccccactttaattccccttggagcacattcccccctttcccccgggggggggaataaaggaaaaagggcccgccccgaatcgccccttcccccaccgttgcgcccccctggaaggggggaaggggatggcccccccggggggggggcgtttaaannnnnnnnnnnnnnnnnnnnnnnnnncnnnnnnnnnnnnnnnnnntttaacatttttggccaggcccccctattggg

SEQ ID NO: 16636 - DNA, 811 bp, Diabrotica virgifera
ctttaaataattttgtaaaagaaattatgtttctcatgagtaagacttttaatattatatctagaacagtagctggcacatcaaatactaaaatcgttaagataatatttccattcatctcggaaagacaaaataccagtataaattatgtaaaaaggcattgttcaacagttgcaaacaaagaagaggatattaattataatgatgtgacaaatggtgataaagaattggaacataaattaaaggtactgatgttagaagctgaagtaatgcgacaagaaggaaaagctgtacctgaacataattttctcagagaaaaacattggaaagaaattttgaacctttcctcaagatctgcaagacaaaaatatttagagtatctatttaagctatcaaaaagaaaagaaaatcagaaggcaaaaaaggaagaaaaaagactggcatttgaagaatatttgtccaaaaaggaagctgaacccaaaaaagaagaaacacttgaagaatttgccctaaagtatgatcttcaacacaataacttatttttaagaatttatgagacaactataaaccaattatacaacaaccgattgatccaagctatgcagtttggccagaaattggtaatagattgtgggtatgatgtgaatatgaccaaaagggaaaacatgaattgtgctaaacaatttatgttgttatttgctgaaaataggttgcatgatgatccgtttgacatccacttttgcaatgcagataagaaaagcgatttaatcaaacaattttataaatacgttccaacgatagacgagccatg

SEQ ID NO: 16637 - DNA, 817 bp, Diabrotica virgifera
  misc_feature (263)..(299): n is a, c, g, or t
  misc_feature (396)..(415): n is a, c, g, or t
  misc_feature (632)..(655): n is a, c, g, or t
  misc_feature (682)..(700): n is a, c, g, or t
  misc_feature (783)..(816): n is a, c, g, or t
tgtctttgtaggttttaaaaatgggagcctacaagtatatacaggagttgtatagaaaaaaacaaagtgatgttcttagatttttactgagagtgagagtgtggcaatatcgccaattgactaaactccacagaactcccagacccagtcggcctgacaaggctcgcagaatgggttacagggccaagcaaggttttgttatttaccgtattagagtacgacgtggaggacgcaagcgtccagtaccaaaaggtgccacctannnnnnnnnnnnnnnnnnnnnnnnnnnnnnnnnnnnncctgtccgtaacttacaagctattgctgaggaacgtgtaggaagaaggtgtggtggattaagagtcctaaactcctactgggtagcccaagattcannnnnnnnnnnnnnnnnnnncattttggtcgacccctcacataacgctattcgcaaggaccccaaaattaactggattgtcaactcagtacacaaacacagagaactccgtggcaaaacttcctctggcaaatcatctcgtggtttgggcaagggtcacagatactctcaaaccaagggaggatccaggcgtgccgcttggctcagaaggaactcactgcaattgcgcagaaaacgnnnnnnnnnnnnnnnnnnnnnnnngaccaataaaatttacggattaatatnnnnnnnnnnnnnnnnnnncctgttacatgaaagttaagaacacattttatgaatgttcattcatttttttaggaatatgtttttgttaataaacttcttgnnnnnnnnnnnnnnnnnnnnnnnnnnnnnnnnnnt

SEQ ID NO: 16638 - DNA, 540 bp, Diabrotica virgifera
ggcggcgcggtgcaggtcgtcgcgcgagcggtacagcagcgtcaggccgacccaggcgcggtgcgggaaggtggcggccagccagcgcgcctgccgcgccatgcggtcggggtcgtcgccgtagaccggcgacaggatcgccaggcattcgggcaggtggcgcaagtgttcgtagcccggcggcggggcggtgaaatcctcgggcgccagccggtattcgcccttgggggcgcgggtgcgggccagggtgatgagttcggacaggttgccgtagccctcgcgggtctgggccagcagggtcaggtccagcggcgcggcctcgggcccggcgcgcagccggaaggtggcgccgatgatgagcggcagcttctgggtcttggcctccatgtgggcgcgcaccacgccggccaggctgcattcgtcggtgatggccagggcggcgtagcccagctcggcggcgcgggcggccagttcctccgggtgcgagggcgccttgcaggaacgagaaagttccgactggcatttgccaagttcggcgta

SEQ ID NO: 16639 - DNA, 589 bp, Diabrotica virgifera
gttgttctcaaccacgagctttcccagttacgcatgttttgtttgatttggacggggtgataattgaatcagaatcgatatacgaaaagatctctgctgatatctgtcgagaatacggaaaaacatacacgaaagatctgaaatctaaagtgatgggcaccccagagtttgaaatctaaagtgatgggcaccccagagtttgaaacctgtcgaataatagtaacagatctaaatttgcctctgactccagcagaatttctaaagaaatatgaagataaagtatggatagagctacagaggcctgagttgttgcctggagttaaagatgttgtgaaacttttccacaaacatgatgtacctattgctattgctacatcttccagggagccaataatgaaaatgaagacaaaacctcatagggaattaataaatctattcccgccatgtcgtttgtggcagttccgacccagaagtcaaaaactacaaagccctgctccagatatattctttagtgccgggattacgatttctcacatcaaccaccatcccttccaggcgcctcgttctcaacgaccctccccccgcccct

SEQ ID NO: 16640 - DNA, 501 bp, Diabrotica virgifera
  misc_feature (63)..(85): n is a, c, g, or t
ttaaaaacgatgtttatttagatacccacatttaagtgtgtaaataaaagtctcagtataaannnnnnnnnnnnnnnnnnnnnnngttaagaaactagccaagaaatatgatgctttccttgcttctgaagccctcatcaaacagatccccaggttgttgggtccaggtttgaacaaggctggtaaattccctggtcttctctcccaccaggaatccatgacacagaaaattgatgaagtaaaagcaacaatcaaattccaaatgaagaaggtactttgcctttctgttgctgttggtcatgaaagcatgaatcaagatgaattggttcaaaatgtccatctttcaatcaacttcttgggctcgctggtgaagaaacattggcggaacgttaggcctctccacgtgaaatcatctatgggacacccacaaagagtgtatttacatgtactttgatgagtaaaacgtttatggcgactgcgtctcgatggacggaaaataca

SEQ ID NO: 16641 - DNA, 524 bp, Diabrotica virgifera
ctttgtccgagaaaattttcccttgaatgttataattgtatcttctgtacatagttattttattcaagtattaattcttcgcaacgtttttcaaagcgctggtaattattttctttactttccaaagtttatcgttattagtcttgtcggtgttgacatctgagatgatatctcaaatgtcatcagatacatattatgtaaattattacgtaagctttcaaatcggtttcgggacataccgatatctttaatcaaattgaattgtgtccggggagcccaataaagtcttagtctcaaatggtggctcttctgaacagtcactttcatcataactaaaattactttcacttggtcaatcgaaaataccatttggaggcataacttttccggtcttccaaatttttttttcactttttttatgcttttgaggaatttcttcttttctaatggtacttcctcctcgtccgatgttgataggtgatagatagattagccccttcatcttctatatcacaacagccgtc

SEQ ID NO: 16642 - DNA, 415 bp, Diabrotica virgifera
ccgcccttttagcctccataatgactatcaagtgcttttggatcggtaattgttgagaaggtgaagagactgcctgatactagcctgcatggacaagctgaacaagaatgcgatatttggacacacaacaaggcaattgtattcgaggtcaatgatgtagtagaagaaccatgaaggaattgctttgcgcgtagggacgtcggaagatgatgcaccacgaaaagaaaagattggatattaagtgacgatcctaccagagccagatgaagctaacgaaatgcactaaaagatagagataacaaccctataaagacgtgaccataatattagatagtagctgacacgacgctcatagatccaggtggacgtcacgcttactgcgtatccctcgaacctcccccagaaagtgatccta

SEQ ID NO: 16643 - DNA, 672 bp, Diabrotica virgifera
  misc_feature (171)..(188): n is a, c, g, or t
  misc_feature (611)..(631): n is a, c, g, or t
ttctttctccgaagataacttgggaacgatcatcaccaattcagagggcatagcagcgacatggaaacaatactgtgaaatactgtttcatagtgaccatgaagacgtgaatctagaagaaataaatgacgaaaaggaaccacatattttaaaatcggaaatagaaaccgnnnnnnnnnnnnnnnnnnctagaaaatctcgaggagaagacggaatcacggcggaagcacttaaagaaatgggagacataggagttgaagtgatgttcaaactgtgtaatgaaatctggaacacaggaaaatggccagatgattggtgtaagtttactttcatacccatttataagtaaggctcaccaactgattgtaataactaccgcactatagccctgatctccccacgcaagtaaagcccttctaactataaccctaacaaccacaacattccaggaatgtactaccaaagttctatcaatatttgaatgccccggacatttagggaaacttcggggaacctctggtttaaattattcctggaatgttaccatagaacttctgggaacttacctacccatggtccctttttttaagttgcgaaataaatacatccgnnnnnnnnnnnnnnnnnnnnncgaatacttacccgaaccaactaagggaacccctttaggcc

SEQ ID NO: 16644 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16645 - DNA, 726 bp, Diabrotica virgifera
  misc_feature (512)..(537): n is a, c, g, or t
  misc_feature (605)..(622): n is a, c, g, or t
ctctgacaatcctacaatgtcccatttgattttagttaattccttttcgagtttgtacagcttttcatcttgagccatggatctgatattatatgtcgctatgtgtattctgttgcattccttctttttccgttttctcttatttgttcttgtcgagcttttgcctcccccagaatccatgaggctgatcggtttcccgatgtgggactccggatttctcctacccacctggggtccatatccgctttgttgtaagttcgacattattagtttggggaaaatagccttaaaacaccaagctggccaggcgggttggttagttgtagggatcacatttccttgactccctgtaactgttgtatggttatccctctcatactcggtcgccagagcctcgtctgttatgtataaggaggcaccgggtgggtaattttagactaccactcgtgcaggtgaggttgacttttggatcgattgatgtattgttcttaagtccgatcccttacctcccnnnnnnnnnnnnnnnnnnnnnnnnnnctctatttgcagaacgtagggaaccgtctcgttagagcttttaccacgctgagcaaatgggatgcgannnnnnnnnnnnnnnnnncccccatcttcctatagtcttggcctccgtatggcttgtattttttagaagtctcggaggctggtaccagagaagggttccactggtttcaatctgatgggacg

SEQ ID NO: 16646 - DNA, 380 bp, Diabrotica virgifera
  misc_feature (19)..(42): n is a, c, g, or t
gtcattgtgttattctgannnnnnnnnnnnnnnnnnnnnnnngtacagtagcttaaattatttcaataattatgtgggcacgaaagtctttaaagaatagggtttttttaaaaagaattaattaacacagacgtaagttattttggaaccacacatattctccatcaacaagtacctgctgtaaaagacacacaagatgagaagtacgaaaagcagttaaaggacttccaaacccataactaatgtgacgaagaaagtacgaactaaaaaaccgcagaagccccccctttgttaaaatttccttctaggcaaatttgatactgatctcctcacttttccggagttaaataaaaaagacaccaaactcctacagcatcatg

SEQ ID NO: 16647 - DNA, 231 bp, Diabrotica virgifera
ctttgtccgattctagttaaattggatcttcgtatatgttgtatcgctttcttttcttaaataatatattgacagtactaggaggaagatcccttagggctgtttcacattgcaagaattttgaacgtgagagggttttctcgtgcggtagttttgactcacttgtccttttcacacaataagaattgagtcgcacgaagatattttgctgtgatgtttcggtcattattt

SEQ ID NO: 16648 - DNA, 745 bp, Diabrotica virgifera
  misc_feature (530)..(558): n is a, c, g, or t
agataatgtaaggaaactatattttaagtgatactagaaagaattagaatggcacagtgtaaaatccataatattagattctataatccagaacctcaaggaattagatgtatgaagattcagaattccaccaaaaagctagccttatgtagaacagatgcaactatagaaatatggaacctacaggaaacatggtttttagaaagaacactagcccctagtacagagaattttagtgtagaagatattgtgtggtgtgataatcgactttttagtgtaggactccatggattgttaatcgagtacaatttgtctaaactttgtatagaaaatcgatgggcagttactggggaggcagcccattgcttagatattaataacactaattccaaaattgctattggaacagaacaagggtatttgaatatatttagcgtaaataaagatggagtatatttcgaaaaattcttagataaacaagaagggcgaataatgtgtcttaaatttgatgccactggtgactttattgnnnnnnnnnnnnnnnnnnnnnnnnnnnnntggaatgtacagtctggccatgctatttccaaaatgacaaccgggaagagtagaaaccaacaagccaactattgtgtggtgtatcgatataactgatgactttacagtgattggtggagacccaaggggaaaattggctttttgggatggaaaagtgggctccaaaacaaaaagttaacaactccca

SEQ ID NO: 16649 - DNA, 199 bp, Diabrotica virgifera
  misc_feature (157)..(174): n is a, c, g, or t
tcgaccccccgcgtcccggtccccattgactgtcctcaccgtaacctgcatatttcaatgactcatacgtccagctaccaaagatgctgccaacctcgctggaccccaggcattacgtaattataaacgaacccaccgctgttgtcatcgcccatgnnnnnnnnnnnnnnnnnnaaggcgattgaactccctctttttc

SEQ ID NO: 16650 - DNA, 70 bp, Diabrotica virgifera
aagaaacttgctcaacgtaagcacttcccttccgtagactggattgcatcatattacaaatatttaagag

SEQ ID NO: 16651 - DNA, 379 bp, Diabrotica virgifera
attttaactacatgatctatttacaacaatttaatacattaacagatttttaatactaattaatgctcttttaaaggtctggttgtctaattctggattccttgtgcagattctgacaatgcaccttcaatagatccataacatcatggttatattcttctggagtttccttcatatttgtagcccaatagtacaattcccaatcatttgaaggtccattaattagtctatcatatttttccaactgttctttgtcaaacgcctttagatgcttagcaacaaaggtactcagaagaagatcattctccagcataccacgtttgcgggattgatataaaagccttgctccttctctgagtctcttggctccttatccctt

SEQ ID NO: 16652 - DNA, 303 bp, Diabrotica virgifera
cttataaatataaaaacgtgtattgctttcaaaattacatttaacgatttggttggtcacaaaaattgtaaattggatataaaaataatttccacaaatatataggtactatcttccaaatcttttttccattattgtagtagatgaaaaagttttgtacttttttcggtctgtgatgcttaattatttaattgaaattaaaacagcaattgaaagaaataaataaacaacaatactatctttagtggccattatctacaataaaaattgactatttttttatacgggtaatcggagaagatg

SEQ ID NO: 16653 - DNA, 257 bp, Diabrotica virgifera
  misc_feature (116)..(133): n is a, c, g, or t
  misc_feature (155)..(175): n is a, c, g, or t
  misc_feature (183)..(201): n is a, c, g, or t
gaaaacgatgaagttctagttgcaggttttggacgtaaaggtcatgctgtaggagatattcccggagttagatttaaggttgttaaggtcgctaatgtgtccctattagctttatnnnnnnnnnnnnnnnnnnggccaagatcataattaaaatnnnnnnnnnnnnnnnnnnnnncttggcannnnnnnnnnnnnnnnnnngtgttaagcatataattttgtacagtgttttatttcaataaacaattttatacctg

SEQ ID NO: 16654 - DNA, 72 bp, Diabrotica virgifera
  misc_feature (11)..(28): n is a, c, g, or t
cctcatatccnnnnnnnnnnnnnnnnnnggggcggccgttcgcgatctaaaactagtcaaagttttttaaag

SEQ ID NO: 16655 - DNA, 458 bp, Diabrotica virgifera
  misc_feature (9)..(51): n is a, c, g, or t
tttgtccgnnnnnnnnnnnnnnnnnnnnnnnnnnnnnnnnnnnnnnnnnnnctgacagtgaagtaatcatgacttacgctagctcctgcttttatggctcctcccttaacacctcctttaactcctcctttggttctcagagccaatcctttggattccatatctttagatttaagtggcttagtggacacaatgtaaccttcttcggtgtaccaaacatctgtatcttgacattgggctctgttctctaagctcaagtaaaaagctttgtcctcaagcgcatcgtaatggaacaaatagttgagaccttgttgcttgaattcccagaaatcaacatcctccttggaattaccttaaagagtttgattaggacatatgaacttctggacttgttcgagggatttccccaaacgacagccttaagtgattggttttcagatgcaatcatcaaaagaaaa

SEQ ID NO: 16656 - DNA, 473 bp, Diabrotica virgifera
agaacttggcatggaaccgaaggacagaatcggaatgatgattcacaattctgttgaaagtattgttgccaattttgcatgtatcagaggcgggtttgtagcggttaacctgaatcccgcacttcaacccagagaactggaacactgcatgaaaatcacacaaatgaaatgcctgataatagtagaccgctataaggtttttaacattcttggtatactacaaaaagttattcctgagatcgaggacacagtttataacccaattgaagccaaagagttcccccacttcaaacgggtggttatgattgatgatcaactccacaagggaacttgctgcttcaaatcagaaatagcgatggcaaacgctacccgccaaaaataaactacaggaatatcccgcccaggctacaccagaacatttatcccctatcatattttacttcgtgtaatccccgttaatccaaaaaccagtt

SEQ ID NO: 16657 - DNA, 230 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (165)..(189): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttccnnnnnnnnnnnnnnnnnnnnnnnnnctacgaataggactaaacatatatcgaaactctaaatattt

SEQ ID NO: 16658 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16659 - DNA, 208 bp, Diabrotica virgifera
  misc_feature (6)..(7): n is a, c, g, or t
  misc_feature (12)..(12): n is a, c, g, or t
ggacgnncttanttgaaggaaaaaggggaccccttttacatagctattttattcaagtattaattcttcgcaacgtttttccaagcgctggtaattattctcttttctctccagaatccatagatattatccccccccgcgcaaccccccgccacgagtaaccacccgccccgcgcaccccccgcctcaccctgcccccccccccccc

SEQ ID NO: 16660 - DNA, 561 bp, Diabrotica virgifera
  misc_feature (33)..(68): n is a, c, g, or t
  misc_feature (133)..(155): n is a, c, g, or t
tttctacatatctctacttttttaccaaacaannnnnnnnnnnnnnnnnnnnnnnnnnnnnnnnnnnnctatctctacattattactattaaatattcttacggatgaccttaaaaataacattttattaccnnnnnnnnnnnnnnnnnnnnnnncgatctaacattctcccattctacaatatgttattatttcttcctacacattacacttatcacgtcctatcccatcctcatccccatcccactttcacttcccccaatctacgaccgacgcccctacagcctctttcaatcagtactattcttaaaaatcaactaagtttaataaagcgaatcccgcccccctctttttcctccctgcttatccaacaccatgcccctttccccctctcccctccacctccccccctcgcctaccgctctcaccccgcatgcgccgcccgccttcctccctcccgccccccctcccctccttcccccctctctctctttttcggcaccctccaactgaaccgctttcgactcctcacaccacctagcctccccttcccctcctccc

SEQ ID NO: 16661 - DNA, 345 bp, Diabrotica virgifera
ggtttccgacttttgcgttattttgccggttattagcgcactaatcactgtatatactattttttttgtcagatatcggtaataatgtcgagaaattctatcctgaacctttctttgcagagtatttcagattcaaaagcttcgaacgaaactttttattcaaaaacgacacattttgtgaatggccgttttatttttccggtgaatgtatgactttgtatgccgaaacttactatttatggattctacatgtcgtgattgacataggtgtcaggcaagttttggaactagaaacggatagactgaaaaatttaaccaaatttagactaaaataacgtctattgc

SEQ ID NO: 16662 - DNA, 124 bp, Diabrotica virgifera
  misc_feature (101)..(123): n is a, c, g, or t
ctgaagagcgatcacccaaaccagccccatggccgtatcaagagaaaggaggaccgtctaaacagatgttgcttgtattcattgtatatacaaaatatagnnnnnnnnnnnnnnnnnnnnnnnc

SEQ ID NO: 16663 - DNA, 334 bp, Diabrotica virgifera
  misc_feature (17)..(17): n is a, c, g, or t
  misc_feature (26)..(26): n is a, c, g, or t
  misc_feature (29)..(29): n is a, c, g, or t
  misc_feature (32)..(32): n is a, c, g, or t
  misc_feature (62)..(62): n is a, c, g, or t
  misc_feature (79)..(79): n is a, c, g, or t
  misc_feature (99)..(99): n is a, c, g, or t
  misc_feature (103)..(103): n is a, c, g, or t
  misc_feature (110)..(110): n is a, c, g, or t
  misc_feature (139)..(139): n is a, c, g, or t
  misc_feature (141)..(141): n is a, c, g, or t
  misc_feature (147)..(149): n is a, c, g, or t
  misc_feature (151)..(151): n is a, c, g, or t
  misc_feature (156)..(156): n is a, c, g, or t
  misc_feature (172)..(172): n is a, c, g, or t
  misc_feature (177)..(177): n is a, c, g, or t
  misc_feature (179)..(179): n is a, c, g, or t
  misc_feature (192)..(192): n is a, c, g, or t
  misc_feature (303)..(303): n is a, c, g, or t
tttttagggcggaagancaaagaggnggnaanagaggggaaagattttaaaagaaaaacgcngcccgccgcccgcgccnccagcagaaaagcccgcganggcncgaaaancacccacgaaaaagccggaaacagaaacncnaaccannncncaaanaacagaacgccccggnacgcncnaaacccaaaagangacacccaaccacgacacaaaccagaaggaaccaaaggggcagcaaacggcaacgacccgggaacaacaaacacaggcgccgccgccacggaaggcaaacaagccaaagcnaccgaaaacgcagaaggcgccagaacaacac

SEQ ID NO: 16664 - DNA, 704 bp, Diabrotica virgifera
  misc_feature (4)..(4): n is a, c, g, or t
  misc_feature (10)..(10): n is a, c, g, or t
  misc_feature (15)..(15): n is a, c, g, or t
  misc_feature (21)..(22): n is a, c, g, or t
  misc_feature (24)..(24): n is a, c, g, or t
  misc_feature (284)..(301): n is a, c, g, or t
gagnacgggnacggnacgggnngnacgggggcctttgggagaataaccttgcattttggttaatttcaaatttcattttcatttattttgagatactttccaacaaagaacagagaaagggacaatatttgtatacaagtctatttttgttcttacatatctgcaagtcattcctcctttttgttgatgaacaaagcgttttttagtgtatagctgtcattgctagtgattgctagcatatattttggaccaacatccaagttttaagtgtttccagaaaatgnnnnnnnnnnnnnnnnnncaacacatattagttaaattatcgtaatataaatacacagttctgatttgctcgcggtgttcaaatagtagattaaacatgaaggtaacagtaacaaccttaacagatttcatatttgtgttagatgtttctgaagatctggaactagaaaactttaaagcattttgcgaaattgaatctggatttccagcctctgaaattgcaatagcctttaatggaatgcccctaatggacaataagaagtccctctaagattttggcattaatgatggggatgctgttattctacaacatatccaaagcgagtcacaaatggaccagtcaggtaatctagattttagcaacatagaaattccaaataccaccaacaacacgagaaaaccgcccagaaaaagaagaccct

SEQ ID NO: 16665 - DNA, 300 bp, Diabrotica virgifera
  misc_feature (232)..(249): n is a, c, g, or t
gtacaaaccagtgcggtatcaatgaagttgccgattatcctctcctataattgtcccatgaattcttgataaaccatgcagttttagctgttggatatggttcagaaaatggtaaagacttttggcttatcaagaattcatgggacacttattggggagaagcaggttatttgagattggtacgtggtacaaaccagtgcggtatcaatgaagttgccgattatcctctccnnnnnnnnnnnnnnnnnncataccttacagtttatataatgaaacatgaataaaaatattataactttt

SEQ ID NO: 16666 - DNA, 412 bp, Diabrotica virgifera
  misc_feature (9)..(34): n is a, c, g, or t
cttcgtccnnnnnnnnnnnnnnnnnnnnnnnnnnttggtcgctatttctctgaattggattgtattttttctgcggttcccgttttaaagtggactctgcttcttcgggtttagtaacaggaacgttttggttggttgtttgttcactttcggcatctaattcttcatcagaatctttatatctaggatcattatatatcgtactgacatcaacactttcctttggacttttgattttgtaaaaatctcttaaaacagctttctttctattatcttcccactgctgcagtttatacttattgctatattttttaagacgatacaactttttatcgaaaggtttcttttcgccccctctttgcactggttcggtagcagttggatctcctggttgcacggcatatatgggccg

SEQ ID NO: 16667 - DNA, 133 bp, Diabrotica virgifera
cttatacattttttcacaaattatactttccaatcctttacactccgtaccgatgatcctatccaccatcacccacctgcacctcccgtccccccacctcgcctcacccacgccctcccccccaccctctccc

SEQ ID NO: 16668 - DNA, 467 bp, Diabrotica virgifera
  misc_feature (9)..(42): n is a, c, g, or t
  misc_feature (45)..(85): n is a, c, g, or t
  misc_feature (87)..(109): n is a, c, g, or t
  misc_feature (265)..(288): n is a, c, g, or t
  misc_feature (304)..(323): n is a, c, g, or t
cttcgtccnnnnnnnnnnnnnnnnnnnnnnnnnnnnnnnnnnccnnnnnnnnnnnnnnnnnnnnnnnnnnnnnnnnnnnnnnnnncnnnnnnnnnnnnnnnnnnnnnnncacaaacctctatctctctgcccccgctcccctcgacacacccctaggccggaccacttactccccccccacctcgctttctaaacgccgcggaacccttctaccaacctgtcaacagcccccccacacacctctaccttcgctctacgttctctnnnnnnnnnnnnnnnnnnnnnnnncccccatacgcctctnnnnnnnnnnnnnnnnnnnntccccctccccctcctccccctcccacccctacccccccccctctccccatctcccccccatgccccccccctacaccctccacctcctcacccctccccctccccgtcccccctctcctctgccccccctcctctcctcctcc

SEQ ID NO: 16669 - DNA, 880 bp, Diabrotica virgifera
  misc_feature (755)..(783): n is a, c, g, or t
ggctctgacatcctctgctttaattatagaaagaatggaaggattattggacagatcttgggtagccggtgtaacaccaagcgaaattctattttcccacgtcatcactcagttcgtagtaatgtgcggccaaacaactctcgtacttatcttcatgattatcgttttccaagttgaatgcaaaggagacatcttccttgtcgtagttattacgattcttcaaggattgtgtggtatgtgcttcggattcgtcatctctgccatctgtgagctcgaacgaaatgcaatccagctggctcttggtagcttttacccaactcttctgttgagcggtgtcatctggccgatagagggaatgccaacggtgctgcgatatatatccacattcctgcctctgaccctggccacgacctctttgagatccatgatgaccaggggctggtccataggagaacccgacgtctattacggatttatagctacgatagtatggatagtactatttttaacgattagtttactggtgctaagatctaagaggggttgaaaaccattctagtaaattgtttaccgcgtgggaaattttgtatgtataattgtactttttaataaacagatcagatctaaaaactctatttaattgtttggacgggtgtttttgcgaatccagtaaatacagccaaaaattggtttaagtgatggacagtaaaatctatgttataaacttgccccccttaaatactggaagtactagnnnnnnnnnnnnnnnnnnnnnnnnnnnnncatttcgcgtactggctttatgggattttatggggttagggagaaagggtttttgaggaaaaataaaattaaagcaggaaatttgattttgaaataa

SEQ ID NO: 16670 - DNA, 665 bp, Diabrotica virgifera
tagacctttggtcaggcggagtatcagaaaaacctttaccaggtagtatattgggtcctaccttcgcatgtataatcgccacacaatttagttattcaagaagaggagacagattttggtatgaactgcccaatcagccttcatcttttaccccagagcaacttcaggaaattagaaaagttagattagcaagacttatctgtgataacacagatttaatagatacggttcagctgtatccaatggtactaccagatcacgaaataaatccccgtgttccttgcaaatctggaataatcccaagtttggatcttagcaaatgggcacattttccgcacgaacatgcatttcagctaaatgatattttaggaaaatagaattatattagatttaatgtaaaaatagttgtacagatgccattgtactaatttatttattgagcatatcaaccgaatgtacttacacaaaaaggaatattctttagtattatatataatatagatattataaaacagtgccaacacatataatgttagtaaatatactaattatttacttaaaagctcatgtatagctaagaaccttcaagtaaaaatttaagattgaaacttactgttagaagtaattgtatatttctttgttacattaaatagttaagttatctg

SEQ ID NO: 16671 - DNA, 154 bp, Diabrotica virgifera
tttgggcgaccatgatgggcgctgcggcaagagcaagaggcttttttttggctggaaaatccatcgaaaacgtaggctccgaatcgcttaaaagtgagacgtactacatgcacccattttgtaatgcgctgccaaagttgttgcatcgctctgt

SEQ ID NO: 16672 - DNA, 409 bp, Diabrotica virgifera
cactgtgatcaggttgaacaatagaggactcaaggaatccccctgtcttattccattgccaacttcaactgggacagaataacgaaaaacgaaaagaaaaatctcgaaatgctgctagatgtcgacgatctaaagaaaccgaactttatctcgaccttgctagttccctcccgttctcaagcgagcagattagccaattggataaggcttcagttatgcgacttgccatttcctatcttaaaatcagaaatatgatgacagctgttcccgactttataacatcgaacgaaactaaaagccaggaagacagcatggcgtttctgaagagtctagatggatatgtgatgattttatctgatgaaggagatttcggctatatagcagataccgtacaccgaatatcattgtt

SEQ ID NO: 16673 - DNA, 1023 bp, Diabrotica virgifera
  misc_feature (22)..(133): n is a, c, g, or t
  misc_feature (135)..(182): n is a, c, g, or t
  misc_feature (184)..(377): n is a, c, g, or t
  misc_feature (379)..(738): n is a, c, g, or t
  misc_feature (740)..(769): n is a, c, g, or t
gtaatgaaatgttatctgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnacccttagggataacagcggaattttattggagagtccaatccatataaaagattgcgccctccttgtcgatttatagtttcttatttgggggactcccttttctctttcattctgctcctctcttcaattttccccggatcccccctaccccccccgcggtgccctatcggtcttcaccttagcttccgcctattccccctctcggcccctcctacacccctcatcctccacattctcccatctaacccccca

SEQ ID NO: 16674 - DNA, 1173 bp, Diabrotica virgifera
  misc_feature (50)..(70): n is a, c, g, or t
  misc_feature (650)..(671): n is a, c, g, or t
  misc_feature (869)..(889): n is a, c, g, or t
  misc_feature (904)..(922): n is a, c, g, or t
  misc_feature (966)..(997): n is a, c, g, or t
  misc_feature (1019)..(1041): n is a, c, g, or t
  misc_feature (1055)..(1083): n is a, c, g, or t
  misc_feature (1114)..(1168): n is a, c, g, or t
catatttgacaactacaaaaataaatatacgtggaataatgtgaaaattnnnnnnnnnnnnnnnnnnnnnctagttttaatatacaaaatggaatctgctgttacaaatgacacaaacaaaaagtcaattctagaaaatttaaccaaggaggagctcgtcaaaaaatgtacccaactattacaaattgcccaaaaagcaaaacaatccaaaagtacactacaagaggaaaacagtaagttaaaagctgagttaaataagaaaaataccgaccctgatcctgctttacaagaatatatagacaatttaacccaacaaaagctgaacttagtaactgataaccaatctttaaaaactaaaaatgaaaccttgtccaagagaattgaagagtatgaagtgcaactgaaggaatgcgaagaaaaactcaatacttgtgataacgaaaacacctcttacaagagacaaataagaaggttaacagacgaaaacgaacagttgattgtggatctagaaacactagaaaaacagctagcaatagcaaaagaaaaagtttctgatgaagcaaatttaatagatctaagtgaatccaaagagaaagatgaaaaacgccaagaactggaaaagatgttgagtattagcttagaagaaattnnnnnnnnnnnnnnnnnnnnnngtggtctaaacgataagatcgaagttcttaaaaataatttaggtgaaaaggataaaagcatactgaccattagtcaagaattagtgttgtcaaaaagtttgattgaaaagtttgaaggattgaacaagaaaaaagaagtccaccgaagcaaagaataataatctgaatataaaattggtagaatctgaaaatagtatnnnnnnnnnnnnnnnnnnnnncaccaaaactcaagnnnnnnnnnnnnnnnnnnnccctccaaaaatatggaaatttgctagaatagctaaaaagtttnnnnnnnnnnnnnnnnnnnnnnnnnnnnnnnngtttaaattcttatattaaacnnnnnnnnnnnnnnnnnnnnnnntcagttaaacttannnnnnnnnnnnnnnnnnnnnnnnnnnnnaaccaggtgtttaaacaaaaaccccaccccnnnnnnnnnnnnnnnnnnnnnnnnnnnnnnnnnnnnnnnnnnnnnnnnnnnnnnnttccc

SEQ ID NO: 16675 - DNA, 972 bp, Diabrotica virgifera
  misc_feature (9)..(66): n is a, c, g, or t
  misc_feature (72)..(94): n is a, c, g, or t
  misc_feature (285)..(358): n is a, c, g, or t
  misc_feature (363)..(428): n is a, c, g, or t
  misc_feature (446)..(464): n is a, c, g, or t
  misc_feature (473)..(487): n is a, c, g, or t
  misc_feature (489)..(505): n is a, c, g, or t
  misc_feature (508)..(526): n is a, c, g, or t
  misc_feature (541)..(561): n is a, c, g, or t
  misc_feature (700)..(713): n is a, c, g, or t
  misc_feature (715)..(734): n is a, c, g, or t
  misc_feature (752)..(830): n is a, c, g, or t
  misc_feature (840)..(868): n is a, c, g, or t
  misc_feature (870)..(921): n is a, c, g, or t
tccttgtgnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttcgcacggtcaaaataccgcggccattcaaattaatcagtgggcaggcgagactttatatttaatacaaaaagacatgtttttaataaacaggtgaaaaaaatgttgccgaattcctttattaacccnnnnnnnnnnnnnncnnnnnnnnnnnnnnnnnnnnaaaattatcatccttacnnnnnnnnnnnnnnnnnnnnnnnnnnnnnnnnnnnnnnnnnnnnnnnnnnnnnnnnnnnnnnnnnnnnnnnnnnnnnnnctaataaccnnnnnnnnnnnnnnnnnnnnnnnnnnnnncnnnnnnnnnnnnnnnnnnnnnnnnnnnnnnnnnnnnnnnnnnnnnnnnnnnngtttttttgttttcctccttggccattttttgggggagtaattaaaggggg

SEQ ID NO: 16676 - DNA, 750 bp, Diabrotica virgifera
  misc_feature (522)..(601): n is a, c, g, or t
gtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgctaattacccactcccggcacggggaggtagtgacgaaaaataacgatacgggactcatccgaggccccgtaatcggaatgagtacactctaatgcctttaacgaggatcaattggaggggaagtctgnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgccgtgcaactggcgtggcgtgggacgcctaacggcgggctttactcgcaagggggtccatttcaacccccccgcgacgtcctttcagattccccgcccttcccccctccccttccccacccct

SEQ ID NO: 16677 - DNA, 352 bp, Diabrotica virgifera
  misc_feature (6)..(27): n is a, c, g, or t
cattannnnnnnnnnnnnnnnnnnnnnggcatgtttaaaatgatccctaaaatattaataacgtctttcattaaataataaatattcaatcagctaaaacggtgcaggtgacaccacatggtaccataaagttcaaaagaaatcggaaatgcattaaatggcatcttccgatcattcataccagcagaaatatcttcaagaaacgctgaagaacaccttcgtccaacatctgtcgattcccaaattggtataaatattaacaacactgtagacaagatcgtggaggcagttactgaacatatacactccaccataaaagtaactactaatccaacaacatccagatctacct

SEQ ID NO: 16678 - DNA, 815 bp, Diabrotica virgifera
  misc_feature (2)..(19): n is a, c, g, or t
  misc_feature (317)..(336): n is a, c, g, or t
  misc_feature (739)..(757): n is a, c, g, or t
gnnnnnnnnnnnnnnnnnngaaaatcttaaaagaaaatactttggaattacactgtccagttgtggaaacctgaataaagatgtgagagatcaagtacaaaaaccaagtagactgacaggatgccttaataacactatatggtgaagaattgtgtcaaaagtgatgtcaatccgaaaaaacccaatacgtaccttgcacaataaatgggcacattttagaacaggtcaatagatttaagtacttgggatgttggatcgatagcagcctaaatcctgttctagaaataagatcaagaatagaacaggccagaaaatcnnnnnnnnnnnnnnnnnnnnctgctttgtaattcccgaataaaactcgaaattcgactaggtttatccaaatgctacgtctggtcgactcttctctatgcagttgagacatggacccttaaaacatcaaccgtaaataagttggaggcctttgaaatgtggatctaccggagaattctcaaaatttcgtggacatcgcatacctcaaacgaagaagtgctgcatagaataggcaaggcaagcgaaagttagaaaaacatcatacctaggtcacatactgagaaataataagtaccaatatagcttatattgaaagaaaagttcgagggaaggagacgacaaataaggacagctaataagaacagctgaagacagagaagagtaatgcattggagtaaccaacctccattgaggagaccacacnnnnnnnnnnnnnnnnnnngtgaaaaatttatacagtcagtgtaagttccactaaccacttatgcttcaaaaataag

SEQ ID NO: 16679 - DNA, 1053 bp, Diabrotica virgifera
  misc_feature (11)..(11): n is a, c, g, or t
  misc_feature (13)..(49): n is a, c, g, or t
  misc_feature (56)..(237): n is a, c, g, or t
  misc_feature (244)..(244): n is a, c, g, or t
  misc_feature (250)..(398): n is a, c, g, or t
  misc_feature (407)..(440): n is a, c, g, or t
  misc_feature (442)..(442): n is a, c, g, or t
  misc_feature (463)..(496): n is a, c, g, or t
  misc_feature (498)..(498): n is a, c, g, or t
  misc_feature (530)..(571): n is a, c, g, or t
  misc_feature (611)..(637): n is a, c, g, or t
  misc_feature (639)..(639): n is a, c, g, or t
  misc_feature (654)..(654): n is a, c, g, or t
  misc_feature (710)..(786): n is a, c, g, or t
  misc_feature (788)..(808): n is a, c, g, or t
  misc_feature (816)..(843): n is a, c, g, or t
  misc_feature (845)..(862): n is a, c, g, or t
  misc_feature (875)..(914): n is a, c, g, or t
  misc_feature (931)..(1021): n is a, c, g, or t
agggggggganannnnnnnnnnnnnnnnnnnnnnnnnnnnnnnnnnnnnagggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagnggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggggggannnnnnnnnnnnnnnnnnnnnnnnnnnnnnnnnnanggaggggagagaggaggggannnnnnnnnnnnnnnnnnnnnnnnnnnnnnnnnnanggagagggggggagggggggagagggggggannnnnnnnnnnnnnnnnnnnnnnnnnnnnnnnnnnnnnnnnnagggggaaggggagggagaggggagggaggggggggagannnnnnnnnnnnnnnnnnnnnnnnnnnanggagggaaggaggangggggagggggaggggggagaagaagaggggggagggggaggggggaagggaggannnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnagggggannnnnnnnnnnnnnnnnnnnnnnnnnnnannnnnnnnnnnnnnnnnngggaggggggagnnnnnnnnnnnnnnnnnnnnnnnnnnnnnnnnnnnnnnnnagggggagggagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggggggggagagggagggggggaggggag

SEQ ID NO: 16680 - DNA, 648 bp, Diabrotica virgifera
  misc_feature (422)..(468): n is a, c, g, or t
aaaaaatatttattcatacaaaaaaatgcaaagtgatgtgtctaaaaactcttaattcaattatattaagacacatcttaacgataataaccttaaaattaaatttacactaaataaaagtgagtttggttctagtttggttcacttgccaaacattcagttcttcgtattcttctatacaagcgtccacctgatcaggattgtaacctttgctagcacatttttccaatgcagatgacactgcaacagtttttgtatcgcctgccaactcggtgatgagtgcgtatattttgtcatttatatttggtggtctgtgccctttgttttgcagagtatgtttcaaagaatctttactcatctctaaaagcctgattgcttcatttacgtcatctttttctacaacatttgatagacgtaggcgnnnnnnnnnnnnnnnnnnnnnnnnnnnnnnnnnnnnnnnnnnnnnnnatgtgaacgtcatatcggcagagttgcgggcttcttttcttagatccacataagcagcaacaataaaatctgtcaactcctcgggtatagcaggatccttcattttacacatagatatgtacttcctcataactttcatgtctaatgctgcggtttccattggcgggtgtttgctattgt

SEQ ID NO: 16681 - DNA, 528 bp, Diabrotica virgifera
  misc_feature (19)..(20): n is a, c, g, or t
  misc_feature (29)..(29): n is a, c, g, or t
  misc_feature (35)..(35): n is a, c, g, or t
  misc_feature (41)..(41): n is a, c, g, or t
  misc_feature (68)..(68): n is a, c, g, or t
  misc_feature (72)..(72): n is a, c, g, or t
  misc_feature (81)..(81): n is a, c, g, or t
  misc_feature (87)..(87): n is a, c, g, or t
  misc_feature (101)..(101): n is a, c, g, or t
  misc_feature (103)..(104): n is a, c, g, or t
  misc_feature (107)..(107): n is a, c, g, or t
  misc_feature (110)..(110): n is a, c, g, or t
  misc_feature (128)..(128): n is a, c, g, or t
  misc_feature (131)..(131): n is a, c, g, or t
  misc_feature (178)..(178): n is a, c, g, or t
  misc_feature (191)..(191): n is a, c, g, or t
  misc_feature (212)..(212): n is a, c, g, or t
  misc_feature (228)..(228): n is a, c, g, or t
  misc_feature (251)..(251): n is a, c, g, or t
  misc_feature (299)..(299): n is a, c, g, or t
  misc_feature (307)..(307): n is a, c, g, or t
  misc_feature (313)..(313): n is a, c, g, or t
  misc_feature (323)..(323): n is a, c, g, or t
  misc_feature (338)..(338): n is a, c, g, or t
  misc_feature (379)..(379): n is a, c, g, or t
  misc_feature (395)..(395): n is a, c, g, or t
  misc_feature (440)..(440): n is a, c, g, or t
catattactgcttcttttnnccaccacanccacanccattnacaaaacaatcttcaaaaactgttccnaacnaccattttncaatcntctccataactatntnntcnatnataaatccaaatactcanccnatatatattccacatctatcaaaaacaacattctcactgtacctttnaacaaccaaaacnccaacaacttcaacctactgntctctatgtttcaacncaacaaaataacccttaaacttnaacacccaaataccaaaacatttcaactccaacatatcctcatcatcnaaaaactnaaaaanttaccattcntcattcacacattcnattctacacatcatatcctattaatcacccctcaacatcantctcttccttataaantgcttattcatccaccaccaccactacttataactttctactacnccccattcaaacaacttcttatatatcctcaaacattactttatcaaaccactcattaaaataaaccatttactttcaaatcaaactt

SEQ ID NO: 16682 - DNA, 644 bp, Diabrotica virgifera
catcggtctatcggagttcagtcctgtcgcaattgcgggcgtttttaagaagcatttacgggaattaccagatcctttgatcccggtgcagtggtacgacaagttcctagaagcagcgagaaaaagaaacgatcaggaatgtacgactttattgaaacagttggtggaagagctacctcctcatcacaagtccactcttagattcattatgggtcacttatgcagaatatgccaactagagtatgctagaggaaacaagagtcctccaactgtattaatccaagtgatgtgtcacattttattgagaccgccatgggaacgaattatacaagttgtctacaacacacaagcccacaatcggatagtcgagttgttattgctgtcatgtgattggggagagaagcttccagaatttgctgcagctccagctgtacctcctagaaaagtatctcgcatggggagtagtgtttatcacgggatgctggacagggataaagataaactcaatgctgtgctgagtttgcaggatgcggagtggtactggggtgatataaagcgtgaagatgtgaacgaagtgctaaatgatacccgtagatggaacctttttggttcgagatgcctcgaataaatgtggagaggacact

SEQ ID NO: 16683 - DNA, 569 bp, Diabrotica virgifera
  misc_feature (23)..(399): n is a, c, g, or t
  misc_feature (406)..(443): n is a, c, g, or t
  misc_feature (463)..(476): n is a, c, g, or t
  misc_feature (479)..(501): n is a, c, g, or t
ttcgtccgtacaaaaagacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttaccattgatctgagcttaaaccggcgtgagccaggttggctctctatc

SEQ ID NO: 16684 - DNA, 255 bp, Diabrotica virgifera
tttttgtccgaagtgatagtgaattctttcaaaaatttgttatgtagggacttcttatcaaatgaataagtgcttaaacgcaacctatcaaccgctgtacaactattttcaatggaaagtgacctttttgatatcattttactcccacaaaagtcagtttaaactgaaattaattaatttatagaaaaatctgaatatactagtcacccctcatgccctccttaatcccctgcccaatatctttctaaaattact

SEQ ID NO: 16685 - DNA, 502 bp, Diabrotica virgifera
  misc_feature (95)..(112): n is a, c, g, or t
tttcgtccgataatttttaattccaaataacttttcttaataccttttttcgatattttgataaatatataaagctactttactcttgagcgaannnnnnnnnnnnnnnnnnacctcgtacactattgacaaaatttgatatctgatgattgcatcttaggtctgagactatgcagagcactttataaagaataactttttttcataaagttaataataaaaaagttttccatatggttccagcttagtgggacctattgcatgtgtatgtgacattttgaaatagcatatcttctttgaaaatggtcctggagtttttgcagtacacaattttaacgtaaataaaataagttttcttttttattgcacaatgtatattcctgaatgtatagtaaaaaaagttatagcgacaaatttaaaagttatcgcacaatatatccaagatcattagaggtctacctttgcaaaaccctatcctcgctcgaacgtgcccaccccacct

SEQ ID NO: 16686 - DNA, 338 bp, Diabrotica virgifera
  misc_feature (3)..(158): n is a, c, g, or t
  misc_feature (165)..(202): n is a, c, g, or t
  misc_feature (222)..(235): n is a, c, g, or t
  misc_feature (238)..(260): n is a, c, g, or t
  misc_feature (268)..(290): n is a, c, g, or t
acnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttacaccggtgcgagccacggcgcctcctacccccacctcctccc

SEQ ID NO: 16687 - DNA, 289 bp, Diabrotica virgifera
  misc_feature (17)..(17): n is a, c, g, or t
  misc_feature (26)..(26): n is a, c, g, or t
  misc_feature (53)..(53): n is a, c, g, or t
  misc_feature (55)..(55): n is a, c, g, or t
  misc_feature (63)..(63): n is a, c, g, or t
  misc_feature (65)..(65): n is a, c, g, or t
  misc_feature (80)..(80): n is a, c, g, or t
  misc_feature (85)..(85): n is a, c, g, or t
  misc_feature (107)..(107): n is a, c, g, or t
  misc_feature (109)..(109): n is a, c, g, or t
  misc_feature (114)..(114): n is a, c, g, or t
  misc_feature (130)..(130): n is a, c, g, or t
  misc_feature (135)..(135): n is a, c, g, or t
  misc_feature (179)..(179): n is a, c, g, or t
  misc_feature (218)..(218): n is a, c, g, or t
  misc_feature (226)..(226): n is a, c, g, or t
  misc_feature (281)..(281): n is a, c, g, or t
tcctaagggggagaggncagacccgncaaagacaggaggccgccttttcaggncnaggggagnangcagagcaggagaanccggnagaggccgcgagccggggccancnagagncgccgatcgggacgcncagancccaagaggggagcagcggaacaaaagaaggagcgacccacccncgcacaccagcgcccgccgccgcacagacagaacaccancgacggcncgagaaacgccgacgcagcgccgaggacgagcaagcggccgaggcacaaggacanagccggag

SEQ ID NO: 16688 - DNA, 149 bp, Diabrotica virgifera
  misc_feature (24)..(24): n is a, c, g, or t
  misc_feature (99)..(99): n is a, c, g, or t
tttcggggggcgacaagagcaacnaccagaccgggggcgggactttccagcgaaaaagccggcaccgaaccacccaaaacgggcgcggcagacgaggancaaaaaagagaccacgctgccttggcagccgccggcaaggcacacggaaa

SEQ ID NO: 16689 - DNA, 589 bp, Diabrotica virgifera
ttttgtccgcgcttttaaaaactgcaacttattccacagcgccattctccacagcgactaaccgagacaatttttatcaaaatatagcaggtgctcaaaatgacgacaccaatccagagggatgggagaatgccaaaccgtttgacagcatacctggaccaaaacctttgcctgtgcttggaaacatgtggaggttttttcctggagcagaatttcataatataaacacggataaactctttctactattccagcaacggtatggggatgtagtacatttaggaggaatatggggacgtagagataagatttttctgtatgatacaggtgatatggaggatatgcttcgcaacactggtccattcccttcgagatttattatggacgccattttctattatagacgtaaactaagaaaagatatctataaagggaatcttggacttgctttattgcaaggtgaggagtggtataagttaagaaaaattgtacatccaatactgatgcaacctaaatcattcagcaataccccccaagaatggatggggcaacataacaaccttatgaaggttaattttctccattcgca

SEQ ID NO: 16690 - DNA, 737 bp, Diabrotica virgifera
  misc_feature (427)..(444): n is a, c, g, or t
tcaaaattagccaaatcgatccaatcgttctagagttgttataacaaaatatattactgtatacaacaaggttactgcacgcggcttgacttttcgaataacgttaaatagggtttcgggccatgaaaaacatcataccgagcgataagaagcttacttcttcacctcacttctgaaaatcagctgaatcagttacactgcggacaatatagaacccaaaataaaggttaataactaatttcaaaaagcacaaatgttgaaaatgctacaaatattgtgtgatacaatcaaatacaaagaaaaatgtacaatgcacaaaattaaatcgtgactagcgaggaatcgtggaaaaaattaacaaccaaaagtattaattacatgtttagctctctccctctctctgttgttttgtatactatcttagccnnnnnnnnnnnnnnnnnntagctgtgaccggttttttgtttcctgtcctgccttattagaaaaattcaattctagctctttcaaacgtaattacactttttgtcgctttattgtttcttctattgtacaaaatgaaatacatataatgtaaaacacactgttgtaatatctacaaagtaagtatctaaatttctttgcagagaatgtccatttcccaccataccatttttgccccatatcacctctattttattattctaaaaccaccactaaccccccctcttattacgcccgcagggccctttcctcta

SEQ ID NO: 16691 - DNA, 136 bp, Diabrotica virgifera
  misc_feature (48)..(49): n is a, c, g, or t
  misc_feature (54)..(54): n is a, c, g, or t
gagataatctatttaggtggaatattggaagggtcttttaaagtaagnnttaangataaagtgtttttgattatattgacaataatcatgggagaaatccaagattttttaattttatgtatattccggagtttga

SEQ ID NO: 16692 - DNA, 250 bp, Diabrotica virgifera
  misc_feature (76)..(101): n is a, c, g, or t
  misc_feature (120)..(170): n is a, c, g, or t
  misc_feature (172)..(184): n is a, c, g, or t
ttttggccgggacctcgcgcctggcgttacatcccgaggagtcttccttttattctaagcttaatttcgaacagtnnnnnnnnnnnnnnnnnnnnnnnnnnaaaatgggtaaagaaaatnnnnnnnnnnnnnnnnnnnnnnnnnnnnnnnnnnnnnnnnnnnnnnnnnnnannnnnnnnnnnnnactttacaaacgtggtggcatccgacaacgtaccatcgaacaggtccaatcagaagcccaagaacc

SEQ ID NO: 16693 - DNA, 677 bp, Diabrotica virgifera
cgcttatgttaaataataaaaaagtcaggtactttaacaactggccatgttcgtcatcagtacagggtgtgtctaaataagtgcgagaaactttaagggataattctacgtgagaaaataatgacagtttgctttatagtcatatgtctgcaaacgcttcgtttccgatatacgggatgtccaatttcttttacaaattgatgatttatttattgctttaaaaccatttaagatatgcaaatcaaatttggtgggttttaaaacgtagttattgcacatttttgacatacaattaagaattttatattcaccattagatacgctgacacgacaatattagatacgctgacgatacagccattcttgctgaaaatttacaagatcttcagacactactaaatctagtcagtgaagcaagctatcggagaggccttaaaatcaacatttcaaaaacaaagtggatggcagttggaaagattaatatagatcaaggtcagctttctcttgatggagaggagttagaacgggtaaatcatttcaagtaccttggtagctggttaaattgtaaattgcgactctgatgaacagataataactaggatccgaatattccgtaagggtttttaatgacctggaaacccactttttatgtaataacaatctgcctatgaattttc

SEQ ID NO: 16694 - DNA, 85 bp, Diabrotica virgifera
  misc_feature (21)..(39): n is a, c, g, or t
ttttgtccgacgaaaggaccnnnnnnnnnnnnnnnnnnngagatagaaaccaccctcggctcacaccggtctaaactcacataat

SEQ ID NO: 16695 - DNA, 664 bp, Diabrotica virgifera
  misc_feature (495)..(516): n is a, c, g, or t
tcaatatctcgcttaatattgcacttaaaacactctttaaaaaagcaatttgttaatttttttacctgctacaattttgttcattacaatattatcgttaaaatacatattttacacattaaatacacattttttgagatatttgcaaaaaactgttgaaaatcgtgagaaaattccgaatttgcaattgccaataacttaaaaagtattgggtttttgaaaaaactgtatgcagcattttttgcttatttttttgttggcttagacttaccgtcatactgtcagacacataaggaatacaagttatcaagttatacaaaacaggtttaacacaaagataacaactaaaaggtattaaataacactaagcttaacagctaaaacaactaactaccataggcattaattaaaaatgtcttaagggaattataatgataatttgctgtctttttaaaaagttaatcaaagagatgtacacctcttacacaaccaagnnnnnnnnnnnnnnnnnnnnnncccaggagctgctactgcacctcttaatatatcatttattattttagatgagccaattgatttctacaccatccaaaaaaatatattactctactccctttccccttcccattggtcccattcattccttttccttaccttgcatttt

SEQ ID NO: 16696 - DNA, 158 bp, Diabrotica virgifera
taagggggacccgcgcagcgacccccaaccccccgagggacttttacgggacagcagacaaggcccgaggacgcccggcaaacaccaaagggaccaacaccgacaaccccaatttcttttcccccccccgcaccgcagaacaacccgaccaacccggg

SEQ ID NO: 16697 - DNA, 153 bp, Diabrotica virgifera
  misc_feature (2)..(33): n is a, c, g, or t
  misc_feature (37)..(75): n is a, c, g, or t
  misc_feature (79)..(125): n is a, c, g, or t
  misc_feature (129)..(152): n is a, c, g, or t
gnnnnnnnnnnnnnnnnnnnnnnnnnnnnnnnnatcnnnnnnnnnnnnnnnnnnnnnnnnnnnnnnnnnnnnnnnatgnnnnnnnnnnnnnnnnnnnnnnnnnnnnnnnnnnnnnnnnnnnnnnntacnnnnnnnnnnnnnnnnnnnnnnnna

SEQ ID NO: 16698 - DNA, 370 bp, Diabrotica virgifera
  misc_feature (260)..(280): n is a, c, g, or t
ctctcttttgctctttagtttttttgctctggctcaaacttttgctagaactagacatgttgatgtcttactttcacaattgactttttgtgtatttgcaggtccaataaaaataaaactatgaaaaatcaaatacacaaatgacgtaaatgacccatggtcacaacaatcaaatgaagaatgcctcctcttcctacttaaaaatacaaatctgggattcctctaacaccatgcaaatgtattctcggctagcaagccannnnnnnnnnnnnnnnnnnnnttaaagcaccctgcctgacatataaatggatttttgattaaaggaatacccacctgcattttgctgcgctgtctcctcctaacccttctc

SEQ ID NO: 16699 - DNA, 236 bp, Diabrotica virgifera
tttttgtccgtattttcatgatcatgttattactatggggaggactttttattgtataaaatgttcaagtaatgatatgtttatcctttataaaaatatcacatctataacgacttgaattgtatttacttaacatcactagacctactcttacctactcccatttcactaatattagatatctctagcgacgagcacacaaaatccactacattccctattcacccctccatccc

SEQ ID NO: 16700 - DNA, 366 bp, Diabrotica virgifera
  misc_feature (11)..(344): n is a, c, g, or t
ttttcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaccctccccaatgaccatc

SEQ ID NO: 16701 - DNA, 577 bp, Diabrotica virgifera
  misc_feature (191)..(214): n is a, c, g, or t
gttcggaaagttcggaaaaagcggaggactcagaaaaatctgaaaattcagaacattcgaaaaaaccagacaattcgaaaaaaccggaaaattcgaaataatcagaaaattgtgaaaaatgtgttgcaatgtgtgaatagaaatacctcgtttttagttcaaatataaatatctagaaatggttgactagnnnnnnnnnnnnnnnnnnnnnnnntgtatattactgcaaatacaaattcgttaaattttttacaacagttctatttttacgagacttatggtccgtgtcaggctttcctgtcatgtaattgtcagatgccccctattattttgggtgcatccaaaaacattcctctatggtaaggaatcgagtcaaatatttctagatttaatttacttttacgacctgtatccaggagttagtaagaacttattaaacgcatttttacctacaaaattccatatccttctccatcaaactccaatcctattgtattatatttgttagtttctgatactttttttgagatttatgtaatttttaaaaagtactggtgcaactgcatttttgcttcgt

SEQ ID NO: 16702 - DNA, 164 bp, Diabrotica virgifera
  misc_feature (2)..(28): n is a, c, g, or t
  misc_feature (30)..(42): n is a, c, g, or t
  misc_feature (51)..(78): n is a, c, g, or t
  misc_feature (80)..(97): n is a, c, g, or t
  misc_feature (108)..(130): n is a, c, g, or t
cnnnnnnnnnnnnnnnnnnnnnnnnnnncnnnnnnnnnnnnncctcgcccnnnnnnnnnnnnnnnnnnnnnnnnnnnncnnnnnnnnnnnnnnnnnngagcataaccnnnnnnnnnnnnnnnnnnnnnnncgaacgaaggggcggatgaaaaaaaactggcttt

SEQ ID NO: 16703 - DNA, 66 bp, Diabrotica virgifera
gacgcgccgtgtacccgctccactccctcgcgccgcgtgtcgtcggttcatccaatatcatgctcg

SEQ ID NO: 16704 - DNA, 458 bp, Diabrotica virgifera
ccagaatgttccaaccaaaataaccttcaccaaatgaacagcgccgaagagatagtagaaaatctcccgaaggtatggaaagtccttatagagctactgagtcaccaaacaggtcctacaaatgtcctcacagacgaaaccagtgacgaagatccttgttataaaaaagtcgacactccgaagggaccgagcctcgtcctaagtgtaagccagacgtttattcgacttaaggatctaatactggagaagaagtcattggaaaaggagactgcgcacttgaaacatttaaacggtcatttggagaaccggttacaagaccaggaaaagaggctggaattggtgcagactgagctgtcaaaaacatggctagtggttgggaagctgcagaaacaacatcaaatgttacacacccaagaaaaaatcctcagataccaacttgcccacacaataagactttt

SEQ ID NO: 16705 - DNA, 255 bp, Diabrotica virgifera
gccagcggccgtccttcttatactagggacatctttggaatttgaaaagtattccgaaattatggatatgaaggaagaagttatgaatgatgccattgatgatgccatgcaatgggatgatgctgcctgacgaaactgacgcagcctgtcttgcatgtattctatggatgggatcttcctgaggacgccactctttccgaattgccgctgcccgctcaatctcctcctgcctctgcggaacaacttcctgtcgct

SEQ ID NO: 16706 - DNA, 455 bp, Diabrotica virgifera
ttagggcgcccacgcggccggcgagcggccgctggcgatctttttctagagcaaagctaggggggcaggagctttgcagtaaatattggaattaatgcatattttgaagtttgcccggccgagtcaagtagattcaaagcattacctataaaaaataagattcagtcataacacacaatcacataatgaggaatttaaaaaataatcctaaaatcaaaaatcgttgcaagcacttattacattttgaaaaagcatatcttattcaaaaataatcctagaattttctataataccaccatttttaagcaaacagaataagctttctttttattatatactccctacctaaacgaagaaaacacagccacacccgcaaattcggaaaatactcctacaaaacatgatagttcgctcaataccgtaacgccctgcaaaggcataacctcctttaaaag

SEQ ID NO: 16707 - DNA, 211 bp, Diabrotica virgifera
  misc_feature (24)..(24): n is a, c, g, or t
tttaggcgggacgagaggcgaggngagaaacagcggggggcccttttgagaccgcagaggggaccgaacaacccacaaagaacacaacggcggaccaacccaccgaagaacaaagggctgaaaacaaagaagcgcacgcacaaaaccaaacagacggggacggcaccaacacgaccacacacaaacgaacaggaaagacaccccaacgacc

SEQ ID NO: 16708 - DNA, 321 bp, Diabrotica virgifera
  misc_feature (215)..(232): n is a, c, g, or t
acagcgtcgaagatgtcgtattttcagatttttgtcgcgaaatcggcgttaaaaatattagacagtatgaagatagagaattgagagcacaagaagagagaaagaagaaaagattggaatttgagaagcaaatcaataggattacgagtaatctggatttcgaaagaagcagagatacacagaataacgtcagtcgctgggaacgcacagtaaannnnnnnnnnnnnnnnnnggaagcttgtaagaagcaagagatcaaacatagggacgaaatagacaaagatcttcaacaagtagaacagttgaaagggtctagattca

SEQ ID NO: 16709 - DNA, 130 bp, Diabrotica virgifera
  misc_feature (17)..(17): n is a, c, g, or t
  misc_feature (25)..(25): n is a, c, g, or t
  misc_feature (27)..(28): n is a, c, g, or t
  misc_feature (30)..(31): n is a, c, g, or t
  misc_feature (78)..(78): n is a, c, g, or t
  misc_feature (104)..(104): n is a, c, g, or t
ttttaggcggaaaaganagaaagananncnngacgggacaccccttttaagggacgccaaccacaaaaaacgcccganggcgccgcagcccgcgggcgcaccgnaaacaaacgaaggaaaataacagccc

SEQ ID NO: 16710 - DNA, 621 bp, Diabrotica virgifera
  misc_feature (98)..(203): n is a, c, g, or t
tctacggcggcctgttgcatctgttggcagaggtcggagatttcttcgaggtcggcttttttcaggagcaacacggctttttctgccagcaaaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctggagggcttcgcgcaccggcatggggctggagccgagggcttcggcgaggccgcggatggtgagtttctggccgggctggaaacgaccactcatcaaggcttcgcggatctggcgatagacctggtcttgcaaggtatcgcgggacacctggcgcaaggtgggaaggagaagcgggccatctgtcatgagtcaaaacctgtgttgtcgttcttatggctccaatatgtgatcacaaatcaaatatgtcaaatagtttcccgttgacggtatcgacgacgctgactctaatgagccctttctccagcaaggaccgctgaaccatgaaatttgcctacaccatcgtctacgtcccggaagtcgctgcatccctgcaattcttcgaaaaagccttcggcttcagtcgccgttttct

SEQ ID NO: 16711 - DNA, 705 bp, Diabrotica virgifera
ctggtatctggtgctggaaaatttctgatcgatattaaattatcatgtaaaggacgaactgaattgtttcccacaatgtgccccaaatattttacctcttctcttgcaaaattacattttagaagtttgagcctaaatccctcttcaagaatggcttccatgagtcttgcaatgtgctctaagtgttcttcaaatgatactgaaaatattaaaatatcatctatgtaatttatacaaaatggatttaaattatgttttctgataatattacttaaaatcctttgaaatattgctggagatgttttaagcccaaaaggtaagcatttccattgccaatgatcatcttgtgtaacaaaagctgtcttatatttatctttattccgaactggaatacaccaaaaagcagaatttatatctaaagtagtaaagaatttagcattccttgttttggtcaaaatctcgtcaattaatggaaaaggttgtggttcgggaacaattaatttgtttaattcacgaaaatcaatgcataatcttgttttagacccttcatcttttttaagagccaatgtaacaggtgctgcaaaaaggcaagatgattcttctattaaatttgcttttaacaaatgtccaatttgaaattctatttcttttttgtcctctatttgagcatctataaggcttctttgcgacaatttattgtctaaa

SEQ ID NO: 16712 - DNA, 491 bp, Diabrotica virgifera
  misc_feature (160)..(198): n is a, c, g, or t
  misc_feature (432)..(474): n is a, c, g, or t
gtagtatcagcggctttgacgttatcatcagttccatcatcttcatcttgttcagtttcttttgcatcatctgtatcagcggtgtcgtcgttttcattactagcttgatcttcatcctcttgatcctcttcgtcaccatctttatcgtcgagatcctgannnnnnnnnnnnnnnnnnnnnnnnnnnnnnnnnnnnnnnccttcgtcatcatcatcggcatcattacttaatttctcttcagaaatgtctcttttctctcgactagctttaatatcatcctcctcgtcttcatctccttcatcctcttgatctttttggtcaacttcctcagtgtcaccatcatctgcttcctcagtttctgcttgatcatcatcttcgtcatgatcttgatcatcatcttcgtctaaagcatattcatcttctttggaagcnnnnnnnnnnnnnnnnnnnnnnnnnnnnnnnnnnnnnnnnnnntcaccaccattatcatc

SEQ ID NO: 16713 - DNA, 753 bp, Diabrotica virgifera
tttgtccgaacggatatttccgaaactaaaaaagcagaagtatttgttgctgtagaatgtttaaaagccgatattactaaaatcaaatccattaaccaaagtcttcaaaatctcaaagaagttacaaattatattgaacaattacccaaaccagagttattagctgctgttggaaatgatgtacaaacattaatgaagcagatacagactttcaaagtagataatgaagccatctatatagttgaaaagtacacggaaactctaaaacaagcgattgtagatgtagttaatcaagatcgtacagatacaaccgagcggttagagaagtcaataggatccagacctatagaaggagatattgggcagtcaatacgaaatatcaattcaagaatcaaagaaattgtggtcaaagaagaggaaaaagttaccaaatctttacaaatcgaagaactaatccagacgaaaccaaccatggaagtttctggtatcaaacttagtgaaaaatttaaccaagatcatagaaaatttaatcaaaagcaacagaggaagctactatatctgaaaaaccttccaaccactttaaaaggtgtaaattcttatgctgccaccatatctgaacatgcaggaaccagtacagggtacttcacccgaactacaatcctttcaccaccgatattacttgctccttggacccaaattcttctcataccacaataactcaattgatggatttttttttatcaaattttgaaa

SEQ ID NO: 16714 - DNA, 780 bp, Diabrotica virgifera
  misc_feature (735)..(771): n is a, c, g, or t
gtaagctgcaactgaagaacaaaaaccatcaagatgtccatggttccacttcttttccgtgactggtgggatgaagaagacctcatgcgtccttccagacttctcgaccaacaattcggtttgggattaagaagagatgatcttcttaactcgataagagatatacccagaagatctgcattgtcgtccagatatattagaccatgggctacatccactgccctacaaagacaagattccggctcaaccattacacaagaccagaataaatttcaggagagggtcagctcgaattaccatgaagataccacattgggtaatcagttagaatccgaaagtattaggatggaggagaaaagtcaggattttgaggttattttagacgtccaacaattcgctcctaacgaaatcactgtaaaaaccaacggcaacagcatcttggtagaaggtaaacacgaagaaaaacaagacgaacatggatatataatgagacactttgtcagacgatacgttcttccacaaacccacgatgcccgaaaacgtggtttcctcattgtcttcagatggtggtttgacggtaagcgcaccaaagaaaagcgaaaaaactgtaacttcggaaagggtaatacctatcccacaaactggacccgccaagaacactgtaacaccccgttgtaaatcctcccccaaccccaaccacaagtgaactaagaaattttgataaataaggttggnnnnnnnnnnnnnnnnnnnnnnnnnnnnnnnnnnnnntaaactaac

SEQ ID NO: 16715 - DNA, 664 bp, Diabrotica virgifera
  misc_feature (63)..(82): n is a, c, g, or t
tttcgtccgggtggatgtgagaggtggcattctgatttttgtataaaaagttttttgatgacnnnnnnnnnnnnnnnnnnnnattttttctctctctcagataggacgagaacattactcaatgttcaagctgccacccactttgaacatttaatttaaggggatgggtatggcaaacgtgcaaagcagatggaagttttgatgtacatggtgaacgacaatggtgttcgaaaaaccttgttagtttaaaaggtttaagagaatggcaacaaatggtaaaggaaataaatcagcgcttggaatttttgaatataaaacagatccatggacagacggaattacaaatcgacgaaaagcctcttgtattgaagatgatcatcgctggagcattttatcccaacttttttataagagaacaaaacgcaaatgaagtcgacgacaagcaactcgttagagctgttggaggtcgagatccatatcgttcagtgtatcttacgggaatggattctcaacagcccggtcctgtttacattagagttattaaaagtctcttccaaaatgaaaacgatagaaatactaatatattccatagggtttgacttctaataataaatccaccttgaaattcaaaagttttaaaccattaccaaaatagaatgggtat

SEQ ID NO: 16716 - DNA, 874 bp, Diabrotica virgifera
gtggtgaacagtgataaagtgaaatatactgacaattttatcgaaacaaaatacacgtaccaatacaacaaagctagaaaaaatggggatgttattgaggttacaccaatatcagaaaagctagttctaaagacgtctagaaaaattcctaaactaggtgttatgctggttggatggggtggcaataatggttcaacgtttactgccgctgtaatagccaataagttaggtttaacatggccgaccaaaaagggaatccaagaagcaaactggtatgggtcccttacacaagccgccacagtatccttaggtgacgatgtcttcgtgcctttttcaaaattgttacccatggtagatccagatgacatcgtaataggcggctgggatatcagctcggctaacctagctgaatcaatggaacgagcccaagttttagaaccagtacttcagcaacaattaaaaccacatatgcaaacattaaaaccaaaaccttctgtctatataccggaatttattgctgccaatcagaaatccagagcggaccatgtaattaaaggtacaagacaggagcagttagaacatatatgccacgatatagccgaatttaaagacgccaataatcttgacaaaatcatcattttatggacagcgaatacggaatgcttcagcgacgtcttagatggtgttaccgacacagctgaaaacattaaaattgctatcgctaacaatgacagcaatatatccaccatctacactatttgcatacgccgctatagctaacggatgtacttacataaaacggatctcccacagaaataaccatttgtttccaggaaattattgacttccctgaaaaaccgtgggagaatttatt

SEQ ID NO: 16717 - DNA, 400 bp, Diabrotica virgifera
actatctactataactttttcactactttcttgaaagtcaacctccattaattcttctacttcactaggttgactactgattgttgaatattcccttttgattccattttcactctttacacttgaactggatgaagtttttgagaagaatgcagaaagccctcctttgggtttattgtttgtagtggattttttgtcagcttctttttctttattattctgtgtttgctttggttcatcctttgatgaagctgaatcttcagatttcagagaagtacccgaagatgtttttggtaagaaaaaggaagactttcctttaattgtacttggtggaggaggtgggagcttctttaccttttacaactctctttatacaacactttctatttaccatacaacc

SEQ ID NO: 16718 - DNA, 810 bp, Diabrotica virgifera
  misc_feature (788)..(809): n is a, c, g, or t
ataatgtatgccaaagaactgagatctgtcatctattttggaggaattgaacctagtttaaggaaagtagtatggaaacatttgctgaacgtgtatccaagcggaatgactggcaaagaacgaatggactatatcaagaagaaagcatcggaatacgtaaatttaaaagaaacctggaagactgcaattgctcaaggccaagtggcgggagagctggcctatacgactggaatggtcagaaaggatgtactcagaactgacagacatcatcctttctatgctggtagcgacgataatcaaaacattgcttctttattcaatatccttaccacatatgctctcaatcaccccaaagtaagctactgtcaaggaatgagtgatttggcatccccgctattggtcaccatgaacgacgaagctcacgcctatatctgcttctgcgcactgatgcagcggttgtgcaccaacttcatgatagatggcattgccatgactcagaagttcactcacttagccgaaggaattttgtactatgatcccgaattttataattatttgaagatacatcaggctgacgaccttttgttctgctaccgttgggtgcttctcgaaatgaagcgtgagtttgccttcgaagattctctgcgcatgctcgaagtcctttggagttcccttcctgccatcccggcagaaaaggagctccaaatggtcgaaacaatgttcccaccgaccatatcaaccccccctatagtccatttataaaaaacacccaacagaaaacgctttannnnnnnnnnnnnnnnnnnnnng

SEQ ID NO: 16719 - DNA, 157 bp, Diabrotica virgifera
atatgtaacgatttattaaatattaacaggcaatacattttacaatacaaataaatatatttatcgaaagacgacttattgaaactaggctcttgtcgtggaagcttatactctcatttaattataaaaatttccaaaataaagaaatacataatat

SEQ ID NO: 16720 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(190): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaacccgtgtgagccagggtggttnnnnnnnnnnnnnnnnnnnnnnnnnnnnngacgaaaggaa

SEQ ID NO: 16721 - DNA, 431 bp, Diabrotica virgifera
  misc_feature (15)..(56): n is a, c, g, or t
tttcgtgcgactagnnnnnnnnnnnnnnnnnnnnnnnnnnnnnnnnnnnnnnnnnngaattaagtttattttaaaggagattagctgaaaatgagtgacaattatatgcagaaacgtataaattagtaatacagagtatatatcaaattaatcatataattctccactctccatggcttgctggtagctctttccgcctctttgttcggaatccaatttgatcatatcgcctattctcaagatggaaatgggagcttctgtcgcaaccttaagggattttattttggacatggtgggttccacaaccccggcttttcggctatctcgaacggccccttccatgagatctactcccacctattcactctgcgcatgatcctttttcgcttgacttggcattctggcttgccctccacccacctaccaaacct

SEQ ID NO: 16722 - DNA, 867 bp, Diabrotica virgifera
cagcttgctgttgatcaacttttttttcatacgcggaatccagacctaaaacctttctctatcggttgctgaacgaaataattattttactgtggaactaaaccattgtctaatattacgcaatcatcgaagtttctttcgaccaatccatctcttttcttccactttttcttgtattattaggcagtcgatggtatttatgtcctctaattatatggctaaagtattctgttcttcgtcgatggtatttatgtcctctaattatatggctaaagttcttccttttattatgtttatgagcagacgttcttaatttattatttttggtcatccgagttgaagggaccaatcgtagattcaataattaccaattaattttgaaacctatgcaagaatggtgaagaaaacccgcctctaaaatgtttgcacacggagtatgcgctgtagcatgcgtatcgcactcgcataagaatagtaccgtaaccaaaaattcatgttttgactattggcgtcatatttcaatattttttgttgtctgtgcatgtaaaatattgtagtaattcaatttgtaaattaaattcaatgataattgacttattgtataattcaaacttataaaatagtgtcgcatgttagatgcgtttgaagttagaatattcttcttctggggatgcgatatatctacgtgttttaaatgagattttgcctctcgttgttgctagcttattcgatgtgatctcatgagcacgccaagaacttgttcccttaaaaaattaactatataacattaggtactgttaagtaaatcaacgatttcatttgggctcacatttgttttggaacacctgattgccaggagtggacaaa

SEQ ID NO: 16723 - DNA, 278 bp, Diabrotica virgifera
  misc_feature (14)..(15): n is a, c, g, or t
  misc_feature (31)..(32): n is a, c, g, or t
  misc_feature (37)..(188): n is a, c, g, or t
ttgagggcgctagnncgagatcgcgagcggnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaaagaaagcgaaaaaaaatatgaataatactaaaaaaatcagggggttatataataacgaaaaaaccacaaaccaacctcagaatc

SEQ ID NO: 16724 - DNA, 903 bp, Diabrotica virgifera
  misc_feature (173)..(191): n is a, c, g, or t
  misc_feature (877)..(896): n is a, c, g, or t
attaatcaatgttttaatattcagacttaagcaatataagtactaagtgacgaccaatatgaggatatttcgactaaataagaccaatgaatatagagatgttagaaattgacgagaaatattttggaaaatatctggcaaagcaaaatataacttctaaactcatagtaacnnnnnnnnnnnnnnnnnnncggtatcattttttgatacattcttattatgaatattatgaattactttaaataagaagcaatctcagatatttaaaacatttgccttaggaccagtaacaccagtaaatgttgatagtaataagagatttaaatgtacttttattaatttcttttactggatgacttctgaactttatgtgaaatgacttaagaaattgccaaatgaggaactgcaaaaaagcatgtaggttaacgttttcattatagacacctcactgtcatatttacttaagcttctcagaaatcatccaaacaaccctaaataattcaaaataatattaatagtgcaataaaatattaagaagtattatggatagtctcaggtttccgagattaacagatttattggaacttttgaaaaccttctaatttgggataaatgaaaatctttgttctcggacctttacaaacaaataagaaggcaacgtattttacagcccgtttaccaaataaacaggggaaatacgaaaatttggggtttttttaaaggttttctttagcttagtagataaggattgtaattttggtggcccgtggaaattacggaaatcactttgttggtctaatttttcccgggaaaagcccattttatgggttgaggttggggttggtattaaaaaaaaggccgctttatagcgggaggnnnnnnnnnnnnnnnnnnnntttttgg

SEQ ID NO: 16725 - DNA, 843 bp, Diabrotica virgifera
  misc_feature (16)..(16): n is a, c, g, or t
  misc_feature (22)..(23): n is a, c, g, or t
  misc_feature (25)..(25): n is a, c, g, or t
  misc_feature (27)..(27): n is a, c, g, or t
  misc_feature (31)..(31): n is a, c, g, or t
  misc_feature (49)..(49): n is a, c, g, or t
  misc_feature (52)..(55): n is a, c, g, or t
  misc_feature (57)..(57): n is a, c, g, or t
  misc_feature (69)..(69): n is a, c, g, or t
ttaagaccgaaaaggnattggnngngngagngcaggggctacttttacnggnnnngncggaaaggaccncgcaaaaaaacacgaaactggaaacaatgtttttggttggtgttgcaaattagcaacaaccaataaatttaaacttaacttactatactcggagaatatactgtgaaaaagaaaaccttgcatcaatcaaaatagtcggatctttagccgtgtccataaaaaggcacttttttacatttagaagcaggttatttaatttctatccatttacacagagcatttaaatctgtttgaagggcaatttgcattagaagtgtagtatctaccaactatatacataaaaagtgaaattaataactcaaaagactgaaacaaagagttaacatcactttttggaaaaataatagaacaaattcgatttctttcttcactagctcaaattttatggttttatctcatgtttgttgtgttaccaacttgttttaatactacatttgtggcatcacttaagaaaaacatcagtttaatttatttgtgactttacagttttgtaaacaataaatttctagcatttttaactatccaccagatgtttataaccactatcacctcaaatatatgtttccacccattccacttaaccttcttcttccttaagcgccccctttgcatctccacgttacccctccttcttgctcacacttcctgaaatttttcccctcaccctcctcaccaaaaaaatcattttaatggggaaaccacagccctggccaaaattactccaaacccaaatgtttttttttatctatcccttctttttttcctcccattttt

SEQ ID NO: 16726 - DNA, 160 bp, Diabrotica virgifera
cgttgaaataatgatttttgctaacagtgagcacttttggcatcaaagatccaaaaagggtcaacaccgttagcttcacagcggccgacgagccccttaagtactaccatattttctagattacgggagaagcatgaacttcttagtattaacgaccgtt

SEQ ID NO: 16727 - DNA, 514 bp, Diabrotica virgifera
  misc_feature (262)..(283): n is a, c, g, or t
ggaagctttgttttgacgtatttgtaattgtagccacgagagatgaaatgaaatatttaggcaaaaatacatcaggtactgaagggatggagcgtgaagttacggacaaaatagaaaagttagcagatataaatcgatctccagttgagagaagtccgagaagaattgctagtattacggagatgctgaaaaatcaaggacagaaagacactacagagcagaaagtgatacctggaagactaaaacagaatcttaatataannnnnnnnnnnnnnnnnnnnnntcagtcgcagccaaaaatttccagtttacgaaaatcccaaagcttggagtcaccttcagacgaggatataagtgattctaaagatgttataagtgaacctgcaacgaagactcttagctataaagattcaccacccaaggacgaggaaaaacctgttaatttcgatgaacctgataacgtgaatatcctggaaagtattactaaggaaagagttcgaattccagtaaagag

SEQ ID NO: 16728 - DNA, 447 bp, Diabrotica virgifera
  misc_feature (248)..(263): n is a, c, g, or t
gtagtgtttgtatgtattagaattgtttttattatcctacgattttaatgaataatctatgatataatgccggttcacttatataaatccttggttattccattttgttaccaagcttttaagacaaaagtaaaatgtttgtttatggtcatagtagtgggcctgtttaaagattttcatcttgataatttttaatcctatttgaagaaaatgagtgataaaatgtccaaagctactgggacctctgnnnnnnnnnnnnnnnnactttatgctacatgggttgacagaactcctgcaaattgtattcccaggctttgttccctcactttaacaagaataataattttaaaaccactcggatctgatttggctgctgtttcaattgctgcctagatgcagtcaccaaaaagaatacttcgacccaatgaattacttttaactccacct

SEQ ID NO: 16729 - DNA, 227 bp, Diabrotica virgifera
  misc_feature (86)..(106): n is a, c, g, or t
ttcagtccggcataatatgcgaacggtactagtttttattgaatcaaaatggcggccatatatttcaacgaatattatgttgttgnnnnnnnnnnnnnnnnnnnnncagacattattgtacaatgtgttaatggatatttaaaaacgcacgtttatatatataattattgttttaacaccgaagatttgaaaatatgagatatcctctccaccctagaacctgagcg

SEQ ID NO: 16730 - DNA, 650 bp, Diabrotica virgifera
aagcttaaaatcaacagtggtttcagcaggacgagtttaacccttcgcacggccagggagcctcgtcgaatactgcgtgattattttgtgagatcgccactcgtcagacctaactccacctgatgcgtacataaatgggaaatgctgaagtaggcagacggatctacattctggacggatctgactttccggaattgcggactggaattaaagaatttttcgtgtcagagggcatctttaacatctgttttatcgggaacgtcgtcgtgaataatgtttgcaaggctatatcagtactgtttattttgctgctacttttattttgttgtattaattcataatacatacgaacttgtatcataaactgcttgagttacatgccatgtatttgccaaagattcaaagatctgtatttaccacattatataccaaagaatacatagactaagtactatttttacctgataagctataaaaccaaaaccaattgtcgatatttggattatactactgagaaaaagcgttgaaatagttttaattataatcgaattaggtctagtttgtatttttaattagattgtctctctttaatgtatacgtagaaaatgacttttaagccttttctttgcacgtaatataatagatgtcat

SEQ ID NO: 16731 - DNA, 399 bp, Diabrotica virgifera
  misc_feature (150)..(171): n is a, c, g, or t
  misc_feature (335)..(358): n is a, c, g, or t
  misc_feature (368)..(394): n is a, c, g, or t
tttcgtccgatggcacaaaaagaggaagaattgcaaaggcttatttaagaggaggaagataagacactagaggatgaaagattgaaaaaagaggaaaaattgcaaaggattaaaaaagaggaagaggataagagactagaggaagatagnnnnnnnnnnnnnnnnnnnnnnttggacagaaaaaagaaagagcaagaggaaaaagaactagaagaaaagaaagtcagagagaaagagatggcagaaaaagaggaagaactgcaaaggcttcagaaagaggaggatgataagaaacaagaggaagaaatattgagaaaagagaaagaagagcttannnnnnnnnnnnnnnnnnnnnnnntcgaagaggnnnnnnnnnnnnnnnnnnnnnnnnnnntggac

SEQ ID NO: 16732 - DNA, 260 bp, Diabrotica virgifera
tttcgtccgaacgatgcagaaagtattaagaggtggaacccaaataaggctcctttcaacaacagtcgatagtcaagaaatggcacattttaaaaaatatgtcaactattggtgggatgaattcggacgagtaaaaccactacatgctatgaataaaattcggataccttggattagagattcacttattagtggaaaaagagttgaagatcctgctttgccattaaagggctattcagttttagatgtaggttgtggag

SEQ ID NO: 16733 - DNA, 55 bp, Diabrotica virgifera
ttttcttgttttttttatttggggtggagtttttggctttttttgggggggggga

SEQ ID NO: 16734 - DNA, 214 bp, Diabrotica virgifera
atggctttggggagagccaattagctttaacccgcgagtaatagcgccgtcagatagaatctcacatttcatcctttttcgtaatacagtaaaacctgtcagtaacggctactaaaaatgaaagaacaattggccgatatagaaaggtggccgctattgccagtttttgtagtctacatataattggtttgagaaatttttaaactggccgtta

SEQ ID NO: 16735 - DNA, 482 bp, Diabrotica virgifera
  misc_feature (40)..(67): n is a, c, g, or t
  misc_feature (327)..(361): n is a, c, g, or t
tttcgtccgcacatatgtaggtacctatttaatattcttnnnnnnnnnnnnnnnnnnnnnnnnnnnnaattaacagttatatttgaacagttttgaaaggaaattccttgcaagttttgcttcaacacattttgtttgacaaaaataattgtgtttgtattgtgcatgcacctgcctcgggcccgtattttaatgggacttggaaagattacccataaatcaggtttaattcaacaacaaattaaattttcaaaattctttcattttacaaacaggaaatgataaatgataacaagaaaagttataattaaacaatgtttaatttcnnnnnnnnnnnnnnnnnnnnnnnnnnnnnnnnnnngaaatttctgatgcaaatatcttcttcttaacgtgccctatcaagctccctttgacgctggtgactaacatgacgaaactgtctctgcctcgaactatccaaaatagcctgcccgctcccc

SEQ ID NO: 16736 - DNA, 743 bp, Diabrotica virgifera
tttgtccggacctctcgaggatgaggcggcattgtacctacccctatgcggcatcttcctccgcttgctaccaagaccttgctatgatagacaggaagaatggcgttcgaccaactatgatacctacgttcgaatgtgtgatacgacgtcataaaagatctacacattgtgagtacggatgtagactctgataattggatccacacttggcaagaatgagctacgcagtcttgtacctacgatacctgcacgccgtcttgcggaagttgttgcagcccttgatcgctcaactaggacccttgtgcacactaagcactgatggcacccaatgtggcacgctcaatgtcctatatcttcgagactgagcaactgcagatggagctgcttccacattgtaaaagaaagatctctaactgttgatgcagagccagctgatgaaaccataagcgaaactaccgccgatatcgacaacgtgaaccaacctaatataactaccatacttcccttgaataatattattaacaccacaaatcttggagatattcccattaatcttaacaatacaaataacgcagaatatacatttaatttatggacaaactggtctctccacacattaccaatggtggactggaattagccccaagggaatgcgtctcctagccctcccaccccctcggcttctctataaaaacaaaaaaaggggcaaactcccccccctcctccccactcccctttacccc

SEQ ID NO: 16737 - DNA, 258 bp, Diabrotica virgifera
  misc_feature (17)..(17): n is a, c, g, or t
  misc_feature (27)..(28): n is a, c, g, or t
tttgcgggcggaaaaangaaacaaagnnaaaggcttctgatatttattcagacgacagtgattcagataatgatgacgacgaaaaatcttcatcctcaccacaaaggcccacaatagcagattctgttagatccagatcacgctctaggtccagatcagagtcatcatctagttcaagttacagacgacccgaagagcgggacatccctcaccctcctataatctcgccgcgcagccagaaggtttccataatcttca

SEQ ID NO: 16738 - DNA, 759 bp, Diabrotica virgifera
  misc_feature (351)..(377): n is a, c, g, or t
taaccagacacaaaatcctatgcgccgatttcttagaaatgaactacgacaaagtatttaatcactatcagagacttctcaattctgagaactacgtcactcggcgtcaaagtctgaagcttctcggggaattgttactggatagacataatttcacagttatgaccaggtatatatcgaaccccgacaacttgaaattaatgatgaatatgcttaaggagaggtctagaaatattcaatttgaagctttccacgtattcaaggtattcgttgccaatccaaataaacctaaaccaattttagacattttattacggaatcaagaaaaactcgtagaatttctgatgcggnnnnnnnnnnnnnnnnnnnnnnnnnnncagttcaacgacgaaaaggcgtatctaataaggcaaatcaaggagctgaaaccgataccgggccattaaagatactgatactgatactgtactttgtcaatattatttttacttgctacccattttaatttgcaaaagtcaactagattgtaattgaactaagcaattttatacccacacgattattgctattacgattttaattcatttatcaatcacaaaacctttgtctaagccctctttccatgaaactttaacctgctccataagtaaactatagccgattcgcggaaattcaagtgaataatacatcaaacgggcccgccgcttggtttcacaaattccctctatcctcctcctaaccagctctaactcgccctct

SEQ ID NO: 16739 - DNA, 419 bp, Diabrotica virgifera
cccacgcgtccgccggggcccaaccaaacgactcaagtggtgccgcctcaaaccgcgggcggcgccgctacaggaggctcggtcgcttccaatgtgggaggggggctaggagacggcagtgccagcgcggccagcagaaacgaccaaggacaagtctatcaagatagttacgtttcctttttgaaccagacacccggtggaaaccaggcggcacgtgggcgcggacgcgggccccactccaacgggaaccccttctcctcaggtgcctctatccccagtctcgggccacagcccggcacaggtaccgccgacattaccgcctaatttacctccaggacaactcgtctcctccagtggacgaaccacatatgtctgttttgatgcccccacaacgtctccccacactcagccgctgcttc

SEQ ID NO: 16740 - DNA, 97 bp, Diabrotica virgifera
  misc_feature (7)..(44): n is a, c, g, or t
taacagnnnnnnnnnnnnnnnnnnnnnnnnnnnnnnnnnnnnnntgcgacctcgatgttggattaaagtttataattggtgcagcagctatattatt

SEQ ID NO: 16741 - DNA, 93 bp, Diabrotica virgifera
aatgcaattccgttatctgtgatggcaacaacgaagtgattcatgaaccattatgtcacgctgaacacgaactccgtcttacattggcacaac

SEQ ID NO: 16742 - DNA, 208 bp, Diabrotica virgifera
gagtttttgatactggattattagattgtgaggtagtctggtgctaggggttactcttgctttgagtcggtaggatacaccgttttctagaaaaatcaatttgaaagtttttagttttgggaatttgaaaaagaagatatagataattaaataagatgatgtatattaccgacttagagcgcgagtgacttctagagctcgttttttc

SEQ ID NO: 16743 - DNA, 286 bp, Diabrotica virgifera
gctggtacaggggcaatagtttcaatccataactagaccatcataaccagcacctccatattctttagatacacatatacccaggatacctagttcacctaatttgttgatttgctgttctggaattttatgcacaaacatgtccctaagttcaacctcccaaattttatgtaaaggaacaactgccataatttcaagatgttttagtttacataaacttccagaaactcataagcctacttcaagtagacttgtatggactttgtacaaaaagaacttaatccca

SEQ ID NO: 16744 - DNA, 656 bp, Diabrotica virgifera
cgcacataacccaagtgacatcttgtctcgattatcgaaactcaagaaacacttcatgacgaataggatccaggctttaattacttaaagaccacaacgttacctggatgtgagccgacttccacccgatcttggatacaagatctggtgtttatcatatgtatctttatgtatacacccatcatcatggcgggactcgcatcatcacttgaacgcatactagttgaagatcctcatgtacaatcccgtcattgatgctattgaacaccctgatggattcccccgactctcttctcatcactatgaccaacgagctgatcttagggttgctgctcccactgaacctacccctattgtcggaagacttactcctgccgtgtttacccatcagatccatagatgtattcatggaacctcttctgctgatcttccctgaccctgcttttgatcacctacctatccctgaagactcttactacaaccttccagatattgctttgagcaatactgactctccgttacatttggctgatatagccattcccgtcaactactatctctcacacagtattgctgtactgtgacgacttttgtatagaaaggatctccgtcttaaacgtatcatgccacggcagaccaaatggaatgaagtatca

SEQ ID NO: 16745 - DNA, 185 bp, Diabrotica virgifera
  misc_feature (4)..(113): n is a, c, g, or t
  misc_feature (120)..(120): n is a, c, g, or t
  misc_feature (125)..(177): n is a, c, g, or t
gttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatanaaaannnnnnnnnnnnnnnnnnnnnnnnnnnnnnnnnnnnnnnnnnnnnnnnnnnnncatttttt

SEQ ID NO: 16746 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16747 - DNA, 758 bp, Diabrotica virgifera
  misc_feature (92)..(113): n is a, c, g, or t
  misc_feature (124)..(156): n is a, c, g, or t
  misc_feature (221)..(240): n is a, c, g, or t
  misc_feature (252)..(282): n is a, c, g, or t
  misc_feature (323)..(351): n is a, c, g, or t
  misc_feature (635)..(653): n is a, c, g, or t
  misc_feature (669)..(686): n is a, c, g, or t
atctgaggattattagcttttattttctctcctaggcatttattgttactattattaagatcacaatttattgtaattgctttatatattcnnnnnnnnnnnnnnnnnnnnnngatataaattnnnnnnnnnnnnnnnnnnnnnnnnnnnnnnnnncaagagttgcgaaggttctttacgcctagcaattttacttataatatttcatgtttatgaaaatnnnnnnnnnnnnnnnnnnnnttctttatgacnnnnnnnnnnnnnnnnnnnnnnnnnnnnnnncctttatgttttcccagagatttttgatcacctcaatgatnnnnnnnnnnnnnnnnnnnnnnnnnnnnnccctaattatgcccgaggattgaattatttctctatttctaatattttaggcattgctcctcgatcttatagattaattttactaccagtttgactttgacctctaataattctacctagacgaaaactatatcaatatgcactttattcgccttaatttttattataatcaatttctttaatattaagactatatctacaattttcttcattatgtattttcattctttatttatgttctgaaatgtatattagtacccgatatattatcatgtattggttgnnnnnnnnnnnnnnnnnnntcacaggctgaaagcnnnnnnnnnnnnnnnnnnccatcatatcattacctatcataattattatctattatatagatgaatagcttcatcgcatttctgttttat

SEQ ID NO: 16748 - DNA, 762 bp, Diabrotica virgifera
atggtcataaaggtgataagtgtgtggttaaagtgatattgcacccgcgagaccaatggtaaaagtggcattatagcggtaaaaaatgaatatcttaactctcccccccaattattaccatagcatcaactgcataaagaaagcagagcaactatttagaatagctcgagacagagacagtttcgccatgttaatcgccaacgtcaaggggacttaatagggcacgttaagaagaagacgtatatgtaggattcgttaaagacaatcgtaataaaagtccgtgtgatgtttaacagttttaattaataaaatagataactaaattagatgctattaaattgacgaaatgtaaaagtgttcgtgtaattgcgaccaaaattttacgagttttcacaaaagaaaatgtctttgaaataatcgcgtttatctacttaatatttgaccggcttgtcaatatataagtacgtattaaacttcgcgtcctttcgattattgccaaatacaacctctttcctcattcgaatctcaaaatcgactgcctctcgcacccctacgctaaataaaaatctcttgcatctaatctcccttttccgtttactcctgagaaccaaactattaaaagtggttcaaagttgccaatgttattcttacttaattagttcttaaagaatcaaagtttagaagtatttcgcacccgaataccgtagtcatcccaattcttatctaccatctgggccactcgaagtaagttcatatgtgtga

SEQ ID NO: 16749 - DNA, 921 bp, Diabrotica virgifera
  misc_feature (20)..(40): n is a, c, g, or t
  misc_feature (721)..(721): n is a, c, g, or t
  misc_feature (903)..(903): n is a, c, g, or t
ccgaaagacactgacacaannnnnnnnnnnnnnnnnnnnnactattaaaattctaattatatgtgttaatagtttccgattaattaaaataagttaatacatatttttgcaatatgacacctgctattgtttgtgatattttagtgattatgtgttttgtgcactctgttttagctaccaataacataaataataatctacagcaaatagattttggcttggaggaagaacaggattttccttatcaagtatccgtccatttgaattataacaaccaatttgtttgtggagcagtagtaatcgctgaagatcaagtacttactttggcgcattgtctttattacgattggggaggtcttttaccgcctataataatatctgttaatagcggcggaaaaatgttaaatactgaagagtatgaatctttttctgtatctgatataagatttcataaagagttcaacacatctgagatgaaatatgatttagccgtgttagatataccagttaagttgatgtcaaaaaactcacccatcattcccataggattacaaagtgattcgatgccttccaggtacgacaactgtatagctattggatggaataacgtttctgctaatcaggaggtaatagatgtgattttgactgattgtaatattgaaacgtctacaaaaatgtgcgcaaaacataaggcgcaaaatgaaactttatgtaacatggntcctggcagtttgttggtatgcagttctacacttgtaggtattatgtccgtagtccccggatgtgattccaccaaccaaatatctctttttgagagtgctagacatgataaagatttattgatatcgtccgctgcatctgtagcccgtagggtttccatcaatactaatatggatttacagntattcttacaatacttat

SEQ ID NO: 16750 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntggtcgannnnnnnnnnnnnnnnnnnnnnnagtttacacgggtgtgagccaggttgctttctatctttattttatcagtatattttagtacgaaagg

SEQ ID NO: 16751 - DNA, 724 bp, Diabrotica virgifera
  misc_feature (707)..(707): n is a, c, g, or t
cggacgcgtgggcgattctcgatatgattaacggtactcaaatacaaaagtaatcaaagtaacgaatactgtaaatgattactttatacaaaagtaacgatttgtaacgaatactcgaaagtaactataatcaacatcactaatgcatggactagcattatttacctccgtatattgggtatagtctgctgcaattgattgtagagggcaaaataaaagataaaagagatgtaggaagaagatgaacctcctggttacgaaatctaagggaatggtttagtctgagctctaaccaactatttagagctgctgtaaataaaataagaattgccatgttgatatccaacccttgatagaagatggaaccttaagaaggagaagaattaaaaacctgattacataaatcatgtaatcaggaatattttaactgtttctaaattagttgctttaattctcttagatatttttgacatttatctaatagaaatatttctgattttctcgcctagtcctgtaagtctattcgatttttttatctttgtatttgcaatgagttttatatttagtagttttttgaagaaagaagattactggtgctgtaaaaatactcatttgaaaagtgaagttattgtttccaaaaatgaacgttcgatgccaaatctgtttttagattttatgttgtttttatgtatgtagataatttttanatatacgtattctatat

SEQ ID NO: 16752 - DNA, 199 bp, Diabrotica virgifera
  misc_feature (7)..(44): n is a, c, g, or t
  misc_feature (57)..(57): n is a, c, g, or t
  misc_feature (79)..(101): n is a, c, g, or t
  misc_feature (109)..(130): n is a, c, g, or t
  misc_feature (159)..(159): n is a, c, g, or t
  misc_feature (161)..(192): n is a, c, g, or t
taacagnnnnnnnnnnnnnnnnnnnnnnnnnnnnnnnnnnnnnntgcgacctcgatngtggattaagtttataattggnnnnnnnnnnnnnnnnnnnnnnntgttcgannnnnnnnnnnnnnnnnnnnnnagtttaaaccggtgtgagcccaggttggntnnnnnnnnnnnnnnnnnnnnnnnnnnnnnnnngaaagga

SEQ ID NO: 16753 - DNA, 433 bp, Diabrotica virgifera
aaaatgtttaaattggtggtgttgttcggactcgcagccgtcgttgcagctagaccaagcggatgggaaactcccgtagtctcctacagcctaccagcagtagcagtccctgccgccgttagttctacctacaggagagacgtcatcaacaaacctgtcattgcttactctgctcatccagtcgtagctgctccagtagtccataatgtagtatcttcaccagtcttgcctctctcagctgctgctacccacagttttagaagcgatttggtaagcagtccatgggtcgttgcccatgaagctcctgcgcttttagctgaacccgtttggcctgcagctgcatccatccatccctggtaaataaagaactgatgttagtgtaatttaaaaatgtttaacaaaatttatacaaaaaagttaataaagttgtttc

SEQ ID NO: 16754 - DNA, 60 bp, Diabrotica virgifera
  misc_feature (4)..(53): n is a, c, g, or t
taannnnnnnnnnnnnnnnnnnnnnnnnnnnnnnnnnnnnnnnnnnnnnnnnnggtgatt

SEQ ID NO: 16755 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16756 - DNA, 735 bp, Diabrotica virgifera
  misc_feature (226)..(246): n is a, c, g, or t
  misc_feature (325)..(344): n is a, c, g, or t
  misc_feature (409)..(457): n is a, c, g, or t
  misc_feature (595)..(615): n is a, c, g, or t
tttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattaaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 16757 - DNA, 810 bp, Diabrotica virgifera
cgttaaacaatttcgaaaaaaaaatggtgactgaagatgataattttatcatttatggtccacgaccgagtgaacccttacctaaggactgtttaggcaaatttgtgttaaataatttaataaacaatcctacaaatgaggttatgctaaacgtacaatccggacaatgcatttcatattcacagattcttcaagaaacttgtaatttggctgaatctctgcgaaaatatggctgcacgcaagacacgatcataggactgtgcagtgagaaccacctcaagttttttgtaccattgttagcagcaacttgcttgggatctgtcatagtacctattaatcctgcttatgttcacgatgaactcagacacgttttgaatctgacacagccacgaattttattttgttcaaaattaacgctttcgaaatttagtaaagacgaatatacttttatagaaaaaataatctgcatagattcagatgtgcccaatgttgaaaccgctgaagaatttgttagtaaacaacttaatagaaagtcggttgatcctaaaagattcgaaatgtttagtggaaacccagaaactcatttaacggccattatgacctcgtccgggactacaggattgcccaaaggagttatgttgacggatcacaattttgaagctagaattttacagtttcgagactccgtctacaaaggagcatatgcaatagtggacgggaaatttacgacgacatccaaaggaacttttggaataatgccattttatcatggagctggcatagttttggctctggcttgtatagctcaac

SEQ ID NO: 16758 - DNA, 963 bp, Diabrotica virgifera
  misc_feature (62)..(945): n is a, c, g, or t
gacagacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctttcgacaagatga

SEQ ID NO: 16759 - DNA, 53 bp, Diabrotica virgifera
tatacttcagtcttatatcagactcaaatgttacaaatagttctttggataac

SEQ ID NO: 16760 - DNA, 836 bp, Diabrotica virgifera
gactatcaaacaactgagcacggaaatagcagagttgcagacagaggtagatggtttaaagcagacggaattccagacgtcggaagataacattaggttgacggaggacttggaatccgagcgacagaaaaacatcaaattggaattagaactttttgagttaaaaaaggaacacgaacaaaccttacgggttatggagatgatgaaaaaagaaatgaaggaattgcaaatgctagaagaagaacataggacaaatctcacaaatttaaaaaaagaatctgatgcccacaagagagagaagaacgtgctaaaacatcaaagtacgttgattttacaaggactgaatgaatcagaaggttcggataattatttattgttgctacaagagatagaagacttaaaaaggactctagaggacgagaggaacaaacacgacgaagaagttaccattctacaggaacgtctagaagaccaagacaacaacgctcagatagaagtcttggaagaacgattgaagctcgtggaatccgagcttcaaaccgcaacggaacgtgctgaaagagctgaagaaaagctgaaagctcctcccgctccaccaccgcctccaccacccccactacctccgatgttaccgcccctttcacttcctgcttcagatccaccagcggtacctttgaggagaagaagaagtaaagtggcactttcagatcttgctgaaagcataggagtacaggaaaataccccatcagacaagaagccagctgcagctcctggtgtcaacgaggacatcattaacgccataaaagcgggccagttcacgttgagggaaggccaaa

SEQ ID NO: 16761 - DNA, 206 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (165)..(165): n is a, c, g, or t
  misc_feature (173)..(173): n is a, c, g, or t
  misc_feature (177)..(177): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaacggtgtgagccagcgtggtttctatncttaattnattnatatattttagtacgaaaggaccaatata

SEQ ID NO: 16762 - DNA, 752 bp, Diabrotica virgifera
gttgtttaatattcagcgatcctaagaaagaattcaactccgataagtattctttagggtgtgcctgataatgtccaacgtgtggtgtattctcccaagttttaaaagtaacctgcatccccatattttcccagttatctgtaactcttctattcgaggtttcactgccaatgggatctgatttgctgacgaacaccagagcaggtgctctcactatgttggtgtggaacatctggcttgagcgtacataatgaacagttacagttttatcaaacgtttttaaatgatataatatgtactgcttgagcgtgttttgtaatacggaattattaggaaagactgctttgggaaatcccactggtatttctgtgacatcggctgcactgtcccagacctgtcctacgattctgtttatgatgtggtcgtatttttgcctttcggcagacataagtaccaaagcttcaccccagaggtacgctgcaactgaaaagccatgtagtaacagggggctataacttgcatttacgtctagaaatttgacaatgtctttggccaccatctgtgttcctttggtgggccagaggaattgccatggctttaacatttactagatcctttgttggaaaaggactgaagtgtttgtccaagttacaggagacctcttcaaagaacaaattgacatcagttttaatattttctgcccaaatgaggtttatatcaacgattgaatgtatcaaaaatatatctctcat

SEQ ID NO: 16763 - DNA, 200 bp, Diabrotica virgifera
  misc_feature (7)..(30): n is a, c, g, or t
  misc_feature (40)..(40): n is a, c, g, or t
  misc_feature (66)..(66): n is a, c, g, or t
  misc_feature (80)..(102): n is a, c, g, or t
  misc_feature (104)..(104): n is a, c, g, or t
  misc_feature (116)..(117): n is a, c, g, or t
  misc_feature (173)..(192): n is a, c, g, or t
taacagnnnnnnnnnnnnnnnnnnnnnnnntcgataatanagattgcgacctcgatgttggattanagtttataattggnnnnnnnnnnnnnnnnnnnnnnntngtcgacttttannattttacatgatctgagttaaaccggtgtgagccagggtgggttctatctttaaannnnnnnnnnnnnnnnnnnngaaaagaa

SEQ ID NO: 16764 - DNA, 128 bp, Diabrotica virgifera
  misc_feature (91)..(122): n is a, c, g, or t
taattggtgtagcagctataaactttaatccaacatcgaggtaaaattttacatgatctgagtttaaaccggagtagagccaggttggttnnnnnnnnnnnnnnnnnnnnnnnnnnnnnnnngaaagg

SEQ ID NO: 16765 - DNA, 850 bp, Diabrotica virgifera
  misc_feature (541)..(570): n is a, c, g, or t
  misc_feature (691)..(708): n is a, c, g, or t
gtagttggtactgtgcagcatctcacacagtacaatgaagttttttaaggtcttaacggtgttgtttttagttgcgggtatcgggactgtgtgtaccgcaaaagttccatccgtattcggtgtgtttttttcgaataccaacacgaaaaatgaaatacaggataatagtgtgccggaaaaagatgccaaatcggattactcagtgattgaagatgaatttaccaagttgcgtattgaatacatcaagaatcagatactcaagaagcttcgtcttaaggagaaacctactatcactatatctgaactacctaaacctgtgaaagagtacgaaaaccttctacccagccaagacatgaatctgcaaagtagctactctgatgatttttacgggaaaaccacacaagccatcatattcccctatgaagataaggcgcgttgttccaacacgatccgttttccttctgcctgtcttccgttccaaatgccgaatgatattcatacatctgaagtcgccagtgcagagttgtggttccataaggannnnnnnnnnnnnnnnnnnnnnnnnnnnnnttttgtcatatatgaagtagctcactgggatactaaaaagagcttccagaagaccacccctatcgctatccaagagactagtcttactgaaggatggttaaaaattgacgtgacctatgtnnnnnnnnnnnnnnnnnnttttctggagtctcccgtgcatgctattaatgtggtctgcaaaacatgcgatatggagaaaaaccaatcaccaatatcgtttactagtgagctgaaaccctttttggtgatatacactcactcccaacaaagaagggcgatg

SEQ ID NO: 16766 - DNA, 779 bp, Diabrotica virgifera
  misc_feature (9)..(26): n is a, c, g, or t
  misc_feature (42)..(96): n is a, c, g, or t
  misc_feature (98)..(125): n is a, c, g, or t
  misc_feature (127)..(196): n is a, c, g, or t
  misc_feature (198)..(211): n is a, c, g, or t
  misc_feature (213)..(238): n is a, c, g, or t
  misc_feature (244)..(256): n is a, c, g, or t
  misc_feature (258)..(279): n is a, c, g, or t
  misc_feature (283)..(301): n is a, c, g, or t
  misc_feature (324)..(341): n is a, c, g, or t
  misc_feature (371)..(397): n is a, c, g, or t
  misc_feature (410)..(429): n is a, c, g, or t
  misc_feature (432)..(462): n is a, c, g, or t
  misc_feature (471)..(491): n is a, c, g, or t
  misc_feature (505)..(544): n is a, c, g, or t
  misc_feature (571)..(607): n is a, c, g, or t
  misc_feature (646)..(664): n is a, c, g, or t
  misc_feature (666)..(703): n is a, c, g, or t
attttaacnnnnnnnnnnnnnnnnnnctacaagtaaacaccnnnnnnnnnnnnnnnnnnnnnnnnnnnnnnnnnnnnnnnnnnnnnnnnnnnnnnncnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnncctgcnnnnnnnnnnnnncnnnnnnnnnnnnnnnnnnnnnntaannnnnnnnnnnnnnnnnnncatatattcatacttaaatatcnnnnnnnnnnnnnnnnnncatattcttacggatgagcttaaacatacnnnnnnnnnnnnnnnnnnnnnnnnnnnaccaattaagacnnnnnnnnnnnnnnnnnnnnccnnnnnnnnnnnnnnnnnnnnnnnnnnnnnnnctttattcnnnnnnnnnnnnnnnnnnnnntatacattcacacnnnnnnnnnnnnnnnnnnnnnnnnnnnnnnnnnnnnnnnntcgtatatctactacaactatataccnnnnnnnnnnnnnnnnnnnnnnnnnnnnnnnnnnnnncctattacaaacatgtctttttgcattcaatataaagcnnnnnnnnnnnnnnnnnnncnnnnnnnnnnnnnnnnnnnnnnnnnnnnnnnnnnnnnnctactcattagtttctttattgaccgctggaatgaatggttggatgcttcaaaaactgtctttacataatttataa

SEQ ID NO: 16767 - DNA, 172 bp, Diabrotica virgifera
  misc_feature (3)..(73): n is a, c, g, or t
  misc_feature (82)..(101): n is a, c, g, or t
  misc_feature (111)..(111): n is a, c, g, or t
  misc_feature (117)..(158): n is a, c, g, or t
gcnnnnnnnnnnnnnnnnnnnnnnnnnnnnnnnnnnnnnnnnnnnnnnnnnnnnnnnnnnnnnnnnnnnnnnnaattatttnnnnnnnnnnnnnnnnnnnnggggtgatanaaaatnnnnnnnnnnnnnnnnnnnnnnnnnnnnnnnnnnnnnnnnnntcccatttttttga

SEQ ID NO: 16768 - DNA, 525 bp, Diabrotica virgifera
  misc_feature (4)..(46): n is a, c, g, or t
  misc_feature (52)..(74): n is a, c, g, or t
  misc_feature (265)..(338): n is a, c, g, or t
  misc_feature (343)..(408): n is a, c, g, or t
  misc_feature (426)..(444): n is a, c, g, or t
  misc_feature (453)..(467): n is a, c, g, or t
  misc_feature (469)..(485): n is a, c, g, or t
  misc_feature (488)..(507): n is a, c, g, or t
ttgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcttcc

SEQ ID NO: 16769 - DNA, 243 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (241)..(242): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattanna

SEQ ID NO: 16770 - DNA, 874 bp, Diabrotica virgifera
  misc_feature (310)..(333): n is a, c, g, or t
  misc_feature (807)..(807): n is a, c, g, or t
  misc_feature (841)..(842): n is a, c, g, or t
  misc_feature (851)..(851): n is a, c, g, or t
ctattcacagatagtcaatccttccgttcgcaaaatagcccaataggctacgatatcgagtgtttttttcaaaatctgatgaatatttgaaaaatcgtaatcgacttacaaaattatctaagtattataaaaacatcaatttagaaatacaatatatcccgatgataagatataagacacttagagctaaaatcaatcatttaattttaaacctcacttatgtgtaatttaattttaaacctcacatcaattgtgtaaagatgagtgtgaaaaatatagaaacacttctagaactacacattggtgaggnnnnnnnnnnnnnnnnnnnnnnnncaaccaacttagtcaatcctggagaaaactatggaggagaattatttaaaatagatgttacgttagaagattccgatacccagaaagaagaagttttacatattgtaggcaaaatcattccagcagacgataattcacaagaaatatttaacgttcaaaatacctttaaatcagaaataggattctatgaaaaaattgtaccggcacttcaaaacttccaaagaaagcataaaatcgaagaaatacttgatatttttcccaaattttatgggagccgaattaacttagatggaagtgagaaagttgatagagacggtgtattattgctagagaatttaaaaatagaaggatatgacaatttagatcggtatattggatataacttggaagatgccaaaatccttcttcgagatcttgctgtattcccaatcacagtcgttgcattaaaaattaagcagcccgatgtattcaacnaagaaattaaaccttttttgtaaacataatttgnncactcctgnagatgatccattagaaatatgat

SEQ ID NO: 16771 - DNA, 192 bp, Diabrotica virgifera
  misc_feature (6)..(47): n is a, c, g, or t
  misc_feature (67)..(100): n is a, c, g, or t
  misc_feature (102)..(102): n is a, c, g, or t
  misc_feature (117)..(163): n is a, c, g, or t
gagggnnnnnnnnnnnnnnnnnnnnnnnnnnnnnnnnnnnnnnnnnnatcttttagtaaaaagctcnnnnnnnnnnnnnnnnnnnnnnnnnnnnnnnnnntntataaaattatcacnnnnnnnnnnnnnnnnnnnnnnnnnnnnnnnnnnnnnnnnnnnnnnnctcgcggtggattaacaaaataactttaa

SEQ ID NO: 16772 - DNA, 62 bp, Diabrotica virgifera
  misc_feature (3)..(27): n is a, c, g, or t
  misc_feature (39)..(61): n is a, c, g, or t
aannnnnnnnnnnnnnnnnnnnnnnnnaattatttatannnnnnnnnnnnnnnnnnnnnnng

SEQ ID NO: 16773 - DNA, 63 bp, Diabrotica virgifera
  misc_feature (6)..(62): n is a, c, g, or t
aaagcnnnnnnnnnnnnnnnnnnnnnnnnnnnnnnnnnnnnnnnnnnnnnnnnnnnnnnnnng

SEQ ID NO: 16774 - DNA, 664 bp, Diabrotica virgifera
tgaattcgtggtggagcatatcagcgttagaagattcccgcctactattcaaagtaagttaagtgataagaatattgtgaggagaacattttcttgcttttactgtttgaataggcatcccctccctgttgactgagaaccatccaaattatgaatccatctataatttctcataaaattacaaattgaaaaatgtctaaaattgtgacttgatatggaacattataaaaagtatgtcctcaccgagcagggacgcgctgcactgtttgatacggcagtagacctcgaaaaaagttatgtatggtcaaaaatgagatgtgtaccagccattacttgtccattgtaaaaactatagagggcagggtcgaacatagagtgctgatagcgagcaaaatcagttacgaaaatggagcttaaatttctgctgatggtggagacgtctactgtcgacttggatatctaaattctagaatttctagtctccctcgattacgaatatgaagcagacgtccaacatttgtattactttagctcagaaactgctgacattgaatagagtcaaaaagattaactaagcgaagtatagcctgtcaagaacactgtaactacccctgggatagcagcattcgatagtgagatggagccgaccccacccgtgtcaact

SEQ ID NO: 16775 - DNA, 218 bp, Diabrotica virgifera; identical to SEQ ID NO: 7300
  misc_feature (6)..(28): n is a, c, g, or t

SEQ ID NO: 16776 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16777 - DNA, 786 bp, Diabrotica virgifera
  misc_feature (5)..(520): n is a, c, g, or t
  misc_feature (527)..(564): n is a, c, g, or t
  misc_feature (584)..(597): n is a, c, g, or t
  misc_feature (600)..(622): n is a, c, g, or t
  misc_feature (630)..(652): n is a, c, g, or t
  misc_feature (682)..(710): n is a, c, g, or t
  misc_feature (721)..(751): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnggacgaaaggnnnnnnnnnnnnnnnnnnnnnnnnnnnnnnnggttaattagtgaaaataattaaaaaggggtgatg

SEQ ID NO: 16778 - DNA, 870 bp, Diabrotica virgifera
  misc_feature (478)..(496): n is a, c, g, or t
  misc_feature (735)..(752): n is a, c, g, or t
  misc_feature (840)..(840): n is a, c, g, or t
ggtttcagcatgaaaatgagaaaacatttaaaaaataaacgcttggagtctctgacgcaactgggaacagataggattgtagacttgcaatttggaactggagaagctgcctaccacgtcattttggaattatacgataggggtaatattttactgacagattatgaacacacaattttgtatgtccttagacctcatgttgaaggggataaattaaaatttgctgtaaaagaaaaatatccacaaggcagggctagagaaggtggcgtaatttctaaagagcaacttttagaagttttaaccaaggcgaaagctggagaccaactaaagaaagttcttgtttccaatttggaatatggtcctgctttgttggaacatgtcctagttcagcacaattttccaaattctaccaaaattggaaagaatttcgatcctgttgataatcttgataaagtttttcaagcgattttagacgccnnnnnnnnnnnnnnnnnnnccaaagctggtcagacaaagggttatattcttcagaaaaaaattgagcgagctaaatcagacacaactccaaatggcgaattttatgaaaaccaagaatttcatccgatgctctttgaacagcacaaagaaatgccttttaaagaattcccaacttttaacgaagcgatagatgaattcttctcttcgctggaaagtcaaaaaatagagcttaaagctgttcagcaggaaagggaggcnnnnnnnnnnnnnnnnnntgtaaggaaagatcacgatcaaagggttggtggctttggaacaaactcaagctgtcgataaacaaaaagctgaattgattacgagatncagaattggtagataaatccattgtagcta

SEQ ID NO: 16779 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16780 - DNA, 180 bp, Diabrotica virgifera
  misc_feature (2)..(18): n is a, c, g, or t
  misc_feature (52)..(74): n is a, c, g, or t
  misc_feature (93)..(125): n is a, c, g, or t
cnnnnnnnnnnnnnnnnngatagaaaccaacctggctcacaccggttgctannnnnnnnnnnnnnnnnnnnnnnccgtagtgcgacaggacgnnnnnnnnnnnnnnnnnnnnnnnnnnnnnnnnngatgtgagcaaaggaagaaagggatctccgatctataggataccaggatcacacg

SEQ ID NO: 16781 - DNA, 783 bp, Diabrotica virgifera
  misc_feature (204)..(216): n is a, c, g, or t
  misc_feature (218)..(230): n is a, c, g, or t
  misc_feature (505)..(524): n is a, c, g, or t
cattggatgtactttatttcacatcagaattaatacataaaataggctttggtatttaaactatgtttattgaataaagtatagtttgcatttttatctagtttatcacattacctgggggcatcaaacagtcatatacattgtaaaatattgtatatcaacaatatagtaacatgtattatttcttattgtaaagctacgaannnnnnnnnnnnngnnnnnnnnnnnnngaaaacctaatactcaaatattttaaatactcttcaaacctaccttggtaaattatttaatttgggttttttaagttaatgattgtatgagcttggaatattattgtttttagaatggttttttagatggattcataataaaaactaaatatttattggtaataagaaccttataaataaagaactagtgatgataaaatgatacaaaatataagaatataaccgttgtataacattgaacaatgaaacaatgtgtgaaattagtgatcacatgnnnnnnnnnnnnnnnnnnnncctacatcaatgcattaaattttattgtacatacagtctaattttgttttaaccactaatcctataaaataatttacaaataacttccgcctgtctgtccgtgaaaaaactagttcagttttttatagatttgctaacgggtggtgccagtgttacatacagggtaattgattactggggcaaagctcaatagatccgctatagtaatagatagcaataaaagttaataacaaaaattgtagccaactttaagcttcca

SEQ ID NO: 16782 - DNA, 941 bp, Diabrotica virgifera
  misc_feature (320)..(339): n is a, c, g, or t
acattgaaaaatggaccgtaagagaatgaaaatgacaataagcgaccaagaacatgaaaaaattatccgaaatatagaagaagggatatcagactcccatttcgactatgagattaccgacgaatcagatagcgaagagcaagatgtttttgaggaaaatgtttcggaaactgaggacaatttagaagtcaacagtgacgaggaatcagatgcagaacctaccgaagtggacgataatattagtgaggttagtggtccaacatatacatccaaatctggaatgcagtggaatagcctacctttcgtgagatccaagaggnnnnnnnnnnnnnnnnnnnntgtacatccaggcttaacaaactatagtaaaaattccaacacgtttttagactatttcaatttatttttgaccgaagagatgaagaatgtcatatgccttcatactaatgaagaagctgttaggcgttatcaagagtggaacgaaaaacatccgaataacaaaaaagagtggacggtacttaccaacaatgaactggatagctttttaggagcacttatcaaagctggtgctttaaggtgtgggaaagaatcgacacgagagatatggtctacagacacctcaatacgccggtcattttttacagccgcattagctaggaaccgatttgaagaattatcgagtttcttgaggtttgatgacaaagtgaccagggtggagcggaaggaacaggataagttagcggcgatacgagtaatttgtgacatgttcgtctctaactgtgacaaagcctttgaaccatacgaacatataacccgtgacgaacagttagtgagttttagaaggaaagtgtccttttagacaatatataaaatcaaaaccttgccgctatgggataaaaatttgggctgccgcggatgtaaaacatcttatttatcaaaac

SEQ ID NO: 16783 - DNA, 939 bp, Diabrotica virgifera
  misc_feature (474)..(603): n is a, c, g, or t
  misc_feature (780)..(780): n is a, c, g, or t
  misc_feature (827)..(847): n is a, c, g, or t
cggtcggtgaaagagcgcgccaaagcgtgtcctgaatatcatgcggcgatcgtctgcaacgctgtgaagcgaaagtggtcattcaaagtttaagtactctacaatcaaagacagcatgttaagctacctcataattattgcaatagtgtcaaatgctcaagttttcggatctaatagtacttttaacaatgttactgcgcttacggccggcaatgacttgtggttcggattggtacgggactgtcaagaaccgacggtatcttgtattaagaacagtatttataattttcttaaaaataccttcgactacgaccgtgacttgaattttactagttttatgaaattttcgaaaaacaacatcatatacaagacccccattaaccaatctataacaacgggtatcgaaaacaacttcctaattggagacgaatcaccttttgaagaaatatctagatcattaaaagatcattccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatctgaagagatcaataggagaaggacgaatattgggaaatctcattggaaaaatcatcagtaagtattttgtttttaaagcatgatatttgcgcgccatatttggtgggggtaaacgtttgtttatagtcttctcgatagagggcaatatagaaagtagtttaaaataaattgngttgtctgatgacatcttgtcttgttttaaaacaacttttatgtccnnnnnnnnnnnnnnnnnnnnnaaagtaatccagttttacacttttcagcgatgtattgccttttactgcttgtttttagagataagctattattatcagatacaataaaactg

SEQ ID NO: 16784 - DNA, 1018 bp, Diabrotica virgifera
  misc_feature (113)..(129): n is a, c, g, or t
  misc_feature (389)..(403): n is a, c, g, or t
  misc_feature (731)..(731): n is a, c, g, or t
  misc_feature (777)..(777): n is a, c, g, or t
  misc_feature (833)..(833): n is a, c, g, or t
  misc_feature (919)..(920): n is a, c, g, or t
aataaataatcaatatttttatatttacagacaagttttattgtaccaataggaacgaccttaaaaccaccatatgtttcaagtatgactttagtttcttttaaatcattaannnnnnnnnnnnnnnnnacaaaaccattaggcaaaatgttaacctgtgcccctgtatctattttaaaaggtatatcaacattactaatttttaaattttcgatccagtctttattatttttattcttgatttcattaacagtgattgatgatatcataaaatcacctacctcgttattttcactttcttccacttgtacttctctcactaacctgctatgataacacactttatcgaaatggttatttttaccgcactttctgcacttttttccatnnnnnnnnnnnnnnnttggcccatggactctcccacagtttctgcagctatattcatctctagaatttgcactcctgaatgtttggactgaattttgcccctgcttggctttactcccaattgattcaattttaaccttctccaagctgttctgaacttcttttatttgagcttgggatatttcatgcattttacatatttcaatagctttagccagatctaaattaatggtctttaacatgttttgttgtgcatccttactattagtgcctaatactattctatctcttaccattgaagatgcttctgctccaaactcacaattttttactttgttttttanatctgttaaaaagtggtcaaacggctctctttcttcttgaatgcgngttgtaaacacatatctttcatagaccacgttttttctaggcgtgacataagactncaatgcttccaatacatctgctagcttgcctttttgggcctcccgtaattccaaagtgttatagatttcaatgccttcttctccannttagatgagtaaattgctaccttaacgtcatcacttttaccactttttcccagaggcatcagatatatttcaaaactttgtctgaatcttttaaattt

SEQ ID NO: 16785 - DNA, 238 bp, Diabrotica virgifera
  misc_feature (2)..(135): n is a, c, g, or t
  misc_feature (138)..(173): n is a, c, g, or t
  misc_feature (181)..(194): n is a, c, g, or t
  misc_feature (196)..(228): n is a, c, g, or t
  misc_feature (235)..(235): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnnnnnnnnnnnnnnnnnnnngtttatannnnnnnnnnnnnngnnnnnnnnnnnnnnnnnnnnnnnnnnnnnnnnntttattnatt

SEQ ID NO: 16786 - DNA, 903 bp, Diabrotica virgifera
  misc_feature (721)..(762): n is a, c, g, or t
  misc_feature (767)..(767): n is a, c, g, or t
  misc_feature (831)..(831): n is a, c, g, or t
  misc_feature (872)..(873): n is a, c, g, or t
atagaaattataaatgaaaattgttgagataaattaaagaatttttgtatgaaaatgatttttctgaattaaaataaaatggcaaatttaaaacctggcagtcaaaatactcgtaagaaagtccaggtgtcaatggtaatatgcgaagcagaagaaaaaaggcatagatctggagtaaatgctctacaattagatcccgcattagatagattgtattcagctggtagagattcaattattagagtatatgagcatgaaaggtttctccatggaatggaacaccataccgactgggtcaatgatatcgtattatgctgtggtggaaaacatttgatatccgcaagctcagatactactgtaaaagtatggaatgctcacaaaggattttgtatgtcaactcttagaactcacaaagattatgtgaaggcgttagcgtatgccaaagatagagagcaagtggcttccgctggattagacaaatctatttatttatgggatattaatactttgacagctctcacagctagcaacaatactgtgacaacttcaagtttagtaggcagcaaagaatccatttacagtttagctatgaatccatcgggtagtataatagtcagtggatccacagaaaaagctctgaggctttgggatcctagaacatgtgccaaactgcttaaattaaaaggtcatgcggacaatgtgaaagcactggtcgtttcannnnnnnnnnnnnnnnnnnnnnnnnnnnnnnnnnnnnnnnnnattanattatggaatctaggatcgcaaaggtgtgttcaaactattttagttcatactgattcagtgtgngctttactagctacagaaagctttagccatgtaatctctgnnggaagagatgaaaaggtgataatgacagat

SEQ ID NO: 16787 - DNA, 461 bp, Diabrotica virgifera
  misc_feature (16)..(37): n is a, c, g, or t
  misc_feature (41)..(61): n is a, c, g, or t
  misc_feature (69)..(69): n is a, c, g, or t
  misc_feature (71)..(71): n is a, c, g, or t
  misc_feature (93)..(93): n is a, c, g, or t
  misc_feature (135)..(135): n is a, c, g, or t
  misc_feature (158)..(158): n is a, c, g, or t
  misc_feature (160)..(161): n is a, c, g, or t
  misc_feature (168)..(168): n is a, c, g, or t
  misc_feature (179)..(179): n is a, c, g, or t
  misc_feature (200)..(233): n is a, c, g, or t
  misc_feature (241)..(242): n is a, c, g, or t
  misc_feature (254)..(254): n is a, c, g, or t
  misc_feature (270)..(270): n is a, c, g, or t
  misc_feature (275)..(275): n is a, c, g, or t
  misc_feature (289)..(289): n is a, c, g, or t
  misc_feature (292)..(292): n is a, c, g, or t
  misc_feature (299)..(299): n is a, c, g, or t
  misc_feature (304)..(304): n is a, c, g, or t
  misc_feature (310)..(311): n is a, c, g, or t
  misc_feature (341)..(341): n is a, c, g, or t
  misc_feature (353)..(353): n is a, c, g, or t
  misc_feature (365)..(365): n is a, c, g, or t
  misc_feature (375)..(375): n is a, c, g, or t
  misc_feature (380)..(380): n is a, c, g, or t
  misc_feature (388)..(388): n is a, c, g, or t
  misc_feature (392)..(392): n is a, c, g, or t
  misc_feature (396)..(396): n is a, c, g, or t
  misc_feature (404)..(404): n is a, c, g, or t
  misc_feature (412)..(414): n is a, c, g, or t
  misc_feature (418)..(419): n is a, c, g, or t
  misc_feature (423)..(423): n is a, c, g, or t
  misc_feature (425)..(427): n is a, c, g, or t
  misc_feature (430)..(432): n is a, c, g, or t
  misc_feature (435)..(435): n is a, c, g, or t
  misc_feature (441)..(441): n is a, c, g, or t
  misc_feature (443)..(443): n is a, c, g, or t
  misc_feature (446)..(447): n is a, c, g, or t
  misc_feature (455)..(455): n is a, c, g, or t
ctcccttaagggtccnnnnnnnnnnnnnnnnnnnnnnccgnnnnnnnnnnnnnnnnnnnnngtgtagtntnaagaaaagattttatataatanagtttatttggaagtgatttatttgaattaagagttgtatangagatgattaatgtataatgttnanngtattgnagttaataaanaaaaataattattttagttannnnnnnnnnnnnnnnnnnnnnnnnnnnnnnnnnagaggatnnaagtttaggtangggtggatgtgaggtnatagnttttttatagtgtnaantaaattnaattnattggnngttgttttataaagttgtgattgggaaaantttggtgttaantaatttaattgntttggagaanatttnatttttgnaagntggngtaatagngaagaggnnngaanngatngnnnttnnnaanagttgngnagnntgaatggngaatgg

SEQ ID NO: 16788 - DNA, 115 bp, Diabrotica virgifera
  misc_feature (8)..(61): n is a, c, g, or t
  misc_feature (65)..(111): n is a, c, g, or t
gtttatannnnnnnnnnnnnnnnnnnnnnnnnnnnnnnnnnnnnnnnnnnnnnnnnnnnnnattnnnnnnnnnnnnnnnnnnnnnnnnnnnnnnnnnnnnnnnnnnnnnnnaata

SEQ ID NO: 16789 - DNA, 97 bp, Diabrotica virgifera
  misc_feature (16)..(35): n is a, c, g, or t
gtttactgatttgagnnnnnnnnnnnnnnnnnnnngacattctcgaacatgcaattctgtgatgaatcttatactgaaataaaattactttttagcc

SEQ ID NO: 16790 - DNA, 958 bp, Diabrotica virgifera
  misc_feature (137)..(151): n is a, c, g, or t
  misc_feature (882)..(882): n is a, c, g, or t
  misc_feature (902)..(902): n is a, c, g, or t
  misc_feature (909)..(909): n is a, c, g, or t
tagtcagtttgtcttgtacatagtcaatatagacgagttttgtttgacggttgtattacgtttaaacgacttggtcaatttttctggtaaaactaacaacgtttcttaatgacttagttaactcaaaactgacaaannnnnnnnnnnnnnntttttgcagtataccgacgatatgtatagccaaacttcgaagctccttcgctcgtaggtttgactagtcaacctcaagtcttagtcaaattttcgtcaaacctaggtgaggttaatttggtcacggaaacgtcgaaacttaatttcatgaactcggggtttgaccagttaaaccccgaggatcaatggaagttttttaaggttctagcaaagcaagagcaaggcacgtacacggtgtagtgaactgtatagtaaaacaattgatgtaatgtgcacaaagttataaaagaaacattattcaaatgaatagttaactaaattcaaaatttcagcacttaataagaaagttgccacgtactagtatcatgagtatcattttgcttctcaccagacgaatttatagcgttttatgactcttcctccgtctgcagaacctttttttcgggcaaagcccgaaacatattatttttcttcagacgtttgactttagaagttagaaacttctacactacgcttcgcggtcactttgcagtacagactattatgaagaatagtgttggctattctacgcctctacagtactttacctacatttagcttatcagcagatttcgaacatttttcacaacaatgaacatttttcagaacaatgctaacaaccatattgtcatcgagagagctcagttgtcacaattatctcaatttaatacaatgtttgtatttatgtatctnaatatatacaatttactttnactatgntcagctgaacgatttacgtactgtacatattatgtatgtatgtatgtat

SEQ ID NO: 16791 - DNA, 674 bp, Diabrotica virgifera
  misc_feature (353)..(489): n is a, c, g, or t
agctaaagtacatgctgactgtcaagctgttcctaaaacccatgaagatgaagataagttgagaaaccttcagaataacattgatgaccatcaagtaggtgttcacatgttctgcatggctgtaaaagctggtttattgaagagcaacggagaccttgatattcctgctattaccagcaaagtttccttggtggttaaagatcattctaaggttgatggactcgtccaaaaatgcgccaaaaaatcagacaactctggaaaaaccgccaacttgttgttcctgtgcttcgttcaaaacgatattcaatattaccataaattgtaaatttgatgttatactaaattaaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaaagaacccaattttacgaaccggggtttggaacgtaaaattttttttaaagggcccccaaatttaatttcctgggccgcctttttacaacgccgggacgggaaaaacctgggggttccccattttattccctttgaagaatttccccttttccccagtgggggaaatagcaaaaagccc

SEQ ID NO: 16792 - DNA, 915 bp, Diabrotica virgifera
  misc_feature (312)..(337): n is a, c, g, or t
  misc_feature (748)..(773): n is a, c, g, or t
  misc_feature (825)..(825): n is a, c, g, or t
  misc_feature (845)..(846): n is a, c, g, or t
gttcttcatcacatgaataacaacctacgcgtcgacctattaaagaaaacccaataaattcgtaaaatttgttttaagcaactcgccatcggaagttcattaaagggacacatcgatagttcacacaggagaagagccttatacgtgtgaaatatcgttttaagcggttttctctaaaaaataatttgaaatcacattttaaattcgcacacggcagagcagcgttacaagtgtgaaatatcgtcttaagaagtttacttcgtaaaagtatcgttggatcgacatacgacagtacacactcggagaaaaatnnnnnnnnnnnnnnnnnnnnnnnnnncagttcacaaaaacatcgcaatttgaatcaacatttgaagatacacactgggagaaaaaccattcaagtgcgaaatttgtttaaagcagttttctcaaaaagttagtttagatacacacacgaatggttcacactgggcaaaaaaccttttaaatgcgaaacttcgttcaaagcagtttactaaattctagtggtttaaaaacacatttgagggtgcacactgggggaaaaaccatacaagtgcgaaatttgttttaatcagttttctcagaaagctcatttggaaagacatttaagaattcacactgaataaatgggtgaactcatctgcaattgtgacatttctttcaaattactttctcaactgggtcattcaaatcacttcatgaataaataatagggatataaacnnnnnnnnnnnnnnnnnnnnnnnnnncatatgcctacatcacaacagaagtgtttacttcactccacgttgtaaatangggattgactttattcttannaagtgtatttgttcgtaatggaagaatatgattcagttttaggctcaatttttagaaattctgaagctt

SEQ ID NO: 16793 - DNA, 926 bp, Diabrotica virgifera
  misc_feature (332)..(353): n is a, c, g, or t
  misc_feature (440)..(487): n is a, c, g, or t
  misc_feature (561)..(898): n is a, c, g, or t
  misc_feature (919)..(919): n is a, c, g, or t
cggacgcgcgggtttttcttctctcaaaaataaaatctcttttacgtaaaagtaatagaaaaaatctctctcatcacacggatagttcaatctcagtaatcgcgagagaaatatcctccactccctaaaagaaaaatctctaaccctccgtacctcgcgtatccagggatctcacacaatctaatcaatctaatcatcatcttcacaaccctcgaatctctcaaaagagctcaaaaaatctcaaaatttctcttcggtaaaataaatatctttaaatcaattcttttcgtaacgaaacgttactcgtttctaaataatcatctcaatttctnnnnnnnnnnnnnnnnnnnnnncttatctcaacaatatatcttatcaattaaataatcttttcatcatctaatctaaataattaaataatcttttagggatcgagctcnnnnnnnnnnnnnnnnnnnnnnnnnnnnnnnnnnnnnnnnnnnnnnnngattcaaaatattcttcataattttcaaaatatcggttattaatcttaatcttttaatcatcattaatctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagcttaatttttttanagacgag

SEQ ID NO: 16794 - DNA, 109 bp, Diabrotica virgifera
ataagcgatgttaaaggagcatattatgactcctactgagtgataggtcttcggaatgtaacatagggtttcctcaggttgtaaaatccccattgcacacgctatcaat

SEQ ID NO: 16795 - DNA, 775 bp, Diabrotica virgifera
  misc_feature (2)..(45): n is a, c, g, or t
  misc_feature (47)..(60): n is a, c, g, or t
  misc_feature (62)..(89): n is a, c, g, or t
  misc_feature (97)..(207): n is a, c, g, or t
  misc_feature (221)..(773): n is a, c, g, or t
cnnnnnnnnnnnnnnnnnnnnnnnnnnnnnnnnnnnnnnnnnnnncnnnnnnnnnnnnnncnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngt

SEQ ID NO: 16796 - DNA, 450 bp, Diabrotica virgifera
ccctcctttttggcgtccgcgtttatatcagtcatgtgagacgatttgctttttaacgacgagcggatttagtagtagtgacaatgcgatctggatagacaatagatgatttctttatttatgcatagaaaataagaagcttttctcaccaccatgaggcgcaaagggtgatcagagccatttgttgtcttagaagaattagacatcccatccacggacccacggaacaaagatataaatgaagctaaacaagttatatctacaccgaaaagcgaaccaagattgactgacataatgtcgaaaactctgcgaaacaaatccctaaagaagatagtgggatgatttagaacctagtagcatataactcgtaacagaatgatatcttacaaccaatagaaaaacaattcttgacgatgaccttgctgtgtacaagctccataaaacctcggg

SEQ ID NO: 16797 - DNA, 951 bp, Diabrotica virgifera
  misc_feature (717)..(717): n is a, c, g, or t
  misc_feature (807)..(807): n is a, c, g, or t
  misc_feature (823)..(823): n is a, c, g, or t
  misc_feature (859)..(859): n is a, c, g, or t
  misc_feature (890)..(890): n is a, c, g, or t
cacaagccctctctaggagtccgtgtacggagaagagcagccacagacaagcaagggtggaggccaaggctcaattcgggctcgtagtgccgtagaagtacaattcgaccgacgatagctcgacgggtgacttttagcgaaaatacacaatacaaggtcagccgccaggtctcgctcgtcggattcgtaagttgaaattatcgtgggaaacttttttactatcgatcgttacgaaaaaaagttattcttcataaaagctctactcgcatcgccttaaaacctaagatacaatcatctcgatatcaaattttatcaatcttatacgaggtatcgtcaaaaatatcgaattttcgctcaagagtaaagtacctttatatttaataaaagaaaagttgtttggaattcgaagactatcgttttaatatcgcaattatatccttctatttaaatggttaattttcggtatctgctagggttttgaagtaacaaaccttacgttgcgccctttcaatctgtttcatctgggaactaacgtcgttgggaggtaagtaatattttacatttttatccgtttttgttgaagaattaacgccttcaagatgttctgctgaaggagaatacttcggatcgtgtagacagcgcttagaacaaatcactcttctccaataacttaacatttagactcgacttgctgtatttgtctatcagacgtcttanaagtttttggatatattgcaacaagaagtaatgataatattgttctgacgctattttcttgcgacatcttaatgcaattaactgttttanaataagttcattttanagtaaaattctggcttattcccataaatatcataanaagtaaatgatatattgagattttatatttncgcaaatggtgaagggtcgcagaggtgctcacactcgatggatcgatcaatgcagaaagca

SEQ ID NO: 16798 - DNA, 703 bp, Diabrotica virgifera
  misc_feature (603)..(603): n is a, c, g, or t
agaactgtgaacagtagaaatgattgaatcggaaaatttatctaacagcttcactgttcaattggtaattatacaaagagtctacattctaccacattcaatactattttaatattaaatgtcatgtaactgcagaaaatatcgatttttattagcactaaatagtcttttcagcgtttttctaaaaacaattttaacggtcacatgatcattcacacatgacataattagcatataagcaaatcacatatatgattcattgaatgcgcttcgcaaagtagtgggtcaggatttagacagaatcctactctgtcgctcatcgcaacagtaactataactgcacttcattagagaacaggcggtagcgcgcagtcacacattagactattacctcccaccacaggaccaatttagatatatccccagtttatactaagcggggacggaaagatcggttcatatttgattcaccctcgtataatggttaataagtcagtgtccgtgattttcttctccaggctacttgaaagtttgttagcacgataaggaacctacaaaaaaaggtctggtggcaggtcatgaaaacgaaaaattttaccttgnaaaatttgccgaaaataacgaaaattagattttcaggaaaacgtacaatggttcaaccctacatttccttttttcttgcttatctcatatgaaattttca

SEQ ID NO: 16799 - DNA, 399 bp, Diabrotica virgifera
  misc_feature (4)..(27): n is a, c, g, or t
  misc_feature (214)..(233): n is a, c, g, or t
gtcnnnnnnnnnnnnnnnnnnnnnnnnggatttataagtagctgcagctcctcttgcagtttgaaaaagtgatacggaaagaagaattgtgagccattatttaaatgtatagaaaagaagaattcattctatgcaccttgagcagcacggagtgatcaaagaataatgatactatttatgatttacaaattcaaaagagctaaaaaaagaacannnnnnnnnnnnnnnnnnnntatgtaataattatatttgaaacgagaaagcatagatcggactgtcaataggtctaatattttgagaaataaatctcgtttaatttataatcagtatatttataatcaagtatctatatatcgataaatgataaaatatctttaacgcatgagaataaaaataaaa

SEQ ID NO: 16800 - DNA, 112 bp, Diabrotica virgifera
  misc_feature (2)..(24): n is a, c, g, or t
  misc_feature (30)..(62): n is a, c, g, or t
  misc_feature (64)..(85): n is a, c, g, or t
gnnnnnnnnnnnnnnnnnnnnnnntgaaannnnnnnnnnnnnnnnnnnnnnnnnnnnnnnnncnnnnnnnnnnnnnnnnnnnnnncaccggtttatgaaaacacatgtcttt

SEQ ID NO: 16801 - DNA, 659 bp, Diabrotica virgifera
  misc_feature (109)..(127): n is a, c, g, or t
caggaataaaatcatcaaaaaagcaataaaattgtgaagctactgtataacattttaaccaatgcttacaataccgcttgaatgatcttttgtgaatgtttttggtacnnnnnnnnnnnnnnnnnnnaaccaaacgcagaatcgaattctatgaactcttcagataaaataactgacccagacgaagcttccaggaataacccagaagcatcgtcgagtaacgtaaacaacgaaaaaaacttctactgacaataaggacgaagttatgaaacgagctgctgcaaagaaacttattagagatacttctaccaacttactgatggctgtggaaatcctcattgtgacaatcgctactgcgcttctagtggtgaaatgaacccgctgactccagatcaagcagcagctcaagccattcagttgttttcccaagatgcaaggctatgtgagagacaccccaacaaaatagctcgaaaaaaagagaatataataattaacaaaactgaaacatcaaacgatgtcaattttaaatcaaatttacccacaaatgatattgaatcacagagtaattattcaaacagtaaagatagtgtcaaatcaaatagtgcccccgtaccaacatatttgacagaacaagctttatacgacataatcgacgaatg

SEQ ID NO: 16802 - DNA, 231 bp, Diabrotica virgifera
ttcctattaattacaaattttagaataacgtttacagaatcaaatattactgaactaggagatagaaagtcctacgcgggcatcccagaagccgaatttgtggaagctgatgacgatttcatggatggcctatgagcagagaaggatcattccttaactgcttctcgtcaacgcattacaaatgaattcgcatcttggaagacaacaaagtgatggatggaacatcacact

SEQ ID NO: 16803 - DNA, 776 bp, Diabrotica virgifera
  misc_feature (53)..(72): n is a, c, g, or t
  misc_feature (568)..(568): n is a, c, g, or t
  misc_feature (662)..(662): n is a, c, g, or t
actttttgtcgttatttattctaaggctttgtggatccgtaattcagtgtacnnnnnnnnnnnnnnnnnnnngtaaagcagtgtagtgattagtaatattaaattctggagcccctatttattattaacaacagtgtaattgatatctaacgtttttgatgaagtaatcgaagaaaataattggaccattttgacagtgggtgctttgactaaacatcagtcaggttaagggacttttaatggattttgagtatagcaaagaaaatattttacctcttctacgaggaaggaacgttcaccaacttaatatggcactacaagctcagactaacagagactgtcaactagaacttctgcagcaaaaagagaaatgggaaaaactaatcgaaacgtacactggagaggatccactagagaattattataaatacatttcctggatagaacagacattcccaaaacatgggcatgaaggcaatttggtgccattgctggaacagtgtctcgccacgtttgaagctgatcggcgatatgcaaatgacagacgtttctgtaaactttggattanatattttgatttgcaaccaaaaccgttggaattttatcacatgatgaaagccaaaggactttgtacaggatgtgctgatttttataaagcttgngcttattatcatgaagctgctggagattttatatccgcaaacaaagtgtttgaagaaggaaaactaaatttagcgcagccgtttgatgaactcgaaaatgcacatcaaaatcta

SEQ ID NO: 16804 - DNA, 899 bp, Diabrotica virgifera
  misc_feature (8)..(26): n is a, c, g, or t
  misc_feature (36)..(55): n is a, c, g, or t
  misc_feature (145)..(172): n is a, c, g, or t
  misc_feature (179)..(226): n is a, c, g, or t
  misc_feature (229)..(261): n is a, c, g, or t
  misc_feature (290)..(756): n is a, c, g, or t
  misc_feature (762)..(796): n is a, c, g, or t
  misc_feature (798)..(798): n is a, c, g, or t
  misc_feature (807)..(828): n is a, c, g, or t
  misc_feature (842)..(842): n is a, c, g, or t
  misc_feature (851)..(897): n is a, c, g, or t
tatttatnnnnnnnnnnnnnnnnnnncttctctccnnnnnnnnnnnnnnnnnnnntctcatctctaacgatagttaattagtatccgtgagagaatatctctctctttctctacaaaagaaaaattcatctctcttcgtacctcnnnnnnnnnnnnnnnnnnnnnnnnnnnncatcatnnnnnnnnnnnnnnnnnnnnnnnnnnnnnnnnnnnnnnnnnnnnnnnntcnnnnnnnnnnnnnnnnnnnnnnnnnnnnnnnnntcgaaacgttattcgtttttcaaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggnnnnnnnnnnnnnnnnnnnnnnnnnnnnnnnnnnnanttttataannnnnnnnnnnnnnnnnnnnnngcttaattttttanaagacgagnnnnnnnnnnnnnnnnnnnnnnnnnnnnnnnnnnnnnnnnnnnnnnntt

SEQ ID NO: 16805 - DNA, 839 bp, Diabrotica virgifera
  misc_feature (645)..(645): n is a, c, g, or t
  misc_feature (724)..(724): n is a, c, g, or t
atgtaagaacctttgaaaatcgtcttcaatttctgctaccgggataatattgtctacataacatagtactttcacgttcactttccccattttatatcatatttcctttattatttctctataaacgtctttgattattctaattaggtgttgcggaactcctctgttggattctatttcgataatatcttccagctgaattctatcaaaatatttccatacgtccacaaaacacaagaatacttgtcaattatattcgacacatgtttctaatatttttctctacttgtcagtataataaaatctgctttaaaacgcatttacttgatttactgaaaactaggggcaactagcgacgacagacatctcataaaccatttatatgcggttccaacataagagctgccgttatagaataataaaagtaatatgaacaaactaccatcgtacgtgaaacagggaagaataaataggaatcattgatggtctaaaaaaatttagtacatcataacccaaacacaatctctaaactttagcacctcaaaaaaatttagcacataagatttattaataagttatactgttatactgatttattaataagttatactgaggtcaaagggcttccacgatatttgaccttanattttaaaggcaggtaatgtaagaatgagtcaaataggaatttattgtatcgccactctctaacttctacttactgaanaaaaaaatatgagcaggcacttcagcacagggctaaaaccaggatagttctattaaacaaactacacacgcaaaggatattatactggtatttaagaaaataacgagaaatcttg

SEQ ID NO: 16806 - DNA, 729 bp, Diabrotica virgifera
  misc_feature (3)..(16): n is a, c, g, or t
  misc_feature (18)..(45): n is a, c, g, or t
  misc_feature (53)..(165): n is a, c, g, or t
  misc_feature (175)..(727): n is a, c, g, or t
ccnnnnnnnnnnnnnncnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaa

SEQ ID NO: 16807 - DNA, 858 bp, Diabrotica virgifera
  misc_feature (787)..(787): n is a, c, g, or t
  misc_feature (848)..(848): n is a, c, g, or t
aatcaaccttcacaggctacctttaaaactgaaacagctgccttggagaaaattaatttagctatagtagacgacgaggaagaccccaacaacgaattaaaatcggtggtttgtcagagatgcaagtcagaaaaatgccattgtaagttaacgaagtcccataaaccgtggctctcggaaaatgctagtgctctccaacaaatccggagttcagatcttacaacagctgatatcttagagagggaagtcaagaataagaaaagcatgttaaggtcggaaatcaaaacaaaggacgacgtggaaccaaagcgcctatcccctttttcggaaatgtcgcgtagagacgaaggtgatggtcgcagcatcgcggattccaactgttccatttataagaatcagtttttaacttaccaatccgctactgacaagaaagcccccaaaccagcgacgaagttgaggacgatttctttgcacagaagaaatttgccgagttgacgtttgattgaagagactgaagatttattgctgtagaatcagaatagtgtaatattttatacagtgtgtacaaaaagtaaagtaactcatattttggtatataaaagtctaaaaagatttcataataaaatctctggataaatttatatataatcaataacctttctaccataataatggtgtaaggtgtaatgtttaatctacttcttaacaaatttcttccaattcactctgttgtctccaatatctttccgattactttaccacatatctgtattggtcttcctctctnttttgttttccatgttattgcttcccacattcctctcactggtatggtatctttcatccgntgtaaatgat

SEQ ID NO: 16808 - DNA, 603 bp, Diabrotica virgifera
  misc_feature (2)..(15): n is a, c, g, or t
  misc_feature (26)..(47): n is a, c, g, or t
  misc_feature (56)..(81): n is a, c, g, or t
  misc_feature (83)..(404): n is a, c, g, or t
  misc_feature (411)..(448): n is a, c, g, or t
  misc_feature (468)..(481): n is a, c, g, or t
  misc_feature (484)..(506): n is a, c, g, or t
  misc_feature (514)..(536): n is a, c, g, or t
  misc_feature (566)..(597): n is a, c, g, or t
cnnnnnnnnnnnnnncgtctttttcnnnnnnnnnnnnnnnnnnnnnncgcccaccnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16809 - DNA, 929 bp, Diabrotica virgifera
ccttctccaatttctcgtgtgtcattattattattgtgccggtagtttgttgacttacgaactcctaccacgacagctcgtaccgacgaagttgaacgctttcacgggcgtgtcgctcgaaattaggaagatattacagttcgagtgcagcacccaatactaagcttttcatcaatcggcaaaatcggtcgaatcacaaacaaaagactcggattgatttgcataatcctcgccaccaacgaggttgttacccgagtgccaaaatccaccaagaaagagatggaagatgcagttgaatctcgccaaagaagcttttaaatcttcggtcgaagacgtcaatcatcactagacaacagatcatcgttcaagtaccaaaatattattaaggctaatatgaaagaacttcggctcgaaaatatcactacagaacaggggaaaacactcgggctcgatgcggaaggggatgttctcagaggcttacaggtggtcgaacatcgcttcgcggcatggccatcacagcttcttcggggaaactttcgcctggcgtagcgaaagatttggacatcatttcgtacagagtaccccttgggtgtgacggcctccatcacacctttcaatttccccgctatggttcccttgtgggcgattcccatgggcaataacttgcggcaacacacacgtgatcaagccttcggaacgggatcctggtgcatgtatgatgctagtagaaatgctccaggaagctgggtgccccccaggcgttgtcaatgtgattcatggagctcacgatgcagttgatttcatttgcgaccaccctgccataagagctatctctttttgttggttcggatattgctggtcagtacatttacgagagaggagccaaaaatggtaagcgggtccaaagcaacatgggcgccagaaatcac

SEQ ID NO: 16810 - DNA, 126 bp, Diabrotica virgifera
  misc_feature (2)..(125): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 16811 - DNA, 671 bp, Diabrotica virgifera
  misc_feature (55)..(144): n is a, c, g, or t
  misc_feature (155)..(333): n is a, c, g, or t
  misc_feature (335)..(383): n is a, c, g, or t
  misc_feature (392)..(501): n is a, c, g, or t
  misc_feature (503)..(540): n is a, c, g, or t
  misc_feature (570)..(596): n is a, c, g, or t
ttctcttcagcggcccacttttatttattttagaataataaaatcccttttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnntgttaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnagtgatgatgataatattagaattaaaatnnnnnnnnnnnnnnnnnnnnnnnnnnnattaagaaaggtattagggaagatttttttcgcctgtatattaataacatgtatttatgtagtaatgatgaagtg

SEQ ID NO: 16812 - DNA, 659 bp, Diabrotica virgifera
  misc_feature (157)..(183): n is a, c, g, or t
  misc_feature (592)..(592): n is a, c, g, or t
tttaataataaattcagaagttgttatagatagagcatagctaaaaaacgtgaggttattgctgaatacatcattctattaatcaaaataatataatattgcaaaattttacgttaacaatatacttttctattttatttgagaataaaaccacaannnnnnnnnnnnnnnnnnnnnnnnnnncgttttgacgtccacttcggaaatcgaaatcaaaatacaacgatttccgaagtggaagtcgaaacgtcaaataaatttacctaattttgatcttaaataattgtggttttattccaggataaaatagtaaattacatatggttggtacagtgtaaataccgttacacgtcattatctacgtcagagatctaagttgacatagttgccaaattacaaaaaaaaattctgaattcattttaaatcaaatacatcataatatataattatttcagaagtgtgcatacaacaaaacaaaccgtgcccccctggcttttcgggtgctgttaactatatatggttatccaaagaacacaaaatataatgtgcaacatcttcacgtctgcccccacccctgaaaatttttatatgngcttccgtgatcttttgtgctattttgtcggttattagcgcgctcatcactgtataaaatattcaat

SEQ ID NO: 16813 - DNA, 799 bp, Diabrotica virgifera
  misc_feature (11)..(28): n is a, c, g, or t
  misc_feature (37)..(56): n is a, c, g, or t
  misc_feature (196)..(219): n is a, c, g, or t
  misc_feature (224)..(251): n is a, c, g, or t
  misc_feature (296)..(320): n is a, c, g, or t
  misc_feature (322)..(383): n is a, c, g, or t
  misc_feature (385)..(797): n is a, c, g, or t
tttttctctcnnnnnnnnnnnnnnnnnnttttctccnnnnnnnnnnnnnnnnnnnnctctcaacatagttaatctcgtatccgtcgagagaatcttttctccccctaaaagaaaaattcatctttccgtacctccgtcgtatcagggatctcttaattaataattcatcatcattcatcctctttcgaatttcaannnnnnnnnnnnnnnnnnnnnnnncatcnnnnnnnnnnnnnnnnnnnnnnnnnnnncgtaatcgaaacgttattcgtttttaaatatcatctaattttttnnnnnnnnnnnnnnnnnnnnnnnnncnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntc

SEQ ID NO: 16814 - DNA, 823 bp, Diabrotica virgifera
  misc_feature (789)..(789): n is a, c, g, or t
cattgtacctctttagtttttgtactaattcctctgaatactcttgttttgtttgttgcacttttaatttggttaagttccacttccttctttttcctactttattattagctttgatgattttcatcttcattttggctattaagagtatgtggtcagtgtcagcgtttgctcctctaaaggatctcacatcttgtattatctttgtccattttttcgaaatcaaaacatgatctatttggttgccatctgatctccctggtaacatccaggttatcttgtgttcccttttatgaataaatttcgtactgacgatgtaggtatttgttgctgctgccagattgcaaacttttgccccgttatccaggaccagatgagattaacaatgaacttattgcaaatggaggagatgaccttctaaaccgtatatataaattaatggtcagtatatgggaaaaggaatacatgcctgaagaatggaagaaaggactcattataccagtttttaaaaaaggagacccaacgctttgcagcaattatagagcaattacgctattaaatacaacatataagatcatgacaacaattataagaaatcggctaaccagatacacagaaaaaaacttaggaccatatcaacagggatttagaaaagggagatcaacaattgatgcaatccacgttttaacgcaaacaatcgaaaaaagttacgaacatggcatagaattgcacatattgtttattgatttccagcaggctttcgacagcatctacagaaaacagctattnaaagaaatgaaaaatatgaatatacctgcaaaat

SEQ ID NO: 16815 - DNA, 604 bp, Diabrotica virgifera
cggacgcgtgggatggtagtgattattattcttgtgatgttagtggttatactgtatgtaccatcaagaatgatagcgtatctgtgattacgttgactttatgaaggagattatacgctgtaggtattcccgccgccatataacaaaaatgagaagatacaatcacaagaggaaaggtgttttagctattccaacactgtttccgttatgtttgttttgcaatagttgtacatgaacacggctgattgcttgggatgcatcccgaaattacacacatttcttgaatactggagtgggaattccgctaacttattccgatttttcccaactccttgcagtttgttacatatatctagacaatgtttagtaaatattattgagagctatagagttcaagacactgatctgctttctctaccattatgaattgagctctggtgtagccgacgcagctatctctctctgctatgtatctcacttgatttcgccagaaccagagagtcactgttgcgatgtataagttgaagatgtatgttatatctctgcattggtctaatgtctatatatgatcttcatagctgatgccgttgaaaatattatctcg

SEQ ID NO: 16816 - DNA, 268 bp, Diabrotica virgifera; identical to SEQ ID NO: 6456
  misc_feature (4)..(46): n is a, c, g, or t
  misc_feature (52)..(74): n is a, c, g, or t

SEQ ID NO: 16817 - DNA, 679 bp, Diabrotica virgifera
  misc_feature (8)..(547): n is a, c, g, or t
  misc_feature (549)..(573): n is a, c, g, or t
  misc_feature (578)..(578): n is a, c, g, or t
  misc_feature (580)..(611): n is a, c, g, or t
  misc_feature (625)..(626): n is a, c, g, or t
  misc_feature (629)..(678): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnngtgcntnnnnnnnnnnnnnnnnnnnnnnnnnnnnnnnngctggaaatgaggnntgnnnnnnnnnnnnnnnnnnnnnnnnnnnnnnnnnnnnnnnnnnnnnnnnnng

SEQ ID NO: 16818 - DNA, 764 bp, Diabrotica virgifera
  misc_feature (716)..(716): n is a, c, g, or t
agaacggaacggcagatggttgatcgaaaattacgggaattttaatacggagtttcaagctcctataagtatttagtggaaaaattaataatgttgttgtttggaagagctaggagacaaagtgtggaagatcccgtagaaattgaagtcacaccatctgccgtttgggtgaaattataaagtaaccagtccatcagctcccctaacaaccgggagcaaccgttctaggccaagccaggtcacttggagaccagcctggagaatctcctcccacgtagcgttgaattctgcacttcgcccccgaagggcaccttgaataattggtacaagctagcaccatccctgtgctaattctactaccagggattttggtatccataacaaggacacttatgggaaccataatatagggtttgttttggggacacttggtacttatttgcaagtgattattactctaccatcacaacacgttaatatttttgtgtaataatcaggacatttagttcaaactaagttttatattttaatcacacatatttttgtttcaagatttaggttgcattttttttcatattaatttttgatagtgtttcccaaaccagtaaactctctggtcaaggaggtttgagctcagatcatcttttccctcatatgagattctctttacctttgtattatattacctgaaatttacttgtaccatttatttattntattaactttatattttttgttactacccttgctagtctccacttatc

SEQ ID NO: 16819 - DNA, 750 bp, Diabrotica virgifera
  misc_feature (7)..(29): n is a, c, g, or t
  misc_feature (666)..(666): n is a, c, g, or t
  misc_feature (692)..(694): n is a, c, g, or t
  misc_feature (720)..(722): n is a, c, g, or t
acttcgnnnnnnnnnnnnnnnnnnnnnnncgccaagaggtacatacctattacaaaactaaacattgtagaatatcgctattgtatttgcttttcaatattcgctcgtgtaggtagaatacttcgctttaagattctagaaaataaaatctatagttgcgagaacctaaaatatcgtcgcatttttctttttaaacgttagtttttcacaacctttgtcttttttgtaacacggttgataaaggtttttctgattccacttcgtcttagcaattttaaagttttcatatcttcatcatagctacttctgacatcatcatggagacgagagatcatgaattccgttatacatttgaggcagaagtagctgggacagtctagacatgataacatctatactatacgatctaccgaacttccccaaaatcaaacagcttgccttttggcggttgatattgaatgaattagatttgacaagctcagatagtgttcagggagaagtgattggcttcgattaaagttacgtaccttatcaactgttctgattccagtgtaagatttttaatatatttgcaccaacaccatttaaaaatagaactccattgaacttgaaccaaatttagaaccaacttttgaaccaacttgaactccattttagaatttctancaagctattatactccttgactctgnnnacatcttaattacctcgatacctagnnntatacaaaacatctagtaggatgcttat

SEQ ID NO: 16820 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16821 - DNA, 933 bp, Diabrotica virgifera
  misc_feature (392)..(414): n is a, c, g, or t
  misc_feature (434)..(479): n is a, c, g, or t
  misc_feature (856)..(856): n is a, c, g, or t
gtgttatgaaattttatttctgtacgttttgtctttgttttcttggcttggttttggttcaccatctgtttgacatttggagttagtggaaatttggtagaaaacgttttattttaaaaacttttatttcatacatcatacaatatgaacacagatttattaaaaaaggcgaaaaggctgagctttacaagcctgtttttcaaatgtttggcttgctcaggttctaaggtatcgaaattgaagacaggatgtacattttgaacattatcatcatttaaaatgtgatttagtaccacgtattctatatcatcgtcattagcttcaagtaatattgcctgtcctatatttctcttccatatttctttagaaaaatttgaaatccaaattgtacnnnnnnnnnnnnnnnnnnnnnnntaagtatgtatcttgggtgnnnnnnnnnnnnnnnnnnnnnnnnnnnnnnnnnnnnnnnnnnnnnngctgtcaaatacgatatttgacttacagctgccaactattaacgtgaggcgggaattctaccacttgataactctaaaattacatatatgtacgttaaaacttataccgtaaaaaatagcatttacgtgtcaaaataacggatggatagaattttacttgataactctctattatccaacgatgtcgcttatagtgctttgtggacccagagcctcatcacccgaaaagtgggctgaacgctccatcagtgtcttttcttctacttctgtagttatagttagaacacctgtaataatttcaaacaacaaaggtttcttttccaatctaacctgaacttgaacctccatatgtagggaagcttcccctgttttactgnagcgagttactactggctttttcttcagtgtttttgtcttccctcttcttggttcggagttaactttcccaactccg

SEQ ID NO: 16822 - DNA, 852 bp, Diabrotica virgifera
  misc_feature (218)..(236): n is a, c, g, or t
  misc_feature (704)..(725): n is a, c, g, or t
  misc_feature (763)..(763): n is a, c, g, or t
  misc_feature (771)..(771): n is a, c, g, or t
aaaattaaaaatttagatatactaatgattcttaacaatagtagactatattaaaaatcatttgaacgtaagtagagttttggttgtcaaactactacaattctacggggtgtggacattgctacgaaattaataaaaaacgtaattatcttttaaaataccctgtataacattacaaatcctcatattttaagaaagaagacatcgaagagaatccnnnnnnnnnnnnnnnnnnngggtgtcccatttaaaaaaacgaagttataagcaacttccggtataaccggaagttgcaaagagatgaaaatattttcatttaatagatcatccttctaaacccctgtattccaattttcatgatttcgttgcctttagttctcgagatatttctaataggccagttatctgcctcaccctgtataaaaacaccctgtattgatgaagatcatggcaaattgttaaagtacctaacttttttattattcaacataagcgaatgaatcaaaaaacaaaatgttaagaaaacctgaggctatagttgggttttaatgtcagtattttataaatgctagaatattccacagggtctgattggtacacctggtatacaatgacaatttacctgtcttcttcttcttgactggctttacaactcgggtgagtcttcgccgcatccactatggccctccatcgtctgcgatctnnnnnnnnnnnnnnnnnnnnnngtaccccatcctagatagatcggtttcacatcatcttncatctttntctgggacggccactgatcttctaacgtctggtctctcgaagcacactgtctttagcactctgtcctcctctgatcttact

SEQ ID NO: 16823 - DNA, 623 bp, Diabrotica virgifera
ccttatatttttatttcttttgctataatactctattttctagcaacaggaaagactaaattttctttaacgatatgcaactcctattgcgagacaatattttattcatataaaagaacaatctattctttgcaccttgtgcatcaagcctaatcacctactaatctatcacctccattatttccaaatccaacacagctacccacttaacaatgttattgcagaagcaatactcttactaattttactgcaacgcaatgctattcgattttactctatagtctaattttctcagcagcaaattctaattaatttattaccactatatttataatcaagtacctctatatcattaatataaaatatcttcagccacgagcttaacaattaaatcttatcacactttactttttaaatcccaactaccactagacattttcctattttaaaccatgctatacatttgtcctcatctactcttctttctacttgctagaactgttttattacaatataactacacatcatttagatttagtattgatgatactattagtattagccaattgcatatcatattacagatatatccgcctatcacacgtattcgctaacattttttt

SEQ ID NO: 16824 - DNA, 705 bp, Diabrotica virgifera
  misc_feature (2)..(15): n is a, c, g, or t
  misc_feature (17)..(46): n is a, c, g, or t
  misc_feature (53)..(165): n is a, c, g, or t
  misc_feature (174)..(598): n is a, c, g, or t
  misc_feature (605)..(657): n is a, c, g, or t
  misc_feature (663)..(663): n is a, c, g, or t
  misc_feature (667)..(667): n is a, c, g, or t
  misc_feature (673)..(700): n is a, c, g, or t
  misc_feature (703)..(703): n is a, c, g, or t
cnnnnnnnnnnnnnncnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggnnnnnnnnnnnnnnnnnnnnnnnnnnnnnnnnnnnnnnnnnnnnnnnnnnnnngctggnatgnaggggnnnnnnnnnnnnnnnnnnnnnnnnnnnnttnat

SEQ ID NO: 16825 - DNA, 817 bp, Diabrotica virgifera
  misc_feature (767)..(767): n is a, c, g, or t
aaacgacgattcagtgcaccgacgcaacgtacgccagccaattgtccctagagaatcccaaaggattttctagagatgcttttggaaggcagagtatgtcagagaagaggcatgcgacgttggatgccaagaataccgacacatatcagaaatcgaagaagattagggaggagaggaagatgaaagaaataaatgctgataaattaggccaattaggaccaagtttaggcatgaagaaatcttcaagcttggaatcgttacagacaatggtacaagagattcaaatgcaagaagaaggcgacccagcttatagttatagaggacccaatggagctttaaaagtaatcagggggaaaggctgtgaagaaagctttagggcagctgtagtggatccaaatcaccgaagtgagatcggagccaaaaagcattggttgcttgacggtccaatggaaaacgaacgagaagtggatggcttcagcaatgctcgaggaggtcctaggcaatcttctctgaatgcagctattgatataaagaataaatcagcaaagaagaaacctggtatatttaaaggcattggttcgatgttcaggtttggcaaacatcgtaaactggacttccaaacagcagaggctgcccaacactatcatcatacaaacgaattcgattcaaatgccaacgtacctcaacaacacaccgcagataccgaaaaccgaacgcaaagtagtcaaccagaacggacgcaagagcattcacaaaaagtacctcanaatagcaacccccagaaccaaaacactttcccaaggttctcaccaccagt

SEQ ID NO: 16826 - DNA, 918 bp, Diabrotica virgifera
  misc_feature (749)..(766): n is a, c, g, or t
  misc_feature (776)..(776): n is a, c, g, or t
  misc_feature (780)..(805): n is a, c, g, or t
  misc_feature (807)..(826): n is a, c, g, or t
  misc_feature (838)..(838): n is a, c, g, or t
  misc_feature (900)..(901): n is a, c, g, or t
gttattagaaaggttgatgttttatttcagtctgtattaccagtatataatatagcaagacacggttagtatttagtattttgtatttcaggtggttgtaaccagtgtcatagagttcctgttgttcgttacttcaaaaatctcgaacctgtccaacttcttggttctgagagctgagttgttcgttcgagttggcgccctttgttcttcttctttctttgttgtatctcgatattattttatctctagcattctgatctatttttcttccatttttgtgtttgcaggtctcattttctttctagttactatcatttcattatcaatttttttttctcatatctccaaagccaatattcggtgtatagaagctagcccaaatacccacttgagatttagtgtctctctgcccatttaatttgtccttctgagctaagcccctcttcttgtcgtcttaaatctcttatcattttcttttacccatctttattcagttcttcttctcttcaaaaatctctatacccagagtaaagaggtttcaattggctagacccaacgtgtggcttcttttacatttttggctttgaaaatatctcattttacttttggttttatcttggtggtttcagtgattgtgtttttagattttgattcgaatgttcactttggtacttcaaattttttttggacgtgtcttatatctatatcttgaataaacttgttttgctatagtatactgtgttgactgnnnnnnnnnnnnnnnnnngattggttanatannnnnnnnnnnnnnnnnnnnnnnnnnannnnnnnnnnnnnnnnnnnnatcttgaatttnaagatttcacatattttttacagtccggagtagcattaaaagtgaatcactaccttgaattnnaaagtttttttcgattt

SEQ ID NO: 16827 - DNA, 795 bp, Diabrotica virgifera
  misc_feature (163)..(181): n is a, c, g, or t
attattttttacttgtttcctgtataagatcagtatttctatgacaaattggactattgggcctgacacctcttatgacacaattgaatcctttcccaaagtcatcaaaccctgtaaaatttgaagctatattatacatatataaaaagttcaccctggaacnnnnnnnnnnnnnnnnnnncaaatttttatacaaagccatactacaatacattaccctagtctaaaaaagttactacgtaaatggatatggaatgtctctaaatagctacgaccaaaactcgttttttatgaagacaggacaacgtaaagctcgaaaacttaataagaaatgaacactctgcatcaacagatagccggaaaactttacatcataaatacaaaaatatttaacgtagtaacagattcatttatgttattacagactgactgcgaatttagtacgatactggtatagccgtgccatattgaagatctttgtcggtttctcccgaataatagatgtatccatcttctgttttttgtttttctaaaccagtccattttacttcacttatccccaagacatcaattttcatttctctcgtctcgtctcttcagtgtttgccggtttcccggacataaataagcttcgtacgctccaggtggtaatgctcattatcctatcatatatttcgattctctattctagttctttttgaattccctcccccagcttcttctcttttcttatctcttgtggtgtccacgtcaaaatctgtttaaggatcctgtcatctggcattctctatacat

SEQ ID NO: 16828 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16829 - DNA, 238 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(229): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnagataatat

SEQ ID NO: 16830 - DNA, 305 bp, Diabrotica virgifera
gccaggtgtctcgggggaatattcggaattgcagccgcattgggacgcgttttggctgcctgttgatcgctactgtatcaccttgataactataataataatctttttcattggccattaaagctaaagattttgggtaatgttttctttagtctattcaatacaaaagaatttatctatcagcaagaagtttttatttatccatcacttccttactttttcaagtctggactcatgtctaattttatttgaggatctttacccaaccatggcatactatagaccaaactacaaaccatggaacg

SEQ ID NO: 16831 - DNA, 737 bp, Diabrotica virgifera
  misc_feature (174)..(192): n is a, c, g, or t
  misc_feature (251)..(406): n is a, c, g, or t
ggtaatcttattcaatgttaagatgaatagagcaggatctaccaattatgtgttaacgaaagatacaggtatagctcaatctgtagctccagcacttacacttgaaagggaaggagatactttatattactttggatatacatttaagggtaattggttccaggcgatggagcnnnnnnnnnnnnnnnnnnnggatttagctagtatagagacaaagcaagaaaatgattttctatataatcagatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggttagatacaactacaataacggtcttcaatggaacgacaacaatcaaaatgctaatcttcatgctctttgtgaggctaaaattacaaaatcggtggcagaaatggttcctctgttttgtaattttacggactctgtaactgttttaagatgagtttgaaacaaacgcattgtagtttagttattttatttagtgtattgtaattttacggactctgtaactgttttaagataagtttgaaacaaacggattgtagtttagttattttattaagtgtattgtattttggtgtgttttttgtatgttttatacgtcaatatagccaatt

SEQ ID NO: 16832 - DNA, 818 bp, Diabrotica virgifera
agattttccagcaccggcttgtatttgctggtcttttatcttcgctttgattcctcctttaatggtggactttgctgatgtgtacgattggaagctagggggctgtggaagagtagtgccttcttttgcaagttcatctgccgcttcattcccttcaacaccgacatgactagggatccattgtaaagtaatcagccaccctttttccagcaagttcgatagttggacgcggcaagatattgtttgggcacagtcggtatatcgatttgtcgacagggcgaggattgcggctttgcagtcgatgaagaaggcaactttttgggggtgttggagattctcgagacttttagcggcttcgtgtatagcagcaatttcgccatcatagttggtgagaggggcacccacagctatggagcctttggagaatattgagacatatcctgctcctgttcttcccgagtcaggcatcgaggagccattgcagtagatgtggagccactcatgcgctgggtaattggtgtgtatcgtctctagggcggctttccttaggacaatgtctgacgataagtgcttcgggttatggttttcaagacgcaattctgtgtttggtagacagcgggtgagtgtagtttgcgctgggaagggggcggctttcgacaggtcaatgtggtatttttccatgatttgatttgctactgtaagcggagtggtttgtgttttaagacgtgaggctgcttgtctatattcgtcccatttttgtggaagtattcgtctttgcttttcccagaaggttaacgcgtgttgctctctgcggcatt

SEQ ID NO: 16833 - DNA, 92 bp, Diabrotica virgifera
tcccttcttttcaaatatggtgtttttctttgatacttttacgatggaggatgcaagtttgtttgggtaaacaccgggtcgctgtaaatcgc

SEQ ID NO: 16834 - DNA, 878 bp, Diabrotica virgifera
  misc_feature (183)..(201): n is a, c, g, or t
gtgcggacatgcaagtttcgttagttttctttcttctaggtccttttataaacagtgagacggttactttgggcagtgttgccaatcgaacttctctagataatatttctctcaaacaaggtataataacgtttaaccataaaatatttacaggaaagaaaggaaataactacaaataaccannnnnnnnnnnnnnnnnnnagtctgttgtagtagattggtagttacactgaaacatataggcaaatatctgattatttttactgattacaactctcaaacagatccgcaaatcggattattatacgccgcttggcaacattgactttgggcggcgttatgggctgtggccctctgaaaagaagacagatagttgaacgatattttatacaatgtgtattaacctggtatggatatctgtgtgtcgaagttttatattggtccactattttaaatgcagttcaactcaatgcaatgttccgaaattttctcgtttattctgtatatttagagaattaaatagttatcagtgattcatttcgaagttcgtggatcattacggaatttgaggagaaatggtagtaaattcagtggcgcgccatttagacgcaatggcgtctaaatttatactataattttacgtgtacaattctatattgttataattatgctattattttgggaagcaataagtaacattgtatgcaacaattccctgccaactatttcggtctttgattgtatacctctttttgccacaatagttcttaataaaaaaatactgtaaagagcaattttataaggtattattattccgtattatttttaattttgagatcttgatttatgtgcatcgttttatgtcgttaatttattga

SEQ ID NO: 16835 - DNA, 661 bp, Diabrotica virgifera
  misc_feature (44)..(659): n is a, c, g, or t
gcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngt

SEQ ID NO: 16836 - DNA, 914 bp, Diabrotica virgifera
  misc_feature (817)..(817): n is a, c, g, or t
  misc_feature (880)..(880): n is a, c, g, or t
  misc_feature (884)..(884): n is a, c, g, or t
cgcgagtgaggggatgtctttgtttgaaagttccgcaaaaatcgtggataattgattacatgtgagccggtgaatatggtatagccggcaaggtgggtcgaagagagtatggccagagtgcggttgttcagatggacttgggtttgggcttggactgcgttagctggactgtgcgctctggccgcaacagagagtcaacagcaatgtcccccgatagcagaaatctccccgtgctcctgtacggtcaaaaagaatggcctggacatcctctgcgagttcaccgatcaacaacacattaacgacgccatgggaaaactcaaaggaaaatctctgaccattttttatttgaagttgagacacaacaacctgcgaaaattaaccggttttattttcctcggtctggacatcagacatctcactatacacaatagcagtttgtcggttgtggaagaagcctcactcagctcgatcggtaaaatgctaacccaactggatgtatctcagaacagcttaaccaccgttccatcagctgcatttaaaaatctccaccaattacttattttgaacatgaaccacaataaagtaaccagtttgcacgcgaaagcttttgagggcttagacacgttggaaatactgacgttgtatgagaataagatcaccaatatcgataccgaagctttcgtggggcttgagaaaaaactaaaacgattaaatttgggggcaaatggtttaacgaaagtgccacaaccatccctcgcaatactggatatgcttaagaaattggaaatgcaggagaacagaattagtgatatcaaangagggagattttgaaggtctaaagaatttagattcattaggattagcccccacacaattgaangaangtacccagcaaggttttctcgcacctgacg

SEQ ID NO: 16837 - DNA, 834 bp, Diabrotica virgifera
gctgtttgtaagaatggtagccattttataaaaaacacattaaatgtgatttttttaaacatttaagggtttttaccctaaccagtggttatatccctgggtttattttaaactaaagaatgtgtttgttcgaagttttctcttcttttgaggtttttacacctataagacgtcatttcaaagagagttgccactccagcaagaattaaaaaagttggattattctctgtagtaccagaaataccaattttcaaatttgatttcaatgaagttgaagaatgcggctctattatagataacatagtaacagtattaaaacattccaaatcaaagcacaaggacctggacatagaaataaagaaaacggataaagagttacgaaaaagacttgttgatttcgatgcgaaaaaaatgggcaataaagttgagatcaaaaatttaactcatctgcttcagaggcaacaaaataggaataataatctagaggggaaggttagtcgactggaaactgaagtttgtactttggtaactagaaataaggaattacaggatattgtcaaatctttgcacaacaaaattaatgaaaaggatttaaaactgaatcaaaacatattggaaagagaacgcacaaaacaaaaaatagcgctagctagcgaacaaatgagccaagaacttgatgctaagttgaagaaacaacgagaacatcttaatgccgctatgatagctaaagaaattcagctgaagaaggtcagagaagctttagaaactgaaattgtcatcgatacgaatgatgttgcgatagaaaatatcccaccatcttctgtactaacaccc

SEQ ID NO: 16838 - DNA, 841 bp, Diabrotica virgifera
  misc_feature (393)..(408): n is a, c, g, or t
  misc_feature (565)..(587): n is a, c, g, or t
atttgtggtgactattcctacaaaagatagtgatatattttctgaatgaaagagccgaagtaaaggtgggaggagaagaaagcgacgtgtaagaatacggtatataattctcgcatgacatactgtacaatgccctttgaacatgttatagaaaaatacaccgacctagaacatccagatctgaccactccttcatatgatggcctatcaacatttccaaaatctcctaacttaaaaagctgacaagaacaagcgagacgtgcatctgaatacatccactatttcatgtcaagcatctaattgtgattccgtatactctgaagatggcgctggctgcagtgttgagtgtgaactctaccaaaaaatcttcatcaaggccagacaagaacgagnnnnnnnnnnnnnnnnaggtaacttcctctcaacgcccagaatcacaggaccctgctccttactctcatgtgacacacaacggaaaggtatctaaagacgagtgaacgcatgttaccagttccactccccgagaatatggatgtgtcacaactacaggctacggaaaatgctnnnnnnnnnnnnnnnnnnnnnnncctgctgagactaagcctacccgatgtggttgacatctatatatagaagattttggacttcaacaccggaggaagaaagcgatagtgatcatgaatgatgagaccacatttgtgaggtctcatgcttattcgtcggagaatgaatacgtggataacgattcactgcagggagaactttctgatgaagagaatgcttaatcgaccgaataagaagacagtgtggtagatgatgaaacagatgatatagataatgc

SEQ ID NO: 16839 - DNA, 206 bp, Diabrotica virgifera
  misc_feature (185)..(203): n is a, c, g, or t
cggacgctgggttagtactaaagaacactaaaccacgtttggtttatttttgaattagtattgtttggtactaaattccgatggttcacataatactgctactaaaattgtaaattatattttataagtacattacagtcattgatcacattaacattcacttttttattgtagatttctggacnnnnnnnnnnnnnnnnnnncag

SEQ ID NO: 16840 - DNA, 67 bp, Diabrotica virgifera
  misc_feature (19)..(19): n is a, c, g, or t
gttcgaaaaaagagccccnagaaatggggtaaggttcatttcaatatgcctgggtactcgacaaact

SEQ ID NO: 16841 - DNA, 886 bp, Diabrotica virgifera
  misc_feature (2)..(31): n is a, c, g, or t
  misc_feature (39)..(686): n is a, c, g, or t
  misc_feature (693)..(730): n is a, c, g, or t
  misc_feature (750)..(763): n is a, c, g, or t
  misc_feature (766)..(788): n is a, c, g, or t
  misc_feature (796)..(818): n is a, c, g, or t
  misc_feature (840)..(840): n is a, c, g, or t
  misc_feature (849)..(880): n is a, c, g, or t
tnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccanggttggttnnnnnnnnnnnnnnnnnnnnnnnnnnnnnnnngaaagg

SEQ ID NO: 16842 - DNA, 477 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcttc

SEQ ID NO: 16843 - DNA, 776 bp, Diabrotica virgifera
  misc_feature (15)..(118): n is a, c, g, or t
  misc_feature (120)..(159): n is a, c, g, or t
  misc_feature (161)..(444): n is a, c, g, or t
  misc_feature (446)..(577): n is a, c, g, or t
  misc_feature (584)..(621): n is a, c, g, or t
  misc_feature (641)..(654): n is a, c, g, or t
  misc_feature (657)..(679): n is a, c, g, or t
  misc_feature (687)..(709): n is a, c, g, or t
  misc_feature (739)..(770): n is a, c, g, or t
cccacccgggtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16844 - DNA, 918 bp, Diabrotica virgifera
  misc_feature (849)..(849): n is a, c, g, or t
  misc_feature (854)..(854): n is a, c, g, or t
  misc_feature (877)..(877): n is a, c, g, or t
  misc_feature (879)..(880): n is a, c, g, or t
  misc_feature (892)..(892): n is a, c, g, or t
gaatcgtctgtgaaaaaacaatttaaggaagaggagtttttttctcttgttttttggttggttaccattgtatggagcgtgatatacagccgttaaagtctttgtgtaccgctgaacaaaatgcagccggacacaagtctttgtcgaatgcctgcggagcttacactggccccttactgcctatcggagagaccagctctgacaaatctatggaaccaaccgttggccgctggggctgcgaatggccaagttgactcgaaaatgagaacgcttggtctcaaaatggaaccctcctagggtttaagcaagagcccttctacggggctcatgggaatttaaacggcaacgttggcctccccgtcgacgctgctagctgcacattggcccaactcattgaagacgagcaggacaacggtctgtggcctttggagcatcctcttcctcttccaggatgggaggaggagtatatcgctccctacagactcaacaacatcagggaatacgaaacgttggcctgtgaaattgagatgcatctgcgcaaagtgctggaagaacacaattacgatactgttggcaattttttgaaactttacgaaagttacaagaagagcggcaacgataacctacttgagtttttccatttgtattctccaccaataacatctgaacatcatacctgcgtcggactggcttttgaactatggaatcgtctcagactcaacctggatagcaagtatccaggtataggcaaccacatttgtgttgtttcttgcgaggaagaaatcgacagccctattgtatacaccaatgcttttagatatgatcccacttctttgccgtatagattgnaaaangaacacgtcatgatgtgctttgnanngtgaattttccngaagaactgcagtgatgctatgtgat

SEQ ID NO: 16845 - DNA, 470 bp, Diabrotica virgifera
  misc_feature (10)..(74): n is a, c, g, or t
  misc_feature (78)..(132): n is a, c, g, or t
  misc_feature (136)..(197): n is a, c, g, or t
  misc_feature (213)..(270): n is a, c, g, or t
  misc_feature (272)..(414): n is a, c, g, or t
  misc_feature (417)..(437): n is a, c, g, or t
  misc_feature (440)..(464): n is a, c, g, or t
gatagttaannnnnnnnnnnnnnnnnnnnnnnnnnnnnnnnnnnnnnnnnnnnnnnnnnnnnnnnnnnnnnnnnaggnnnnnnnnnnnnnnnnnnnnnnnnnnnnnnnnnnnnnnnnnnnnnnnnnnnnnnngccnnnnnnnnnnnnnnnnnnnnnnnnnnnnnnnnnnnnnnnnnnnnnnnnnnnnnnnnnnnnnngaaaagggatttccgnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnnnnnnnnnnccnnnnnnnnnnnnnnnnnnnnnnnnnaggaag

SEQ ID NO: 16846 - DNA, 386 bp, Diabrotica virgifera
aagaattctttaacaagtacctctgcaacggtagcagcttcttgatttggtaatgcataggcctcagtccattttgtaaaataatccatggctaccaggatgtatttatttccagcatcggtttctggaaatggacctgcaatgtcgatagctactctttccataggacttccaacattgtactgtctcatgggtgctctctttttaccaaccggaccattaccggatgcacacggttcacattttcggcaccatcttcttacattatctttacagttcacccaatagaaccgttctcgaaccttttgcagagtcttcgtaatacccaagtgtccacctgatgtaccgtcatgcaactgacgcaatacttctgacactttactttt

SEQ ID NO: 16847 - DNA, 761 bp, Diabrotica virgifera
  misc_feature (8)..(69): n is a, c, g, or t
  misc_feature (71)..(105): n is a, c, g, or t
  misc_feature (110)..(146): n is a, c, g, or t
  misc_feature (155)..(175): n is a, c, g, or t
  misc_feature (188)..(258): n is a, c, g, or t
  misc_feature (268)..(402): n is a, c, g, or t
  misc_feature (411)..(440): n is a, c, g, or t
  misc_feature (447)..(585): n is a, c, g, or t
  misc_feature (591)..(695): n is a, c, g, or t
  misc_feature (698)..(710): n is a, c, g, or t
  misc_feature (720)..(758): n is a, c, g, or t
ggagggtnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnggcgnnnnnnnnnnnnnnnnnnnnnnnnnnnnnnnnnnnnntgtgtgtgnnnnnnnnnnnnnnnnnnnnngggggcgggggcnnnnnnnnnnnnnnnnnnnnnnnnnnnnnnnnnnnnnnnnnnnnnnnnnnnnnnnnnnnnnnnnnnnnnnnttcccttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggcggnnnnnnnnnnnnnnnnnnnnnnnnnnnnnnccccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnnccgccgccgnnnnnnnnnnnnnnnnnnnnnnnnnnnnnnnnnnnnnnnaac

SEQ ID NO: 16848 - DNA, 585 bp, Diabrotica virgifera
  misc_feature (187)..(203): n is a, c, g, or t
ttgagcaactaggagtgaaagcattagctctaacactggagttcgatgaagctgctgtgcttaagaccaacagtgcatacctagcgtatactttagatctcgaagaagttatcattaagtatactgatgacccagaagcaactgagaagatgaaagagtgctgtccaggctctccttttgtactgtnnnnnnnnnnnnnnnnnattaaattagaatttataaatccggtcccacagaatgggctcttttcaaaggtgctgaccgttagtgacggagatacttacgaaaaagtcgtgcaaaggctcgccaaagatagtaaagctatgaaaaaaccagaatctattcagctatggaggtttgaagatcccgttcttgggcctacaaaaataccagcgttcaatgaaccaactaaggataagcttcaagtatcacctgatagtgtcttcaagattgacggttcgagacttaaactgttattaggaaaacaaactgttgatctaggaagccaaataacttatttagttgtgtaacaataagattatttgtttatttatttatacagttttaataaatatggagtttctt

SEQ ID NO: 16849 - DNA, 119 bp, Diabrotica virgifera
  misc_feature (54)..(54): n is a, c, g, or t
taattttagatgtttttatgttaactttaacctatctaatttgtgtatatcggnttatatttatctgatttaaaacattgcatagtagctaattatttaaaaatgatggctggcagact

SEQ ID NO: 16850 - DNA, 74 bp, Diabrotica virgifera
gtgcaattgtattttgttttataatctattttgattctacattctactttcaattagtattaaattcgaatccc

SEQ ID NO: 16851 - DNA, 874 bp, Diabrotica virgifera
ataaatcatctctgtatcatttagtagatgattatacgcatgacctttattacgagcttttaaagcaatattaacaatattaggaataattaagtgattacatttatataagaatactttactaagaaccgccttattacttgcaagattaattatatatcactggatgccgacatattgcacagagaatggaactatatcaaaggccgttcaatacctcttacttatgatagctaacagtgcttactgattgtagtgaataatatttatattcattagctctcatgaagatattattgtttatatcatttttttgaggattttgtcctacaccattaactccaactattgagttaagaatactttgacctcctattgcaatacaagccttgaacccatgaaaaatcccttgattaaatactttatctctttgaactacaggattgactgttactcgcagcgcacatcatcaacctactatagaaataatttttctcatggacttgcaaggcatttactgcttacagtaacattagagaatttattttactattttacaaggatatgaatatattgaatcaccttttgcgatttctgattacatttatgactcttcattttttataacaccaggtattcatgtaccacctgtaattatagaaacaaccttcttagtattctgattaattcgccattatttgaatcatttttcatcgacacgtcactgtggatatgaatcatcagcttgatactgacattgtgcatatgccgcatggttattcttatatatttcagttcactgatgaggtatataaagtagggacacttttacatcaaacgttgatgtcatagacactggagacataaaatttat

SEQ ID NO: 16852 - DNA, 284 bp, Diabrotica virgifera
  misc_feature (17)..(34): n is a, c, g, or t
  misc_feature (47)..(66): n is a, c, g, or t
  misc_feature (76)..(93): n is a, c, g, or t
gagaaatatataggtgnnnnnnnnnnnnnnnnnntgatttttttctnnnnnnnnnnnnnnnnnnnngcttggtggnnnnnnnnnnnnnnnnnngcggctcactgactacttagggtgtctgtgagaccttgaccgagatgaacatgaccatgagtagggaattattagtgcacggttgcctgaggtttgtgtgtagaaaagtgtctctggaagagatcctataataggtcttcaaagattatcggtggcctgcgacgaagggaaccgagtgactttcatgggta

SEQ ID NO: 16853 - DNA, 195 bp, Diabrotica virgifera
gtgcgcgctggtggagacggggcggaattaccggggcccccttccacgcccgcgcatctaatagaggaaaacagaccggtgcccgctatttatactggagattatttcgcagcctggatcactcatagaaagaactatcgtgtgtaactaacggtatagttgtttagagcaaccatactatagatgctacgtatc

SEQ ID NO: 16854 - DNA, 452 bp, Diabrotica virgifera
gtgacgatgaagagtataaatctcttgatctgtgttttgttcgtttatttgaatattgcagagggaatttccgaagactcaagttcagctgctgtcgccaatgaaatatgtaagagctacaccgaagatgccaaaaagaatcatatttgtcctgtccctcaagagaccagcctaattggaggaattttagcagaaaaaggagaatttcctcatatggtacaactcgcttatagcaaaagtaatacaactaagtatctttgtagtggtttcattattagtaaaaattacgttcttactgcagctcactgtgttaatggaggagggacaaataagccacagtttctaagagctggagtaacagatgtcaacgatgtgtcaaatgagcaggtacgatctatcgattctattataattcatcctggatttaagcggccagcgatatacaacgatat

SEQ ID NO: 16855 - DNA, 934 bp, Diabrotica virgifera
  misc_feature (888)..(889): n is a, c, g, or t
gttatggttttgctcttttttgctgaattgaattcgcgatttaaaaagtattttattgcatttttaacttataatacaactaccaagatgtggaaaacatttacaaatgatgatcatatttatatgcttaaagtcgttgacagtgacaacaactttgaaatatatttatctgatttgatgacaatgtggaattgtatcctttcacaagaagcattagtacagaaatttcaggaatgcaatccagctattgagcaaacaccagaagaatatattcaacatgctaaaaatatattaaatgaagttgaaaacgcagaagttggcgttatatgtgatgaaggaccatgtagtgtgcgattctatattaaaacacatctagcaactaatttcaagtttaaattaaaactagaactagattttgcacaagcagaggaagaatcattcactgaaaagatgactgtaccgttaatacaaacaataatcctattagaaaagcaacaggaaatgatgagaaacttgctattgaaaaaagacagggagttggaggaatataaaatggaaaaaggagaaatatcaagaagtgatttaattacagaaaaattcaatccagaatcactgatagcatcaagcaagacattaatgttgaatgttttccaaaatcgcgctgaagatatcaaaagaaaatacggagcaatagaagaaaaagtagaagaagttgaagtggaatcatggaacagtgtgaaaaggagaaggaaaatatataacaaagaaactgcaaataggacaaaagatgttgaaattaaatataatggtggaacaaatataaaacaggaaaattagggttttgatattttttcgaattagatttttatgtttatattcattaatttnngtatattttttggtgtaatatctataaaatatttttgcaattccc

SEQ ID NO: 16856 - DNA, 603 bp, Diabrotica virgifera
aattatggtcaaacaaaattttttgttataccattgccattttgagacaatgagttgataggtattaacattacacgatctaggaggactgcgacaatattataatatttttcgaagacaacctcaaccgcgacattgagtttactgatgcagtagcctacacacaaatggattcaattcgtctttcgttgctaccaaatgttgtcgaccccatgtctgaaaataccatgacgctcactgtaatccaggtttatatttatcccgagactgctcttgtgaacatcttgccccacgtcacacggaatcgacgtgtgtgtgatcagccgacaggaattggtagaaattaataagtatctcttgcaacagaatatgaaagtctctgctccactatgggaaaatgcatgatgatctgggatcttcctgcattaaatacagacttggtacctgggaagacatctttcgtccagggtttgagaagctgcaaagacatgtatcgggttactagtaaaatgttccctgaagcccacaatcttatcaccggagacgatgtaggtgcctccgtggccacatgactcatcctgataaacttttctcccgtctcat

SEQ ID NO: 16857 - DNA, 634 bp, Diabrotica virgifera
gtggaggaaatgctgaaaaagaccggttgtattaatctgcattataaagtacaggactgcatatcagaaactaaagattggaggcagtgtcaaagtcaagtaaccgagttcaggaggtgtatgcaagaacatcaagaatcaaaaattaaaactggctcccaaaaaacctaacatcattattttgtgttttagttttctaaaaagacttgttttaaacatgtttaagtccttaatatccagtcttcaaccttcgaaaatggtaataatattacgaactgatattaacatgggaaggggcaagctagcttcccaggcagctcatgcagctgtattactgtatcagtcatcaatagaaagtaacaatctgcatttaaaatcgtggttagcaacaggacaacctaagatagttttaaaagtagagacgaactgtgaagaggtgcttaaagatacctacaacaaagcaaagaatttgaacttaaacacttgcttggttagagatgcagggagaactcaagtggatgtagcgtgcttaactgctgttggtataggacccaataaaaaatcggatattgatgaaattacaagtagttttaaattattgtgaatatgtatataggtaaagttgttaatattg

SEQ ID NO: 16858 - DNA, 623 bp, Diabrotica virgifera
atttttatttatttgaaaggtaataaataacccctataagaaaaactgagaaaaaaatttcgataacgaacgttgggaaactggaggctcagaagaagacatgaaatatgccctatgcacagatgctgccccagcgaaaatagaagagagcaatgtagaagcctacaccctgcatgagtgtagtagtgtccagatacaacaaatgaaaaacatgccccagatacagaaaacttggatggaagagtcgtcaccctagtttattaatatgcagatatttgtaattctacacaaaaatgttatgacccaccagttgcacgagcatatgatcagagtgacagacattactggagatgacgacttatcttttaagacagattatgaagaagtacgagcagaaatagaagaacaagatggtgaagttggagggaagcacgagaagaaatgctggcagaaaggaaatatgatgttccgaacggagatcttgctggtggaaaagtctgtactgcatgtaagaacaaagactgctcttgaagatcataatggccggatgtaagacagatggatcgagaacgtaggcgtcatcctttgtcctctgggaatacccgagattaatttatatgacc

SEQ ID NO: 16859 - DNA, 934 bp, Diabrotica virgifera
  misc_feature (192)..(217): n is a, c, g, or t
  misc_feature (725)..(744): n is a, c, g, or t
  misc_feature (746)..(764): n is a, c, g, or t
gcgccctggtctatgtagaaattccttcggattacgtttgaatagcctcaaatactgctctgaagtggtctcatggctacacttgttggtcgccatcgaaggagaatagtcaccgtacacagcatccaagcgttctctgatttcactgcacaatttcccttcgaaaaacaggaatcgattcaccgatcgatnnnnnnnnnnnnnnnnnnnnnnnnnnctaaaatccccagacactcccacttccacacgcggtcaaaacaaaactacgaatcggatttggctgagattttgacataggccgtttacaagaatgtattgtatgatagtatatttctcttgatatagtagcgccatcgggcggacaggctaagtacttatcggaccacctacgtatataattgattcaaagccaagaaaaagctcgcataaactcgaactttgaaattcttcattgtagaacaaagctgggttattactcgcctcatggtttttatctttatatcgctaacttatcctttttatttctaaattttttgtacattaacaactatcttccaaagactttaataaaaattattctcttagatattaaaaggggattaatatgttgctgatggatccgtaattttttacaatgaaccattataatgcttggtgtttgcttagtgtaaaaagtattacctgccgatataattatgaatttctttttctttcaaacttatttnnnnnnnnnnnnnnnnnnnncnnnnnnnnnnnnnnnnnnnccataatatggaactttttgttggataacttagtactttattataatatctttaatatggttttattcacttctataaatcattgaaagcttccaaaaaaattcttagtagtgtttaaaattaacatatttacattaagagcgtaggcgcaaaatatcgaccagtgcttt

SEQ ID NO: 16860 - DNA, 539 bp, Diabrotica virgifera
  misc_feature (65)..(79): n is a, c, g, or t
cgcttttagcgaaaagtccaacatactccctttttacagcctgcaaaagtaaatacgaaagtagnnnnnnnnnnnnnnnctggagagagacgagatagaattgtagaagttattcgtaagaaaacttcagagcgctgctcggagtcgactgagctagttccctccgctccacaggatcctattcgtctcgccgatattagaatttgttgtctacctagaatatggagacgccggaccgacacatctgctgtcttgtgtaattacttgaacagaatcgtcattggtgtcgaattgtgagttatacacggtacatctggggtgtgattagtaggcaggatcacctaaaataacagcattattcatgacaacagattatgtacatgtaggcccacctcaggttaaaaatgattactcgactagaatcagggtgcatagaatcaaattgtgagattcgtagttggaaagaaagtatagggttagtagatgtgtaagggtttatatgatgataagggtaagttatcctttaaatcatctaaatt

SEQ ID NO: 16861 - DNA, 975 bp, Diabrotica virgifera
  misc_feature (439)..(528): n is a, c, g, or t
  misc_feature (854)..(854): n is a, c, g, or t
  misc_feature (895)..(895): n is a, c, g, or t
  misc_feature (902)..(902): n is a, c, g, or t
  misc_feature (933)..(966): n is a, c, g, or t
cttctggatctagcgtattacccacagcagcagcagttgcggctgcagcagcgacagctaaaattcaagctatggacgcagttgctagtaacgccgcagcgctaggattacctacgttaaataaagcaccgacagttcctaacgtagtgacccaaccggtagttatgccagtgataacccagccagttgtagcaggaccgacgatagtaacgacgacagcaggcattcctgcaatcattcctccacctggtatcgccataccgcaaattacaccaaacaacacgattcagccggcgattgttacgcctttgatcactccaccacaaatcgcagcccctacaatggtcacaccgatgcccatggtccaacaaccttctggcagttcagcagaatcgatgaaaaaggtccaggaagctcagttaaaacaacaggaacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgcagaaacttatgaggaaggtggattcgagggttgttattttaaggaatatggtaggtcccgaggacgtagacgaaatgttgcaggaggaaatccaagaggaatgtagcaaatttgggtcggttgaaagagtaatcatatataacgaaaaacagtcagaagaagacgatgattccgatgtgatagttaaaatttttgtagaatttacgaaaacgtatgctgcagaaagagcgagagatgtattaaacggcaggtacttcggaggacgcatggtgcaagcatccctctatgaccaaacgttattcgatcacagtgatttctcngggtagcacgttttagaccaaagactgttttaataagtganaattaantatttaaagttttacgttcgtcaaaaatcgnnnnnnnnnnnnnnnnnnnnnnnnnnnnnnnnnntagtaaaaa

SEQ ID NO: 16862 - DNA, 67 bp, Diabrotica virgifera
  misc_feature (2)..(66): n is a, c, g, or t
annnnnnnnnnnnnnnnnnnnnnnnnnnnnnnnnnnnnnnnnnnnnnnnnnnnnnnnnnnnnnnnnt

SEQ ID NO: 16863 - DNA, 978 bp, Diabrotica virgifera
  misc_feature (24)..(42): n is a, c, g, or t
  misc_feature (876)..(876): n is a, c, g, or t
aaaagaaatagaacgtaataatgnnnnnnnnnnnnnnnnnnnctctggaacataagcatctactattaatttgatgcagctaaggaaataatatgggcaacaagtaaaaaagcctcctcaaacaaacagacagagtggtggtgacaaaaaaagaggtggcatagataggtgtcttttaggaaatatttggaaaagaacgaccatacttataataatacaactgtaaatgtgtaaaaaatcgtattgattttgctacttgtgtctattgtgtcattttattagatcacaatatatataaactgttgaactcgaccgtaagctgctttaaaaacaataaaatgttttgaaatgtagtaaatatgtcatcgaataagtgacgtcatagctaagtgtagacagtattgccaaaataatttgtatacataatggttcttctatttatacaaaactttaatctttttaatttcttctctttgtatttgactattaacaaagtgaaacgaattttgcaattattttagtatattaacgtagaaaaagatcaataattgactctagagacttttaattcttaacaaaattaaacaattatattaaacaccaaaactactctgatcaagtcatggtctctgcatattatttataccttagagctacactatttagaacaaaatgttaatataaacattttttaataggtattttgagatagaaagtgtatgtgaaaattctgtgtttataatgcaaaaccccatacacggcttaggaataagtttatgtaggctaaacacagacgaaattagttatatttatggaaactgagactacgacgtagttcgacgaaatataaacagtctacgggatgtcctatcgtgntatagccgaatcaaatttaatataagggtagttatgactaaaaaattgaaaaccgtacatgatcatatcacagtttatggcatacattatggtcaacacatg

SEQ ID NO: 16864 - DNA, 859 bp, Diabrotica virgifera
  misc_feature (367)..(382): n is a, c, g, or t
cagcgaaaaatgacgatttttaatacgctgttaattgcttgtttgtgtgttccaattacaaactgtgattactttaatgaaattactataaaaatattcaggagacaatccattgaccctcgttcacgcaaacacagtcaacgatgaagaaaacatcactgaagtccagatagaagatgaagatatacctgtattgaaaaccggtacatttcagaatctttctcggttaaaagtaattcggatccacagaaataacctgcaagatcttgaaaattgtccattttacaacgtaactgctttaagaataataaatctcaatttcaacaggattaagatagttccagaaaacgttttcgctaacttatcnnnnnnnnnnnnnnnnctaaaagggaatggaatcagcttgttacaaccaggagcattttacaatctgagcaacttgcatgctctggatttaagttcaaataatatcaagtatttaccaaaagatctgttttatttaacgaataatgttaagacaatcgatttaagctacaaccaaatgcaatattactggaacattgtgccgtacagttattttgcagaaccattcgccaatgtcaaccgagatgagcattcctgtatagatctaagcttcaacaactttacttttataagcagtatgttgttcaagaacgtaccttatgttaaacaattatatttgaacaataataacatcaaaaggattggggatgctgcgtttactgatttaaggtgggtggagatgttagatttggaaggaaacgaattggaggaacttagtgatggtacattgaagagtttgtctatagcaaattatgtaaatctagctaacaatccc

SEQ ID NO: 16865 - DNA, 117 bp, Diabrotica virgifera
ggtggatagtcgagcaaatgtgaactttaacattatttactggatattcgatgatggttcgactgttgtattttattacgtatgcgaatatgtatgacaattgaagttttggcgtat

SEQ ID NO: 16866 - DNA, 246 bp, Diabrotica virgifera
  misc_feature (3)..(160): n is a, c, g, or t
  misc_feature (197)..(197): n is a, c, g, or t
ttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaataccttagggatacagcgtaattttattggnagagtcaatcgatataaagatgcgacctcgatgttggataaaagtttat

SEQ ID NO: 16867 - DNA, 793 bp, Diabrotica virgifera
atttgaagtattcttatcttttatccgctaactgatttgctagtattgaaaaatgcactaccatctacttatccgaacagaatgcaatattgctgacctagatttccttagctccttgtaatgccatcgataccagcctctatgtgaaaaaatgttacagtgaattccttatcttttcctggttttctagaactataggtggaaccaatttcttacaaaactataccaacttgtacgaattactccttgactaatcgcatatttgctgaaccatgatcctgtaatgggttttgcagaattaaaagacagaagagaaatcatccatatttgatgagatgacccacgacctctaattctaaaaacacagaccaccataatttccgagtatccacttaggagctacttcttgtaccaacgcatacaaaacagatatagtacatatcttagatgaactacccctcctgattccctacctatgcaatggaataaacaatcttgcccgccttgccaatatgcacaacagactttgcactacgttatcgatatacacatctccaacctgcccagctaactaccgtcgtgatcaaaactacactttggatttatgattttcttatggatgaaggaaccatgaatagagcaataaatgatctaccttttagaggagttaaaggcactacagatactacagcttcttttacctctgtatttataaacgatagagaaagatgtagagacctacatagaatacatgctgaatgtatgtgtagttgtgagatcatatcctgttact

SEQ ID NO: 16868 - DNA, 925 bp, Diabrotica virgifera
  misc_feature (792)..(792): n is a, c, g, or t
  misc_feature (896)..(897): n is a, c, g, or t
agtatatgtacaataacttcagagttgtgaatatctatgtacaataacttaaatttatattcccagctaagatgtcgctgctgctgttgtatgtagggccatcttagctgggaatataaatttaagttattgtttttaacattcatttgattaattcagagttgaaataaaacattatgaactgttatcggacagttctaaagaaatttgcatccataaacgacatttagacttttgtcgcttattacttttggtaatcgaaaaatgttggcgattcatggcattgtttgtggttaacaccttctctgcgtttagagatatttataaacttgcgtgaactgcgttacgacccacatatgtttaacaaagccatttaaaggctgcttgattcgaaaattaaagatattgttacgacagttctgtagattgatcctacataaaagaaaaagttccttaaaatgggttggtaggtttatttgaagataccaatttatgcgctattcacgctaagagagtcgccattatgcctaagaacatccagctggctagaagaatcagaggagaaagggcataaacaaataaaatacatattaaaaatgtaatataagaaattaatcttgaaagacaagaaaggtacaccttttgcaagatgctggctagaagaatcggaggagaaagggcataaacaaataaaataaggtaccttttgcaagatcagataattttcgacatattgtctacgcagccaacccttagtgtaatacgaggtctatatgtctcataacgcagcgnaaggtgttgatttcatataaacatgacaatgttttttattaactgtaccttttgttttcttttgtgattttccttaagtgttttaacctaagtctaattatctnnaaaggatgcacattgtttttagatatcc

SEQ ID NO: 16869 - DNA, 131 bp, Diabrotica virgifera
cgggtgtattgtgcgttattagttcgtgtcggtgtatatgcacacctctactaatttcgtcttctcccaagaagtgataaactaagacgatatgaaaccaatccgaatgagctgcctgcaagaagctatct

SEQ ID NO: 16870 - DNA, 950 bp, Diabrotica virgifera
  misc_feature (299)..(315): n is a, c, g, or t
  misc_feature (622)..(641): n is a, c, g, or t
  misc_feature (779)..(803): n is a, c, g, or t
ccgatctccgaattttctcgcctttttgcccctcgaaaatccgaaaaaatggtttatgaaagcgatttttacacgaccaggaggccctatcgtgccactccttccgtttcgtcttacactatttcgactccaagacattacgtggtgacggattacccagagcgtacccgcaaatctgcagagcaagtctattcttactcctattcttccgactcttctaatcgctccggttatggcgacccccgctctcgttcttacacgtccaccgagagcgtctccagatcttccactggaggccnnnnnnnnnnnnnnnnnacttcggaacggaccagccgctccagaggcgacggtcctggaggttacagctccagctatagctctacttcatctggcccaggcacatacagacactactcctatcgtgtctaagacctcttgagtttctgcttgtaacctagttatattcttttaaaatcgggaatatccttagtgtttcaattaataaagaaaaacagtaaataaggttgtaaaagcaacttaaattttagaagatatttttactatactgtagtccttaaactaaaaactatactaatgctagtacaagattacatcaactggnnnnnnnnnnnnnnnnnnnnctctatgtcgagtgttagttttacaagataacctcgccttacaattgtctagaaacattattgatacagggtgtacataattaggaaatataatatcgttattaaggatattcccgaaaatttcaatatggtttagannnnnnnnnnnnnnnnnnnnnnnnncacatgcattaacaaaattgtgtttgatatatagtactttataataattttggttgaaataagtattttaggtcaattataaataaaataagagttaaacatactagaaatcaaatcgtgaaaaatacatatcaaaaaccccttagc

SEQ ID NO: 16871 - DNA, 1001 bp, Diabrotica virgifera
  misc_feature (303)..(318): n is a, c, g, or t
  misc_feature (421)..(435): n is a, c, g, or t
  misc_feature (955)..(955): n is a, c, g, or t
aaacttgtctgcggtttgaccaattacaaacaagcaatacagcgcggtaaatttgaatcactcctcttggttaaaaaacaaatataactgatatttggtttggtttagatcgtgattgagacataacctcacaaaatttaagtaatgacgtcatcggtaatgtgacatattgttgattaactttgatattttctttttaactttttttatgtaaagttaccacaatattttctttagtttttaggatcctttattaatactttacataatatttatgactaaaattcaatatttacgtgacannnnnnnnnnnnnnnnctataccaaaaaaggacaattcattactgctcccggaacgaaccaaggccgatgagaaacgctgtcgacggtcttacgcccacctaaattctacagtctctannnnnnnnnnnnnnntctcaccggccatgattcgctccggaatctgtaaacatgtttaatgtaagagaatcgagattaataaaaaatggctagagaagagtgtggtaccttctagtcatatattcagtcatgagaggctgtacgaagaagtctaatttaaaaagaaaacattgcaaattactttacatgagattattcaaaagtagcatcacatctacacagaaacacgaagagtataattttaaacaccaaaatattaatattcaaagcaaaatcttagcaggtagtgccattttttaccattaacctattttttcgaagaataaaagtgaggttaaattatttagaacagaatgtaggcaaccaataatatacgttgcctagctattgtaggttgcctacatttgaaattttacaaaatgaatcgttctttcgatagacccctatacttttaaaccaatttaaccacaacatttgttgctctcgcaataaaatttctttttatttgatcagcagcgagcaataaatgtttggntgaaatgttgaatctcatttttcctgaatattcattaaggaaaaac

SEQ ID NO: 16872 - DNA, 608 bp, Diabrotica virgifera
  misc_feature (107)..(119): n is a, c, g, or t
  misc_feature (122)..(140): n is a, c, g, or t
ggcgcgcactagtcggagacaaattagcagcaaaacgcatgcgcactttataatgatataaataatatcgttaatagatggatatacaaggtatatttacctagtannnnnnnnnnnnnagnnnnnnnnnnnnnnnnnnngtaaatataccgtgtatatttgtctattaacgatattatttatattaagtgaggttagaaagtgtcgacgacaagttgtcaactgtacccgcgaacgcacctattatactctcgtataatcgaagaagatgaggacctatgaattatttccagcgacctctgttgataagtagtataattttggtttactgttctctacatttgactactaagttattaaaatgcggaaaacattttaatttgtgtgaattgagcttaatttgagagaatttcagtttctaagtggaggatttataaaatcacatctggcaaatctggtgggagttgtagcaaattttccctggcatgctctgtctctctctctaggacctctcacttgcatggtggtcgcaatctcgcttcactatttgaattggactgggacattccatccgtggtgaccagtgatcgtgacgcatgggaaaaggt

SEQ ID NO: 16873 - DNA, 941 bp, Diabrotica virgifera
  misc_feature (707)..(926): n is a, c, g, or t
aaacttcgcctgaatactgtgtgcatggaataatggaataggacctcggttctattttgttggttttcggaaccccgaggtaatgattaataggaacggatgggggcattcgtattgcgacgttagaggtgaaattcttggatcgtcgcaagacggacagaagcgaaagcatttgccaaaaacgctttcattgatcaagaacgaaagttagaggttcgaaggcgatcagataccgccctagttctaaccataaacgatgccagctagcgattcgccgacgttcctccgatgactcggcgagcagcttccgaaaccaaagcttttgggttccgggggaagtatggttgcaaagctgaaacttaaaggaattgacggaagggcaccaccaggagtggagcctgcggcttaatttgactcaacacgggaaacctcaccaggcccggacaccggaaggattgacagattgagagctctttcttgattcggtgggtggtggtgcatggccgttcttagttggtggagcgatttgtctggttaattccgataacgaacgagactctagcctgctaactaggcgtatttcgacatcccaaaggcccgtcggtggagtttcctgctcttgctgcacgcggtttttactgtcggcgtacacacaattcttcttagagggacaggcggcttctagccgcacgagattgagcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactaccgattggat

SEQ ID NO: 16874 - DNA, 813 bp, Diabrotica virgifera
  misc_feature (27)..(69): n is a, c, g, or t
  misc_feature (89)..(165): n is a, c, g, or t
  misc_feature (255)..(273): n is a, c, g, or t
  misc_feature (294)..(364): n is a, c, g, or t
  misc_feature (389)..(412): n is a, c, g, or t
  misc_feature (419)..(443): n is a, c, g, or t
  misc_feature (454)..(482): n is a, c, g, or t
  misc_feature (528)..(582): n is a, c, g, or t
  misc_feature (593)..(617): n is a, c, g, or t
  misc_feature (655)..(700): n is a, c, g, or t
  misc_feature (702)..(726): n is a, c, g, or t
  misc_feature (728)..(744): n is a, c, g, or t
  misc_feature (746)..(782): n is a, c, g, or t
atttttatttatttcaccataatcacnnnnnnnnnnnnnnnnnnnnnnnnnnnnnnnnnnnnnnnnnnnctaattagtattgcgagacnnnnnnnnnnnnnnnnnnnnnnnnnnnnnnnnnnnnnnnnnnnnnnnnnnnnnnnnnnnnnnnnnnnnnnnnnnnnnctatcattttcgaatttaccacacctccaacattaaaatctttattgtaaactacatattttaaataatcttttttgtactgaaatgtcnnnnnnnnnnnnnnnnnnncactcttttacgaaataaacnnnnnnnnnnnnnnnnnnnnnnnnnnnnnnnnnnnnnnnnnnnnnnnnnnnnnnnnnnnnnnnnnnnnnnncgcgcttaaacataaaattttatcnnnnnnnnnnnnnnnnnnnnnnnntagcccnnnnnnnnnnnnnnnnnnnnnnnnngtcatcattcnnnnnnnnnnnnnnnnnnnnnnnnnnnnnatcacttttttattaacatataaatttaccctatttaaattcagcnnnnnnnnnnnnnnnnnnnnnnnnnnnnnnnnnnnnnnnnnnnnnnnnnnnnnnncaataaacgcnnnnnnnnnnnnnnnnnnnnnnnnnctactcacaacctgtctttttgtactaaatataaagcnnnnnnnnnnnnnnnnnnnnnnnnnnnnnnnnnnnnnnnnnnnnnncnnnnnnnnnnnnnnnnnnnnnnnnncnnnnnnnnnnnnnnnnncnnnnnnnnnnnnnnnnnnnnnnnnnnnnnnnnnnnnnctatcaagaattctatttttacgttaacaag

SEQ ID NO: 16875 - DNA, 651 bp, Diabrotica virgifera
gttttgtattgctattgtgatattctcggaggtattactcattgtttttgtgtttctcatagtttattctaagaccgatttttcgtgcttctctatctagtttcaaaagcacattacttaactcctctttatcactttctatcggtaagacatcatcggcatatcgtacgtggtttagatattctccacttctttttattcccttctcttgtcgatttagtttcttgaaaacaagctccaaggcttatttaaacagttttgatgacattgtgtcaccttacatcattcctctgttcagtgctattgggtccgtgagttatttcgtgtttttgctttctgatagatgttgtcaataagtttagtatgtttgtaatctaccctactgcgcttagtgagtacctattttattgcacagttttccacactgttgaaagctttttcaaagtctacaaaagctgcatactatcgggatatacgggtcagaaaatgtaatatttaatattatgtatttgcaaatatgtttatgtaaattattgtcgtatgtattagatacaaataatagttaaataacggttaaatgttatacctttctttgttatttgaattaaaagtttattgttattgggcagctaataaaagtttttatatttt

SEQ ID NO: 16876 - DNA, 825 bp, Diabrotica virgifera
  misc_feature (123)..(142): n is a, c, g, or t
  misc_feature (212)..(231): n is a, c, g, or t
  misc_feature (278)..(290): n is a, c, g, or t
  misc_feature (292)..(307): n is a, c, g, or t
  misc_feature (379)..(420): n is a, c, g, or t
  misc_feature (428)..(451): n is a, c, g, or t
  misc_feature (476)..(511): n is a, c, g, or t
  misc_feature (662)..(731): n is a, c, g, or t
gcggtacgctacacaaatctctcgttttcccttttttaccataagtgaagagagattcttatgtcaagcgatagataactactattcgctgagagtatattttatttcttcataaaatcaacnnnnnnnnnnnnnnnnnnnncgtatcaggccactattaattaataactatcatacctattatcttcgattctaacagagctaaaacatgnnnnnnnnnnnnnnnnnnnncatactctccataatttctttggaatgaaatgctattcgtatttagnnnnnnnnnnnnngnnnnnnnnnnnnnnnngctttatctagttaacagatatatttatccttaaagatttttatatgatcaagataacatatttttagggcnnnnnnnnnnnnnnnnnnnnnnnnnnnnnnnnnnnnnnnnnncaaactcnnnnnnnnnnnnnnnnnnnnnnnncaaacatgtgattatctatttttgnnnnnnnnnnnnnnnnnnnnnnnnnnnnnnnnnnnngacaatatacctttaaattatttagatttagcaatgctgataatcagacaattacaagattgtctatgtagcaaaaatacataggtccactaaaggaattcggacacatttttttctcctggttattacaaaacatgccttttctgtattnnnnnnnnnnnnnnnnnnnnnnnnnnnnnnnnnnnnnnnnnnnnnnnnnnnnnnnnnnnnnnnnnnnnnntaatccttagtttctttatagaaagccggaatgaaggggtgcgcgcaccaaaacctgtctcttattacctttttaggcacaattctttcttaag

SEQ ID NO: 16877 - DNA, 748 bp, Diabrotica virgifera
gactgccgtaactctttgctctcatcccgaagatttccccgccgtataaactctgattgccgtagcaatatcgtacacggacaaacgtttaagtagctcccgattttgtgtttgaaaaaactaataaaactaaaaatgttcaccaagaaatttccaagaggaaatgagttgctgcttttgaatcaaaagatgctaaggaccttcaagagagcaacgacatcactgactatgttcccattgaacaactaaaagaagaaaacgataatgatacaatacaaattttgtaatggactggatttgttgaaggagcaattgttccataaccctgtgacagagtattccctatcttggttaattgttaaaagtaacagcgtcaatgatgacactttcctcagaacagaacgaacacctctaaatcctctttgtatattctcaacagacacttacttgcccacacttacttgtaagaataaacaatcactctagctgacactgtaatcgtgtgcaaccaattgaaggcctactaatatgaacttgataccccctttacaccatctattgctgatacttctacatggatcactacacttattatacagtaacgatacataactgtacttggatagataaaactttgcaagtgaggtgctcaatactggaactatagctgatgcaactgtaccaccaggaacccgcacgaccaaatgagataagatgcaagagactgatgcacatacacgtacagaaa

SEQ ID NO: 16878 - DNA, 147 bp, Diabrotica virgifera
  misc_feature (89)..(89): n is a, c, g, or t
  misc_feature (123)..(123): n is a, c, g, or t
ctagttatgatcgcgagtgtacttacataattgtttaaacaaaagagatccagccagagcaagcaaaactaacatacatagaacagcanaaagccactaattctaatttccattttccatccnatcataaattttttaggtattatg

SEQ ID NO: 16879 - DNA, 84 bp, Diabrotica virgifera
  misc_feature (2)..(29): n is a, c, g, or t
  misc_feature (32)..(78): n is a, c, g, or t
gnnnnnnnnnnnnnnnnnnnnnnnnnnnntgnnnnnnnnnnnnnnnnnnnnnnnnnnnnnnnnnnnnnnnnnnnnnnngataaa

SEQ ID NO: 16880 - DNA, 278 bp, Diabrotica virgifera
tatatgatatatctatataattttcgggattgtaaagttagctaataccagtttatatagagaaataaaaactttaaacaatagtataaggaacgctacggtatacgagatagaccagcgctccaactcctataagagagtttccagatgcctcctatagctatacatttatgattaaacattgatattatattcactccacatctgcgtcgaccagaactcaaaaacgaacatttattaaacacttcattaataatgaaaaaccaggacaaaatctt

SEQ ID NO: 16881 - DNA, 325 bp, Diabrotica virgifera
  misc_feature (7)..(20): n is a, c, g, or t
  misc_feature (22)..(34): n is a, c, g, or t
  misc_feature (69)..(93): n is a, c, g, or t
  misc_feature (107)..(143): n is a, c, g, or t
  misc_feature (185)..(244): n is a, c, g, or t
  misc_feature (299)..(321): n is a, c, g, or t
ctattcnnnnnnnnnnnnnncnnnnnnnnnnnnnaacaaaatataatctaataattatcattatattcnnnnnnnnnnnnnnnnnnnnnnnnnagcataaaagaacnnnnnnnnnnnnnnnnnnnnnnnnnnnnnnnnnnnnngtataaattatgacttatttttcaccaagttataaattagtnnnnnnnnnnnnnnnnnnnnnnnnnnnnnnnnnnnnnnnnnnnnnnnnnnnnnnnnnnnnctacatttacttatgatgataatattagacactaataatagtatatttagctcgnnnnnnnnnnnnnnnnnnnnnnnctcg

SEQ ID NO: 16882 - DNA, 1080 bp, Diabrotica virgifera
  misc_feature (994)..(1007): n is a, c, g, or t
  misc_feature (1009)..(1027): n is a, c, g, or t
caaaaagtcaataaaatcattttttaagttaaattgtcggttgtttcccggttagaatagtaaattacataaataccacaaagaaatagcttcagaaccacatttcgaaagcctcaatttacttggaggtggcgtctgtgagaatcctcgactcaactccgtacaacattataggaaagatataacatcgtagtaacctgatttttatgggtattgttaaatcatgacatttgaatatattagccattttttaaatgcagatcttgctttctctatcctatatttgatttctagggaatggtcccaatttgctttaaagttcctaccaaggtaggtgtatgtttttactctttctatttgttgaccgttcacactgattcgtccaaattgtttccttcaatgtgtctacttgtcaataaatttagtatccctctcatctcgtttcctgtgaacactgagcataaagggaggaccgcttaacctcgcatctcctatcattgagtgatttcacgtcttcacccgtcgtaaagtgctaaatgtgctttaaatgctacatgttgtggctggaatagttaaaagaattttgcttttttcacatcatcatcatctagccgttatcatccactgctgaacataggcctcccgtttctccacgtcttgagctaccatcatccaattcccggcgctctttatatcgtcactcaagcgcgttggtgatcgaccaactttccatcgaccattcttttttgctacatgttctatcgggtctttgatttttgttctttgtctgatagtattatttggtatccctgttctacttactgctgaggaaaatgcagtattcaaatgtgggaaactccagcaataaaattatggagaagggcctcggtaaagagcctggatatctttccgcaattgagagaaattctggtttggaatatttttcttataatttttctcggggaacaaaaaggaaaaacggttttcccccacnnnnnnnnnnnnnncnnnnnnnnnnnnnnnnnnnacccggaaagagggggggtaaaggtcttatattctcttaaaaaaatttttttt

SEQ ID NO: 16883 - DNA, 88 bp, Diabrotica virgifera
  misc_feature (5)..(83): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnacgag

SEQ ID NO: 16884 - DNA, 1002 bp, Diabrotica virgifera
  misc_feature (58)..(77): n is a, c, g, or t
  misc_feature (782)..(814): n is a, c, g, or t
  misc_feature (970)..(990): n is a, c, g, or t
caacgaccgggaaagttcttgtgtgtatcgttaacgttttctgttaagtagatcgtgnnnnnnnnnnnnnnnnnnnnctgaagtggactcagtaaacactaataatgctgtaaatgaagaaaatagtcaagaagaaaaaagttccaaaactaggaaatccaagtccaagtctcctagactaacaacaattgagagggctcgagaagaaagcgaagctattactaagggcttgggacctgaggttgaaggcaggcgcagaacgaggtcagcagctaaaggtgtgacagccactcctccacctccagctaagaaagaaagaaaaagttctagcacaactaaatcatcgagaggcaggccgaagagaactgtagaagaaagtagtgattcacatgatgaaaaatctgaaacctcagtagcagaaagtgaagaacaagcaaaaagtatcgatgaatccaaaagtgaagctgacactacagaaaccaattcacatgatgacaaagaagaatctggtaacaacaatgctgatgcttctaagtgtgaagatcaggcaatgagtgttgacgaaaagagtgaagctgatggtaatgaaactaattcacatgatgacaaggaggaatctgctaataataatgctgatgctaaggatgaagcagacgcagatgcagaggaatctactcctgcacctgctgccacagagaatggagcgaaagaggatagtgtagatgctcccgcctccgaagaagaacaagacaaagccgaaagagaatctaccagtgaagatnnnnnnnnnnnnnnnnnnnnnnnnnnnnnnnnngatgatgatgcagaagaacatgtgccacaagtagaagaaggcgatcacgatgagttataaaaatagtgtaaagtgaactaaagagactttttttatatattacaaggtgtgaaagtgttttgttccgatagtggtgtactgttcccttgaattgannnnnnnnnnnnnnnnnnnnnggatttacttcc

SEQ ID NO: 16885 - DNA, 389 bp, Diabrotica virgifera
  misc_feature (10)..(10): n is a, c, g, or t
  misc_feature (16)..(16): n is a, c, g, or t
ccttacgcgnccgagncattgatgaagcgttcccgctattcctttaagcaacatggcaactgaaaacgaacaaggagactgtcctgacgatttgcaatctcggcaacaaatgttttttcataacgacctaatctgggcccactaaagaattaacaaatagctacaaatttaacagtctacagaccatgttttctttttctttatggtaacaaacgctatcaacagaaatgacaccgcatgcaaggtaccccgcggtcaaccatacctaatatattaaaatccaaactaaataaatttaataaccagatagatatattcaattattactatacaatcataatatactaataccaagtatgtgcccaaaagagctcaaaaactaaaattta

SEQ ID NO: 16886 - DNA, 223 bp, Diabrotica virgifera
  misc_feature (17)..(46): n is a, c, g, or t
  misc_feature (55)..(68): n is a, c, g, or t
  misc_feature (70)..(175): n is a, c, g, or t
  misc_feature (177)..(209): n is a, c, g, or t
  misc_feature (215)..(215): n is a, c, g, or t
cggttattaaaaacacnnnnnnnnnnnnnnnnnnnnnnnnnnnnnncgcccacgnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnttttanaagacgag

SEQ ID NO: 16887 - DNA, 62 bp, Diabrotica virgifera
  misc_feature (4)..(49): n is a, c, g, or t
cggnnnnnnnnnnnnnnnnnnnnnnnnnnnnnnnnnnnnnnnnnnnnnnatttaaagagcta

SEQ ID NO: 16888 - DNA, 198 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (104)..(104): n is a, c, g, or t
  misc_feature (110)..(132): n is a, c, g, or t
  misc_feature (135)..(135): n is a, c, g, or t
  misc_feature (162)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntngtcgannnnnnnnnnnnnnnnnnnnnnnagnttaaaccggtgtgagccaggttggttnnnnnnnnnnnnnnnnnnnnnnnnnnnnnnngaaagg

SEQ ID NO: 16889 - DNA, 1187 bp, Diabrotica virgifera
  misc_feature (675)..(695): n is a, c, g, or t
  misc_feature (765)..(818): n is a, c, g, or t
  misc_feature (820)..(834): n is a, c, g, or t
  misc_feature (848)..(878): n is a, c, g, or t
  misc_feature (882)..(894): n is a, c, g, or t
  misc_feature (897)..(909): n is a, c, g, or t
  misc_feature (911)..(947): n is a, c, g, or t
  misc_feature (955)..(982): n is a, c, g, or t
  misc_feature (1000)..(1048): n is a, c, g, or t
  misc_feature (1050)..(1078): n is a, c, g, or t
  misc_feature (1092)..(1121): n is a, c, g, or t
  misc_feature (1125)..(1169): n is a, c, g, or t
  misc_feature (1172)..(1186): n is a, c, g, or t
tcgattaaataatattgtttattcggatgattatctgcgattgtgataataaggtaggtttgtaagagttgaaaatttctaagaattacctcaagatgatgcacggacccaaaccgtcgtatcgcaaacaatcacataaagttgagtataaggctagagcgagattttgtcgtccattgcttctggtaacaatcgatagtacaaacaaccgagaaaattgtaccacctgaggcgtcacttcaagatttcaggattttcttttttaacacaaagtaaaaatttcatttaacaaccaacattgattcactttttactattttctagattttaaaatgttaaaaataaaattgtagtcacgcattcaaataaaaagtctacataatagtaaaaaatgtcccccgaaagaacagatacgtaagctaaaaaatgaagaaaccaagataccatattagcaaacatctgacgaatgtttttaaatcccaaaagattagcaaacatatttttatttatctgtattggaaaaaaatttgtagctaatagggatactgggtctttgtcccttattattaaaatgtataaaacgccttccttttaaactactttgtattttatgtaacggtgcctgctacttttgggaaaaacatcctaaataaataccaataggggtttggttannnnnnnnnnnnnnnnnnnnngggggattgggggggaaaaagaaaatattcttttttggtgggaatggaatgggcccctgcccccccccannnnnnnnnnnnnnnnnnnnnnnnnnnnnnnnnnnnnnnnnnnnnnnnnnnnnncnnnnnnnnnnnnnnnaaattttgtgcccnnnnnnnnnnnnnnnnnnnnnnnnnnnnnnncaannnnnnnnnnnnntgnnnnnnnnnnnnnannnnnnnnnnnnnnnnnnnnnnnnnnnnnnnnnnnnnccctttcnnnnnnnnnnnnnnnnnnnnnnnnnnnnggttgggacggtttttgnnnnnnnnnnnnnnnnnnnnnnnnnnnnnnnnnnnnnnnnnnnnnnnnntnnnnnnnnnnnnnnnnnnnnnnnnnnnnngggggggagagaannnnnnnnnnnnnnnnnnnnnnnnnnnnnnctcnnnnnnnnnnnnnnnnnnnnnnnnnnnnnnnnnnnnnnnnnnnnncgnnnnnnnnnnnnnnnt

SEQ ID NO: 16890 - DNA, 564 bp, Diabrotica virgifera
  misc_feature (24)..(41): n is a, c, g, or t
  misc_feature (198)..(216): n is a, c, g, or t
ttttcaatatgtcattaacttttnnnnnnnnnnnnnnnnnngcatcattatttcattattaaaatgaatacaattgaaagagaccctaacaagcgaaaagttaagcctgtggatccaggagatcaaacatgtgttttagactttgatgaagaaagttctgatgacagcgattttagaattgaagatcatccagaagtnnnnnnnnnnnnnnnnnnntctttggacagtcaaggtgaaggtaatggtgctgaagttagcgaagataatgaagatgaatctgaagattccgatttagaaatgttaaaaggtgttggtcaacccaaaaccaatggtatggaaagatctgttgctgatgtgatagaacaagcagccaagtctaaattgaagtttaatgaaaaggacgcgcagataatgatctgttgtggatgccttggagaccaaagtgatggagtaaatgagattgttgaatggtgatgttgtggagtcactgtacatgaagcttgttatggtgtttctgattctaacagtgtatccagtactgactcactgtcaccaaacactcct

SEQ ID NO: 16891 - DNA, 881 bp, Diabrotica virgifera
  misc_feature (3)..(16): n is a, c, g, or t
  misc_feature (21)..(569): n is a, c, g, or t
  misc_feature (576)..(613): n is a, c, g, or t
  misc_feature (633)..(646): n is a, c, g, or t
  misc_feature (649)..(671): n is a, c, g, or t
  misc_feature (679)..(701): n is a, c, g, or t
  misc_feature (731)..(762): n is a, c, g, or t
  misc_feature (771)..(804): n is a, c, g, or t
  misc_feature (806)..(880): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggacnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnng

SEQ ID NO: 16892 - DNA, 904 bp, Diabrotica virgifera
  misc_feature (521)..(541): n is a, c, g, or t
  misc_feature (780)..(780): n is a, c, g, or t
  misc_feature (839)..(839): n is a, c, g, or t
  misc_feature (870)..(870): n is a, c, g, or t
ataaagtgtttgatgattaacctcaagaagttattaaaaaatatgtgtattgtaccaaaatgacgaagcttatattattcgtgagtgttattttagcagctgcagtttcgagcgacgcaggcattattcaagatattctgggctctgttaactcaaagtatgacttcattgttataggagcaggatctgcgggtagtgtggtagcaaaccgactcgtcagctaacccgaactggacagttctagctcttgaagctggtatcaatgaaaactttttaaacgacattcccatcaccgcttggtttcagtcaaaatacccctacgactgggggtttaaaactgaaaaacagccaaacgcatggtctgagtaccattgatggaacatggctgatagctaatggaaaggccgttggtggaacgtctgttaccaattttatggtctataacaggggaaataaagaagattataacgaatgggctgctttaggaaacaatggctggagttacgacgacgttctgcccnnnnnnnnnnnnnnnnnnnnnattgtgaaaatggtacgatattgatgcaggttatcacagtaatgacggacccttgaacatagaacctcctggctgggaatcccccttagtggacttgtttataaaagctggagaagaacttggctattctcaaaacgatccggatggcaaagaacaattggggtttttctaaaattagaggcactgaaagacgaggacgaagatgtagcactgcaacagcttttattaagccctattanatagatctaattttaatcttcagtctggtgccagagtcaccaaatcttaatcgatcccnacacccagaagctcacggagtagatatatanaatatgggatcaaacatacagtccatgctaggaa

SEQ ID NO: 16893 - DNA, 322 bp, Diabrotica virgifera
  misc_feature (2)..(14): n is a, c, g, or t
  misc_feature (17)..(126): n is a, c, g, or t
  misc_feature (134)..(287): n is a, c, g, or t
  misc_feature (296)..(296): n is a, c, g, or t
  misc_feature (300)..(300): n is a, c, g, or t
  misc_feature (303)..(303): n is a, c, g, or t
  misc_feature (305)..(305): n is a, c, g, or t
gnnnnnnnnnnnnncgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaattnattnaantngggggtgataaaaaata

SEQ ID NO: 16894 - DNA, 501 bp, Diabrotica virgifera
  misc_feature (87)..(108): n is a, c, g, or t
cggacgcgtgggcgacccacgcttcccccatgttagcattaaaacattatgaaaacacttaactgacttatatgctacgaaaacagnnnnnnnnnnnnnnnnnnnnnngatgtaatgtaacccaattaagtctaatatgtacaaaggagtaatattaaatattcgcttacctataagactaacctcacataccttcagtttactaaagcaatactaatgtgaactaaacttcactggtcccagcactacctaagtcaatatgacatactcaactgcttcacctccacatcttgtacatatacagcacatagttgcgattccttcgtctaagctatttcctctcaagtcgatgccgacctcagcttggtaatttactcctttcaaccactattcccaaatatgaaagttctatttgaacaaatcactatagttaattacgtcactatgtgatgtatacatctatgcatgtctatgtcatattaccagcctctattagaaacc

SEQ ID NO: 16895 - DNA, 894 bp, Diabrotica virgifera
  misc_feature (871)..(871): n is a, c, g, or t
taaatgcaacaaataaacaaagaaaattagtaataaattttacaaaaaaacacacaaacacaaaatacaatattttagtgaagacaattaaacactacttttgtatgtaaatgtaacaatgtaacaaataaagaacgaaacataatttatcagtaatacattttgcaaaaaaacatgttggaaaaagttagaagctacttttaataaaatatttctaatatttaattacataaggtgttcaaaattatctcctaacacatttatgtacgcctaaaacgatcattgaatgagctacttactctacggagcatttgtaaattaacacatcgaaatacactttgtattctatttttcatctcatcccttgttgttggaggtattttataaacttcattattaacgtaaccccaaaaaaatcagtccagtttattaaattctggtgattttggtggccacgctactggtccattgaaaaatgaaaatgttttgaaaactgataaatttggacatatggaatggttatctaaaaggtaaggtgcggtaatggtgcttttcaatggtgatataaggtgcggggtgttccatttaaaattactgagaggataatggtacttgcgttttgactcaccctgtatttgatatgggggaaaattggcaatatcgaccattcttgaaaattttgacaatacgttaaaggatatggcattaatagaccattggtgttttgcttatttttatgtttatacagggagttgaacttgttgcgattttcatataaaaaattggttataactttgtaaatgccctgtatagcatgacaagcctttgtatttttgtgatggagaggtaacaggatttcgaatttaaaggnaattatagggtggtccatttaaa

SEQ ID NO: 16896 - DNA, 908 bp, Diabrotica virgifera
  misc_feature (625)..(644): n is a, c, g, or t
  misc_feature (869)..(869): n is a, c, g, or t
aaaccgaaaagttactaatatatttgcaaaaataattttgctatttaaaagatgtccattactcccattagtttcagatagatgtaaatagaagttaatttttttgtactatggaagcaacactgaccttttctgtttgctatagaacaccagaaggttttcttacggaacaatttgaacagttagagtatgacactgtagaaaatctaaaaattagtatccaccaaatttttggcattccaccgcatagacaaataattgatggatggagaactgaacccgaaaacgatcagtctttactccaaatatgtacagatttaggacgtacaaattacttgtttttaagatgtagacaggaggaatcaattccaactgacagctctttcaatgctcaggaaaatgaaagagattgtatggaaatcagagcagtaaaaagttgtataagaaaaattagtacccacataactgcgtcaagcgtaaggtttaatatgggaaaactatccaatattaaagatactgtacttcttgctcctcctctaaatcgaaagtttgtagtgttatatatgcacaattcgagggaggaattttcaactacatttttgacaagatatttgcgagacgaagnnnnnnnnnnnnnnnnnnnngactacttttgtattattggatgggatgtagaaaacagagcttatcactcggcgctttgtaaagctgtagaagatgctaacttcggtaatctatctgcattgattcagtctgaagattgcgcagcagttattattcaaaatataaatggcttccccaatattatttcatttttaattggagacgaagtagattcgagccgtgattcattttttatatgtctacanaattgtcgcgactatttaaattgtcgatcgcatggtagc

SEQ ID NO: 16897 - DNA, 875 bp, Diabrotica virgifera
cccacgcgtccggtgaaaacgacgatgacaacagtgaattgagtgagcacagatttttaaccaaaggcgccttcctgctcaccccctcgcacgacctaagtctagacaaggctgccaacatttgcgacaaactcaacttccgaggaagtttcagtttgactaaaacggccacgggcatattgtttaaattttcagagcccgaggacttccagcaagttttcaggaagggatttcataaggtaactggtggaagattatatagaaaagtggcgatcccttgcagacctcaaaaaactttctcgttgttggtatacgaggtaccatctgatcttccagaagatgatataagggctagtctttatagatattgctctgtggtcgaagttactaggcttccaggtcgtctagaccaatctccaggagcccctcctccaattcgcataacagtagcctccttggacgaatacaacgctctgctccagcaaggcctagacttctacggggccacgtacttccctacagagccgctgaaaaaggaccaattgaatcaacttagaggcagcaaggagaaacttctgccagtgttcgactccgccggattctccaggatccccccaccaccgacgagaactctgaagccgatacggtcatgaaaattacagaaatcctggctggttgaactcgtatataccgctttttacttaaaataaagaaaattagcgaaacgtggcaacgcggtaatgtctcatttactttttgtacttctaggaacggtttattcattaaaagtttgtatgtaatgtaaccctgtaaagttagtttaattaaattcggaaagatccttaaaggtcagcgtggtttacttgtacgaatat

SEQ ID NO: 16898 - DNA, 907 bp, Diabrotica virgifera
  misc_feature (810)..(810): n is a, c, g, or t
  misc_feature (818)..(818): n is a, c, g, or t
  misc_feature (880)..(880): n is a, c, g, or t
  misc_feature (895)..(895): n is a, c, g, or t
attccatcgaatattcgcttgtctgatccaaatttcaacattccttccggcatagatcttctcataggtgtagagcttttctgggatcttctgtgcgttggacaaatcaaattgggtactcagaaacccattttacaaaaaaccaaatttggctgggtactttctggcccactgcccaaaaggtatgatcatcaaatcgtcacttgcaatttcgcacagcagaatgaatgtcatcatctatcaagattctgggaaatagaagagtgtccacttctcccacctctttcaaaggaggaaatagagtgcgaggaacactttaaatcgactcataaaagaaattcggatggtcgttttgtagtcagtcttccattaaagaattcgactgatactctgggtgaatctaggagcagagctggaaaaagattctttaatctagaacgaaaacttccgaataatcctatcatgaaagatatgtatgtttcatttatggacgaatatatttcaatgggtcatatgtctaaggttgaggagcctacagaccaagctcacttctatcttccacaccatggagtccttaaggagaatagtctcactactcagctgcgtgtagtgttcgatggttcttgccctaccacttcaggtgtttcagttaacgatcttcaaatgggtcggaccagtcgtccaaaatgatcttatatcaattctatttcgatttaggcaacacacttatgtggcttctgctgacatcgccaaaatgtatcggcaaattctcgtttgtccttctgaacgaaacctccagctaattctatnggagacgngatcctcaggagccttttgcaacttattctctgaacacggtaacttacggcactgcctctgncagctttcttgctancagatgcctgct

SEQ ID NO: 16899 - DNA, 680 bp, Diabrotica virgifera
  misc_feature (289)..(313): n is a, c, g, or t
actaagcgtaaagatattggcactttatacgttattttcgacatctgagcaggaatggcaggcacttcattaaaaattttagtacgagcagaagtaggaagcgcccggatctttaattggaaaagaccaaatttataatggtatcgatacagctcatgcatttatgataactgtttttataggtatacctattataattgctgagtttggaaattgacttgcacccttaatacttggcgctcccgccatagcatatccactccaacaaataatataccactttgattgnnnnnnnnnnnnnnnnnnnnnnnnngattacgaacgctgggacaaaggagggctccgggaccgcttggaacagctcacccggctctgacctcacatattgcccatgtggggccctccctagatctacctatctttagattgcatttagctgctcttccatctattctaggagcaactaattttattactccagtaactaatatacgaccaactaggaatgacttttgatccactacgcctatgtgaccgagctgacgcagttactccagtccttcttctactatctttaccagcatgagctggagctatgacaatatgatgaacagatcgagatttaaatacatcgttttttgatgccagctgatggaggttatcctattctctatcaacat

SEQ ID NO: 16900 - DNA, 137 bp, Diabrotica virgifera
  misc_feature (2)..(84): n is a, c, g, or t
  misc_feature (97)..(136): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnaagacgagagacnnnnnnnnnnnnnnnnnnnnnnnnnnnnnnnnnnnnnnnng

SEQ ID NO: 16901 - DNA, 645 bp, Diabrotica virgifera
  misc_feature (445)..(463): n is a, c, g, or t
ataaggttaagggggggtggggtgctgtggaagaaacaaataagcattttccggatgtaggcgtatataattgattaaaacaacaataggacgggccacactgtaaaatataacaaagaaatagaagcaactacttacttagtcttagtgagtgcctaaatgttcaaatcgtttatatacatttaactgattagttcaaatagcaacagatttaactgttttagacttttatttgtgggaaagattaaagaccttgtttttgccgctaggctcactactcgagaaaacattatctagaatctagagaatacgaaacgccattcaaagcattgcgaaagcagaaattgagactgctgttcactctactcttgaaagagtaaatgcttgaatcgaaaatgataggcagcgatttgaacatttaagtcgtcactaagtgagtggttgnnnnnnnnnnnnnnnnnnntttgtagtgttgtttgtcttgttgttgttttgattaattgtttacgtttgcgtctggagggtgtttctttgttttttccatagcacactacttttccttaacttcgtttaccggtgacattaacagttgtttgaaagttacacggttcttgatctataaaaggtatctacatgcggttttcg

SEQ ID NO: 16902 - DNA, 140 bp, Diabrotica virgifera
  misc_feature (7)..(94): n is a, c, g, or t
  misc_feature (104)..(139): n is a, c, g, or t
taatcannnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcnnnnnnnnnnnnnnnnnnnnnnnnnnnnnnnnnnnng

SEQ ID NO: 16903 - DNA, 945 bp, Diabrotica virgifera
ctcctcgcgtccgcccatttgaactgaatctaattataaaactgttaacattagtttatcctgataagggttcaatacttcgttcaattattttgaaatttattcaattctgtagtgaagatgggagacactggtatcgataaagtttgtaatgacttccacagtttggaggtcgaagaaacttttgaagatgctttggatggtcaatgccttggacgcaccaggaatggtaaatctgaatctgatgaaggagatgcacaaggaacagatggaaaaacgtctggtgaaaaagatgcaagaatgccagtgcacaaaaattccccttattacaacatggaccatcctaaaagaggtatggcccttattttcaatcatgaattcttcgacgatgaagacctactaactagaagaggtactaacgaagactgcagaaacctcaaagagtgccttattgctttgggctttgatgtgcaggttttcaaggatttagataatcgggatattgaacaacatattgatgacactgccaaaatcgatcataacaaatatgattgtctgttaatttctgttctgtcccatggtgacttgggaatagtacatgcaaaagatggaccgtataagcctgaaacactttggacaccttttactgcagacaagtgtcccagccttgcaggaaaaccgaaaatattcttcttgcaagcctgtcgaggtaggcaattcgaatagtgggatcatattgaaaaaaactgaaactgatggagagcagacttcttaaaaaattccagttgaagctgacttcctcatagtatatcttacagcgatttggttatttttcatggcgtaatcccgttaaaggttcctggttcatccaatcactttgtgacgagctgaagaaaaaagcttttgagctggacctctaaagtattctgaccttcgtctctaaac

SEQ ID NO: 16904 - DNA, 222 bp, Diabrotica virgifera; identical to SEQ ID NO: 7599
  misc_feature (6)..(28): n is a, c, g, or t

SEQ ID NO: 16905 - DNA, 363 bp, Diabrotica virgifera
  misc_feature (6)..(25): n is a, c, g, or t
  misc_feature (167)..(187): n is a, c, g, or t
  misc_feature (189)..(206): n is a, c, g, or t
atgagnnnnnnnnnnnnnnnnnnnncattttctaaattaacagtgattttatgtgtataatatatatggagaattatatgttgtaaagaattgtttgggccgtgcaatgaaagacgcatttacttagaacaaatttaataatagatagaccataattatttatcaannnnnnnnnnnnnnnnnnnnncnnnnnnnnnnnnnnnnnnaagtagcttcaggtatgacattatgaacaacatcttattaaaagaaaatttttgaataaaaattatgaataataaagattatatttcaaaagatgtatacatttattgttatttaatattattaagatttttaatacgaataaaatttaaatataga

SEQ ID NO: 16906 - DNA, 284 bp, Diabrotica virgifera
  misc_feature (7)..(31): n is a, c, g, or t
  misc_feature (37)..(38): n is a, c, g, or t
  misc_feature (42)..(96): n is a, c, g, or t
  misc_feature (108)..(108): n is a, c, g, or t
  misc_feature (112)..(112): n is a, c, g, or t
  misc_feature (118)..(118): n is a, c, g, or t
  misc_feature (131)..(175): n is a, c, g, or t
  misc_feature (181)..(182): n is a, c, g, or t
  misc_feature (190)..(209): n is a, c, g, or t
  misc_feature (211)..(211): n is a, c, g, or t
  misc_feature (214)..(228): n is a, c, g, or t
  misc_feature (230)..(283): n is a, c, g, or t
taatcannnnnnnnnnnnnnnnnnnnnnnnntggaanngggnnnnnnnnnnnnnnnnnnnnnnnnnnnnnnnnnnnnnnnnnnnnnnnnnnnnnnngtaaaagcttanattnttttanaagacgagagacnnnnnnnnnnnnnnnnnnnnnnnnnnnnnnnnnnnnnnnnnnnnntaattnnattatatnnnnnnnnnnnnnnnnnnnntnggnnnnnnnnnnnnnnncnnnnnnnnnnnnnnnnnnnnnnnnnnnnnnnnnnnnnnnnnnnnnnnnnnnnnng

SEQ ID NO: 16907 - DNA, 449 bp, Diabrotica virgifera
gggaaatgtctgttacacccctgacccattcaccttcaaaaacgaattacacgaaacgcataagaaaaaatgggaaatgtctgttacacccctgacccattcaccaacacaattgtgtttgtagaaatctatatgactcttataaattattaaacaccaagatgtgcaaaataaactgactcgtcaaccatggatgtaaaagacatttaataggccgcgtgacatgtctactcataactgctacgacttcctttgaatctgaaaaggatatgctagatgcgtgttttaccagaatgtatatcaatacagacaaatgcacgacacgactatataatatctgtcggctgtttagttatcacaacaaaaaatatgatcattgatcattctcagcctacagaaaaaggatacctaaaaaccgatatgtcaatactcatatttattaacatcac

SEQ ID NO: 16908 - DNA, 61 bp, Diabrotica virgifera
  misc_feature (2)..(19): n is a, c, g, or t
  misc_feature (34)..(55): n is a, c, g, or t
gnnnnnnnnnnnnnnnnnngcgaccgttttaagnnnnnnnnnnnnnnnnnnnnnngataat

SEQ ID NO: 16909 - DNA, 956 bp, Diabrotica virgifera
  misc_feature (133)..(150): n is a, c, g, or t
  misc_feature (451)..(481): n is a, c, g, or t
agccagttaaactgcggggacaataaatataagacacccagcaagtcttcttttgcatggatagaactggatccttcagtgttcacaaatatcactgcagaagacctaaaagcttttgaaaaaagcttacatnnnnnnnnnnnnnnnnnntttcagtttgatgagagcatacattttaaaataccagagacacctgtaacacaaacgacgcaaaaagaaactaaagtcatggagctggaagatttaatagatacaagcattttggcagacttttccgatacagcagcaactacagcaaccaatactacagcaacttttatgccacctaagtcactaaataacttattaaataaatacagcacttccttaatagacgagaacttgcaatttcctccaccaactgatactcaacattcagaatacaataacaagagtacgttagaagttattnnnnnnnnnnnnnnnnnnnnnnnnnnnnnnncgaaggatattttagattttttcaaattagaaacattggaagacgttttcgagacgaatattcctgattctcaggccactataacatattcccctgatatttttgacataactaatacagcaaatacaaatgttattatagaagacgatataagtgaagactcaaattcaccgataatatgttcttacttcaacaaaaagaagaatgtcacgataagaaattcgcaaatagaggccacgtattcccaaagtttgagcagtactcctttaacacgtaaaacagaaaaaaatatcgataaattatcccaaagttcaaacaaactatgtggcaacactggagatccaaagaaaactccgcctgaagacttaacgactttctcgacttttctttctttgcatcacagtctagtaaaaaaatggaaacagtgtaaaagcaaggaatcattaattacctgatagtgtaccacatcgatttt

SEQ ID NO: 16910 - DNA, 523 bp, Diabrotica virgifera
  misc_feature (2)..(61): n is a, c, g, or t
  misc_feature (63)..(90): n is a, c, g, or t
  misc_feature (99)..(157): n is a, c, g, or t
  misc_feature (164)..(196): n is a, c, g, or t
  misc_feature (198)..(247): n is a, c, g, or t
  misc_feature (261)..(333): n is a, c, g, or t
  misc_feature (337)..(351): n is a, c, g, or t
  misc_feature (353)..(400): n is a, c, g, or t
  misc_feature (405)..(438): n is a, c, g, or t
  misc_feature (491)..(508): n is a, c, g, or t
gnnnnnnnnnnnnnnnnnnnnnnnnnnnnnnnnnnnnnnnnnnnnnnnnnnnnnnnnnnnnannnnnnnnnnnnnnnnnnnnnnnnnnnnaccgaggcnnnnnnnnnnnnnnnnnnnnnnnnnnnnnnnnnnnnnnnnnnnnnnnnnnnnnnnnnnnagtttgnnnnnnnnnnnnnnnnnnnnnnnnnnnnnnnnngnnnnnnnnnnnnnnnnnnnnnnnnnnnnnnnnnnnnnnnnnnnnnnnnnnaaccctatagaggnnnnnnnnnnnnnnnnnnnnnnnnnnnnnnnnnnnnnnnnnnnnnnnnnnnnnnnnnnnnnnnnnnnnnnnnngggnnnnnnnnnnnnnnncnnnnnnnnnnnnnnnnnnnnnnnnnnnnnnnnnnnnnnnnnnnnnnnnccccnnnnnnnnnnnnnnnnnnnnnnnnnnnnnnnnnncttaagggaaaaacccgctctaatttttatttgggaaaaggtcaaaaaccccnnnnnnnnnnnnnnnnnncgcccccccccatat

SEQ ID NO: 16911 - DNA, 872 bp, Diabrotica virgifera
  misc_feature (446)..(464): n is a, c, g, or t
  misc_feature (819)..(819): n is a, c, g, or t
gttaaatgaattaaaaacatgatcggaagtaaagtatttaatactagttttaaaacaacaacgaattagtgttattcgtaaatttagttctcaaattaatattgaaaaattagaagaggaatctactttaagtcccagtgattttataagtgatgaagcaaaagctagagatgctataatcgaacaaaaacgaaacaaatctcgtcttagagaacaggatagaagcatattaatgaataaaaatccttaccctgagccgtgcgcttcccatcacggttccttgaaatatcttagacgtacctatggacattatggagaagcttcaggagtaaatccttctctctgttggcctgtaaaagaagaattagatagttcaaaagaatacgaaagccttaagcatccatatactataccagaaatgattgccgaagcagcaaagttaaggnnnnnnnnnnnnnnnnnnnttgctataagacaggaggaaattgttaagaaaatgcaaaaattagaaggatggaaacaggatttattcaacagaatagccaaaaaggaagctgaagcaagatcagtaaagattccttgcaaacatatcttctgtctagcatggtggtaaacaagaacagaaacagtgtccccgatgtttagaaaaagttacaagagtggaacaaactggactagggactgtatttatgtgtactcatggtggtacacgttacggtcaaaagtgggtgtcgtaaaacttatctgtcacaacgcgatctacaagcacacattaaccaccgacacgtgtctaatttatcgttaatgctcaccaatggnagtagttgaacccgaaagaactttacctgtgcgtactaaactggcacgatcag

SEQ ID NO: 16912 - DNA, 111 bp, Diabrotica virgifera
  misc_feature (7)..(92): n is a, c, g, or t
  misc_feature (98)..(98): n is a, c, g, or t
tttttannnnnnnnnnnnnnnnnnnnnnnnnnnnnnnnnnnnnnnnnnnnnnnnnnnnnnnnnnnnnnnnnnnnnnnnnnnnnnnnnnnnnnatattnttagggatgagct

SEQ ID NO: 16913 - DNA, 925 bp, Diabrotica virgifera
  misc_feature (740)..(740): n is a, c, g, or t
aaaacaagtccccgatcaagataaaataaaaatggttgggatttgataacatttcagattttatgaaggatggttttaaaacattaatggaagccataaaacactcaaatagtctaccacaggggtctgactcggaacttttatcacgctcatcgagacctttaacaaaataatgaacgaagaaagtggtaaagttcttaaacaaataaatggtatattaagaactaatcatatagaaggaaatgttcgtaatagatgtctagaagaaaaaacagatttgatagtagaaggtaatgataacattcttgaaagggtagcaaacgatattgatgaaatggaatggtattaagaaagcaggagttgcaccagttttaatacaaaatggttagtgctcggagttaccaattaatggatctcggaacagatttaatgatgttaaattttctggtaacacctacaataactccacaggttaatttacaagaccctaagaacactcgttacattaattgctgcaaaaaatggtaattagaccacaaaaattctttagggataaaattattaatagtagtaaatttccttggggaaccaaggattaaaatcaaacctaattcaataaaacctttagccatctttctggaagagactggaaaacggagaggaattttctcatccttatgaatttgaatgggacagattcacaccatggccaatacagttaaagaaagaaaatcctttanaaccactacctggtggagagacacccttaatagaaattacagaagagggacattgggatggattggtagaaactttattaaactggtcaagaattggctggtagacgtcgaacatcattcatatagaacttttatggggtattacttggtctggtgcaaatttctactagagagaaaagatatat

SEQ ID NO: 16914 - DNA, 195 bp, Diabrotica virgifera
  misc_feature (8)..(98): n is a, c, g, or t
  misc_feature (100)..(144): n is a, c, g, or t
  misc_feature (157)..(157): n is a, c, g, or t
  misc_feature (167)..(192): n is a, c, g, or t
gccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnngtaacaagcttanattcttttannnnnnnnnnnnnnnnnnnnnnnnnnatc

SEQ ID NO: 16915 - DNA, 608 bp, Diabrotica virgifera
tatccccggagcggactgatttcttatgttatgttagttgaccgcatcttatatgtattcacatgccgcgagaaccagatcgcggatgccgaccttggatgcggcggactgattgcatactcgctagtggacatgatcgccaaggaagatgtgttcgatcgcaacctaaccttacccgtccgccttttggagatcacgcccatgatgagtgaggtaaagtatgtcgcactggagctcgccgattgctcccttcctgttttaatagaagacgttccaagtgctgatgcagatggactatttaacgacgactccgctgccttcctggtgggcgccatggccaggaaagtgggaatggaacgaaacgatttactcgcctgccatcgtcgaatgcttagatgaacaagttgaagatgtaaacaaacacgacataaaaagatgttgaatgattaatacttggatgtccggccgacacgagtgctctagtttgttcaaattaatactccctccattcctgaagatcatttcacagctatgaccagattgtacctatatagagatagggaggaaagtgtattttttaatctattttattaaagaattctttttgt

SEQ ID NO: 16916 - DNA, 784 bp, Diabrotica virgifera
  misc_feature (503)..(528): n is a, c, g, or t
  misc_feature (684)..(737): n is a, c, g, or t
atccatcaccatgacaaatgtactttctctataccaagtcaagagagattttaataaccccgagccggttaatatcgtgagaaaatatatttatacctcatcatatatctattatttgctcgcaccttgcgtatcacggattattaactgataatcatagatctgttatctttctacacctactagagacgacgaatacagacacttagagatctatgtacttgcgaaacccaaaccatattctcaatcacaatcttctctgtctcgttattcgaatatgtccatctccgtgttttgagcgatgatcataagttttgttcagcaaaagtaaactcacacgtatatgtctactctattccacattatttataattacatatctttagatgatccatatgaaatatttttagacatgtcctcagacatcctgtgtttattacaagtcaatttttaagataaaagataacgattagaaaatatcttcctattctacaatatagtcnnnnnnnnnnnnnnnnnnnnnnnnnncttattcttcataaaatatttattcagatataactttgatttactctgaacatcacaatggacgattatattagtattacactcccgcctatcctaaacaaaatatctcggctatctacagacattccccaacatttttttgcacctgtttattcnnnnnnnnnnnnnnnnnnnnnnnnnnnnnnnnnnnnnnnnnnnnnnnnnnnnnncaatgctcgcgctattttgtccgggctacggtagtgtaatcattagt

SEQ ID NO: 16917 - DNA, 796 bp, Diabrotica virgifera
  misc_feature (7)..(20): n is a, c, g, or t
  misc_feature (22)..(64): n is a, c, g, or t
  misc_feature (72)..(152): n is a, c, g, or t
  misc_feature (155)..(185): n is a, c, g, or t
  misc_feature (197)..(385): n is a, c, g, or t
  misc_feature (389)..(559): n is a, c, g, or t
  misc_feature (561)..(748): n is a, c, g, or t
  misc_feature (761)..(761): n is a, c, g, or t
taacggnnnnnnnnnnnnnncnnnnnnnnnnnnnnnnnnnnnnnnnnnnnnnnnnnnnnnnnnnggacctcnnnnnnnnnnnnnnnnnnnnnnnnnnnnnnnnnnnnnnnnnnnnnnnnnnnnnnnnnnnnnnnnnnnnnnnnnnnnnnnnntcnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcttanatttttttaaagacgagagaccctatagagtttat

SEQ ID NO: 16918 - DNA, 238 bp, Diabrotica virgifera; identical to SEQ ID NO: 14564
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t

SEQ ID NO: 16919 - DNA, 110 bp, Diabrotica virgifera
  misc_feature (27)..(27): n is a, c, g, or t
gcataataacgttaaatctttaagatncaaatttcaagatgctgaagcctggctacgtccctgggctactttagagcagttagccaagtagtaagtaaccaaactcacac

SEQ ID NO: 16920 - DNA, 965 bp, Diabrotica virgifera
  misc_feature (674)..(693): n is a, c, g, or t
  misc_feature (802)..(802): n is a, c, g, or t
  misc_feature (874)..(874): n is a, c, g, or t
ggattataacggcattattacattgtatcttatataactgtatttatacttgattttcattacttgccaaaatattaataattaccaacaatattattatcgtgtataatcaataaaatacatcatttaatattttaaggctaaaaatgacaaatgcatctaccaatttctattatttaatagaaataaagaaaaataataaagaaccacagaaataagctttcaagtagaaatttaaataggatcaagtatatttcttaacatacaagactataaaaaatacaacactaaggcccggtcttttccttttcacctccggataaatagttaacgggaagtttatctgacagataaaaaaagtagcgtcttttcactctggaataaagttatccggcagataaattgacgttaaatatcaaatatttaactgccgaataagaagttatctgggagataaactttgattttcgtatatttcatggtttctgattaccaggaaactaaaaatataacctaaaatcttgagggtctgattgaatttattgcaaaagtaaaattttgttctttctaaaaattctcaatcacaaattttatgttattttgtttttatacatacctacctactgtaattttttaagcagagttattagatattatattaaagatgggttatnnnnnnnnnnnnnnnnnnnnggtatgtattattgtatacctacccaactatattcatttacaaaggaaaacaagttgtaaaaaataaaaatagaatagtttcttatcccatcatttctttgaattgccnaatattttacgattccaaaatgaaaggtattgatatatgtaggtagtaactagaattatgtatgcacatggntctcagaaacagtagatgatacctaccttgaaaaaaaaagctgctggtaagtatccaaaacatactggggtgtatcatgaaattctaaaaa

SEQ ID NO: 16921 - DNA, 842 bp, Diabrotica virgifera
  misc_feature (545)..(545): n is a, c, g, or t
  misc_feature (673)..(673): n is a, c, g, or t
  misc_feature (704)..(704): n is a, c, g, or t
gatctaacctcaaaaatttttaacgatctaaatctaaaaccatttttaaaacagaagcaaacaaaggatatttcagtgttttaaataacagatcaaaaatggctgacttttcggagctcctgcaagaagctgaaaagctcacaaatgaacttggaggaagccaagatcttccaaaagtagagaggtccatacgacaagtgttagaagcgtccaccgatttgtactccagagttgcccaaactcggagccaaagatattcaagccaatcttctggttaggtgccaaaggagtggatcttcccaaaattcgcccagaagctcgaatcactcagtactaagagaacatttgaaccaatcctcccagttacagatttagatatctacaatactttagaaaacgaaaccagaacccagatactctcaatttttgattcaggttataataagatgttatcgtttacctaagacatggcatgggaacaccaacagtctgagtggaaacaagaaaaaaggaagattctaaatgctatgagtacgtcttccggngcagccattggagtaggtacaaataaacatttaactataaatctcgatcgtcctacttatggccgcaggtaatctctggtcctttggagactaatatatgtatctaagataatggaatataaacaagncgttagcagaagtgctcagaaacaaatctcngtaatatattctggtcaatggtgaatgattttaaagatcaaaaagtacagatatgtggggaattatcaaatatatgactcaacttcccacttcttcaaaaacagatgatcctattaaaacaagaaatactaatacttt

SEQ ID NO: 16922 - DNA, 106 bp, Diabrotica virgifera
  misc_feature (8)..(8): n is a, c, g, or t
  misc_feature (18)..(18): n is a, c, g, or t
  misc_feature (28)..(105): n is a, c, g, or t
aagcttanatttttttanaagacgagannnnnnnnnnnnnnnnnnnnnnnnnnnnnnnnnnnnnnnnnnnnnnnnnnnnnnnnnnnnnnnnnnnnnnnnnnnnnng

SEQ ID NO: 16923 - DNA, 62 bp, Diabrotica virgifera
  misc_feature (5)..(59): n is a, c, g, or t
aagcnnnnnnnnnnnnnnnnnnnnnnnnnnnnnnnnnnnnnnnnnnnnnnnnnnnnnnntag

SEQ ID NO: 16924 - DNA, 75 bp, Diabrotica virgifera
  misc_feature (5)..(47): n is a, c, g, or t
  misc_feature (49)..(66): n is a, c, g, or t
ggggnnnnnnnnnnnnnnnnnnnnnnnnnnnnnnnnnnnnnnnnnnnannnnnnnnnnnnnnnnnncgttattta

SEQ ID NO: 16925 - DNA, 921 bp, Diabrotica virgifera
  misc_feature (764)..(785): n is a, c, g, or t
  misc_feature (860)..(861): n is a, c, g, or t
  misc_feature (871)..(871): n is a, c, g, or t
  misc_feature (894)..(894): n is a, c, g, or t
ttcgatattctggcagctcttctaaaaagatccatttcggtagtaagcagcttattttcggatttttttgtcatttgccacgcttcggagccaaacgttaaaattgatttcagaatagcgtcgtacatcctcatttttgtatttaaggttatgttatgttgccacaagacagggtttagggctctagtaacctttctagccttcgtcactcttatcatctatactgggttccgttcttccactatttgttaacttcatccctagatctttgtaagaacatacctcttctaattgctcattatgtaagaccaatttttttctagattgtatgtaattatgtagaattatagaaaaataaaacgtaaatacctgtggtaatggcgatactagtgttgaacttgatggtagaatattattggatagggacttctttctttcagtatgagaattttagttctttaacaatgtctctaattagagaaatcactttaggtcgatattctaatacatatattgctcgagcgttattggactctaattaaaaattatactcaatattatttctcacgaaatttatctaaaacataaatctaaaccataccaaatgatctaaaccagaaacatcatacataaaaatcgtagttggatatttggtgcaattaaagactgttttatatataaagaaaacttaaaataaccgtttatcttaatttgtaaacctatattttaaaagccattaagtgaaaaaggaatgttcgatccgnnnnnnnnnnnnnnnnnnnnnntaggtttaaattttttgacttcctgtatagaaaagaaggttcgaggcatttctttttacacttacacttatgtgnntaaattattnacagtacttttttccattaattngcatatgatgccttttttgtaagctag

SEQ ID NO: 16926 - DNA, 838 bp, Diabrotica virgifera
  misc_feature (538)..(553): n is a, c, g, or t
  misc_feature (609)..(631): n is a, c, g, or t
agaaatcctgttttcggccacgttattaattataataattcgttatctaatcaagtccacaccgccttgacatttcaaaatatttattttgagagaaactggtcggaacaattggtgctattttcgatattaaattagcgttgtcatacattgtgagtgttaatccgattgatgtactacttgacttcaccatggttatttttttaatactcttggtcacgataatattccttgcatacaaatattttaccagacattttgactactggaaaaaacgaggcgtgcatactaaaaaaccaattccattttttggacatttctacagaactgccacatttcaaactaccttgtcagagttgatacaagacctataccatgaaactgacgaaccatactttggggtatttgcttttgacagaccaatcttggtgatcaaatcacctaagttaattaaagatatattaataaaagattttaatacgttctgcgatagaaccgttgcagatcccactcatcaccctctcttatccaaattttnnnnnnnnnnnnnnnnggcaaaatggaggcacacgaggacgaagttaactccattgtttacgtcatcaatgnnnnnnnnnnnnnnnnnnnnnnnacaattgatcaatgagaagtttgttgaatatttaggaaatattcaaggcccatttgatgctaaatatgttgctggtcattacagcaccgagatgattggtcgttgctttttcgcaattgatccacggtgttttgaagagaccacaacagagtttagagactgcgtggaaagaaccttgagtttaccctcagaaatgaatttatacag

SEQ ID NO: 16927 - DNA, 131 bp, Diabrotica virgifera
acggtccagtgaacacactaattgcattatttaaaaacattatgtagaagtcagaggaaaaaaatgaagtaacggggactaggtcgattctgagtaccagaagaccactaatttggagtgtgagtatgtct

SEQ ID NO: 16928 - DNA, 181 bp, Diabrotica virgifera
  misc_feature (26)..(48): n is a, c, g, or t
  misc_feature (62)..(84): n is a, c, g, or t
  misc_feature (92)..(114): n is a, c, g, or t
  misc_feature (144)..(175): n is a, c, g, or t
caattatattattaagtctgttcgannnnnnnnnnnnnnnnnnnnnnnagtttataattggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnnaaaagg

SEQ ID NO: 16929 - DNA, 879 bp, Diabrotica virgifera
aaagtgctcgtattggtgttatggcaagataacgggtttaagcaaaaaatggtttacacattgcttcctgtctatagtgctgagcttatacacagttggaggagctcttttgtttatgtacgtagaaggttcacatgaaaccaaaatagtagaacatgatcttaggacagatcgatacaatctaattaggaatctacggaacttatcaataagtatgcctgacaaaacatcagaaggggaatgggagggagccgccgctcgaatgatattcaaatatgaggataatattatagcagcttatcaaaaatcacaactcattcttataaaccggggccacaaaatatggacgctctggaacgctattgtatattgtgcaactgtttataccacattgggatatggtcacctctacccctccactaccactggtcgagctttaacgatcgtatacgctatagtgggaattcctctctttcttatagcgcttacagattttggtaaattattcaccagagctattaaattcttatggtcgtttgttagacgactttattatacaggaagctgtaggaaagttagaaaaagtgcaactgcttcggaaatatttaaaggagcccaaatgatgtacggcatagcaactttccgtagaccctcaaaggacccctccgccgaaagcgccgcatcaccgttttcaacagatattaccagtataaaacctatgtcatcgcacgacactgtgatatcggcaatgtccgaggacacaccaacaacaccagatttatcaacttttgaaatagatgatgagtttaatctacccatctccgtcgctctgttcatacttgtagcgtatatgtttatcggagccttagtatattgtgc

SEQ ID NO: 16930 - DNA, 905 bp, Diabrotica virgifera
  misc_feature (192)..(206): n is a, c, g, or t
  misc_feature (633)..(633): n is a, c, g, or t
  misc_feature (660)..(660): n is a, c, g, or t
  misc_feature (782)..(782): n is a, c, g, or t
  misc_feature (785)..(785): n is a, c, g, or t
  misc_feature (880)..(880): n is a, c, g, or t
cttgaacaatccctgtaattttatatcactgttagtgaaaactaagttgaaattttagtgctttcttattgtttggatttgaaaaatgccactcgttccaactgatgccgctagggcagtggctttagttgatgctggttacagtcaacgtcatatcgctcgtacactcgatgtgcccagaactacggtacnnnnnnnnnnnnnnngatttcgggagacaggatcatataaccgcaggccacgtcaaggccgacaacgatgcacttcagttcgagatgaccgcttcattgtcaccaaagtattgagaaatcgcttttgcaccgcttctgaagctcgtaagtaagtctcttcttgaggtgagaaacgttagtgtgagtagacgaacgattagaagaagactgtcacaaataaacttaagggctttccgtccagctcgcgcaccacaactgctcccacaacaccgtagggctagacttccttttgcgcgagaatggactctggcggaatggaagcatacactgttgtcagatgagagcagaataaacctaaccggtccagatggacgtcaacgtgtctataggcgtcaaaatggaaaggtttgcttcatgcgctataaccgaaacactggcttanccgaggagggtcaataatgattttggngaggtatttcttacgaagcgcgtactggatctttgttgtgtcggtagaggcagtgtgaatgcccaattatacgtgcaagaagttatccaagaccatgttatgccttttgcaccattcattgntgntaacttcagactaatgcatgacaatgcacgttgccatacagcaagatctacccgtgggtaccttaattaggtcggggatcaaggtctagcatggncagcacacagtccgaatcttaaccc

SEQ ID NO: 16931 - DNA, 459 bp, Diabrotica virgifera
cccacgtcgtccgtggtgctcttattttggatgctgatatccctcctttgggagccgagtatgtgttaatggaatgatacttaataatgggtgggagaaactcatctttgttcacaagccacacagttattttgcagcaccgatgcgcaccaacaattattaataaatcatcatatatttattaatatccaagttaatcgtattgttatgttattatatcggttgaattatagatcttttgaatcatgtttatgaagtgatcagttattctcctataaatagaactaagtctgtaaaagttgagataaattcaaccaatatcaatgtatcactacttactatatatgtatattataatgattacgtatctttacgtaggatggtatcaacaatagatgagaagaaactgcatagtctactgacagtatgacatccacatctacatctgtgagcggatgt

SEQ ID NO: 16932 - DNA, 93 bp, Diabrotica virgifera
  misc_feature (2)..(63): n is a, c, g, or t
gnnnnnnnnnnnnnnnnnnnnnnnnnnnnnnnnnnnnnnnnnnnnnnnnnnnnnnnnnnnnnngtttttttgattaaaaagataaaattaccc

SEQ ID NO: 16933 - DNA, 653 bp, Diabrotica virgifera
cctctttcgcgcgcgatgatttttgttagagtgatgccttcatctttagtgctagctgaagtaaggtgtgctcgaatgtcagataggatagagcgagcgcgtatagaggagtctgatgttactggatgaactgtcgggttcttgtgtttgaggtcgagtcagtagggacagtcctcgtcgactcgatggaccttaaatgagatgtgcaaccaggatttttattggaagctggtcctcttgagttcatagaaagcaaagttaagtgccacacgtttgaatatccctcctttatctgacgaatggtatgcagactagttgtccactggggatttatgactaagtggtcgtacccgacatatagatgatatgttgcggttggagcggagaagccaggttcgtctaagaggcttgtgatagtctaatgaatattcagaattgtgtgatagtgtggagtaaggctttttgtatagtggtacgaaaaatgtcatcggtcttgagagcatatttgaatgaaacacaaagtggaactacgtgagatgtgatgccagcgaggaaatccagtgacggaatagggtgacggttggttgtgtttacaggtggttacaggtttagaggcccttgattgctaccggatcatctgattgtaagtatta

SEQ ID NO: 16934 - DNA, 943 bp, Diabrotica virgifera
  misc_feature (185)..(202): n is a, c, g, or t
  misc_feature (265)..(284): n is a, c, g, or t
  misc_feature (536)..(551): n is a, c, g, or t
  misc_feature (761)..(778): n is a, c, g, or t
  misc_feature (911)..(937): n is a, c, g, or t
gcataatcactacaaaaacttttatgtcaggtttagaactgtatacatacaactatactattttggtataatatttataataatgtatagaaataaacagtgctgtttttgtaactatacaggttccggtacgcaatgttccagtgggtctgggggttattcataaggagggtccgcccccgagnnnnnnnnnnnnnnnnnncctcagtaagggcgtttgaaagctatttgggagcaaggaaaaattaaggaatttgtctatagnnnnnnnnnnnnnnnnnnnnatattcttctttagcggcgaatcgattgagggtaaaatttgattgatccgcgcgcatgcgcacaccgacagtatggtattagtcgttatacgggctctgattgggtattgaaattttgaaatgatctgtcagtaattgttcaatatggaggttatcggtaaacaaaaatattgtataatattagtttttattgatgtgtggacagaaataaaatcaaatttataattatagtgactttttaaatagtttttnnnnnnnnnnnnnnnngtaattctaaatgttttagttggaaatacctaatagtttcgatacatatctatttggaaaatgtaaacaaaataatgtagttacctattagtaggcaatgctttaatttacataatctgattacgaacaaactttctacaaatcttcatctcatatatcgttttcttactctatattttgttgtattttatttcgacaaaaaaacaaacnnnnnnnnnnnnnnnnnncgtataaatttatggtgtaaacgtttagtttgtgtatattaccacatgacgtatacgcgaatggggtgcaggttgaaatgccgccaatttcgaacgggggggaaaccggaaggggtttcagcccccaacaagnnnnnnnnnnnnnnnnnnnnnnnnnnngaaagc

SEQ ID NO: 16935 - DNA, 892 bp, Diabrotica virgifera
  misc_feature (595)..(595): n is a, c, g, or t
ctttgaagtctacggacaatctgcaagagcttatagaattggtgacatttttgcaaaaagccattgaaaggcaaggaaggcaagttacggtatctggtgctttggcagaccttctctcgcactactcttctttattggcgtcccaaggcgaattatcaacggcaatagcttacttaggaaactctaccaatgaaaaagtatcaacattacgcgatcgactgcaagtagcccttggagtaaagcaagttctcgcccaagatcctagacaaccgaatcgcagaggaagtcatcgcacttctttatccaccattggttacaaccagttcaacacaggattgcctaatccatcaataaacaatcagccatggcaaccacaacccacgcagtgtttccctcaaccaccaaaggcgttttctccagcccctcaagcgccaccttctcatccgcctagacctaccagtgttgggtccaaccaaggtggctcaggtttaccatcgagaaaatacgtactggatccatcggtatcttcaaatccctacggctctcccccaaaccaatacgttccacctccaattcattccttccagcaaaatanacgccttccagtctaacccctacgcaccgccatccgtaaattcgtcgcagcttccaccactaaacaactcgtcgatgctaaatcccagtcgaagttccttctaattccagtttcaatctaacaccgttggtgcctgcccaaccaagctacggaggatctaatctatcactcccacctacagacattgcccaagaagcgactactacaacgacccccagatatagtagtgcaccttctggatggaatgatccgcctcctcctcttcacaagcctctaaagcacaaccaaaacctgaac

SEQ ID NO: 16936 - DNA, 936 bp, Diabrotica virgifera
  misc_feature (646)..(646): n is a, c, g, or t
  misc_feature (764)..(764): n is a, c, g, or t
aaaaaaccgataactcagaacctgtaattattgtgaacgggactcctgaagaagttaaaatttgtacagagaacctaaaatccacaaagtacgatttgaaaccagatgccgaagaattcgtaccacgagccttcagaacgccagaaatacctctaagtccagtacaattcatcaaagtacctccaaactttatgcctataccggtggtgccattcaacggccaaatcaacccagcatttattcctccaggaggcataccgatcaacttcctacctccagatccaaagatgtttccaaactttatcaatttcgttcctacgccaccaagaagtgaagaggctaccgaaaagaacaaagaagctaaagaggttacagcaaatcaccaaaatacctgtgttatccatcactgtactaacattgccaaatccgaaattcctctaaaagccgaaaaaattgtagagaaaagtactccaggaaaaaccattgatatcgccacaatcgtctcgaaactggaagaagcagcaaaagaacaggaagaagacgaagataaaagtaaagttactgaagcagaacaaatcacgaagaagagaatatttaaaaataaccaaaaataccgatctaattttaagagaaactattacaacangtcctagaagttcgcctcaaaggcaaaatggtgatataacgatatgcaacggtatcgaaactaacgaaaataaacatatcgcaatcgacaaccaaatcgaagaaaagcttgatcctanatttatcagggagagtccggaaaggttcagaaaaaattggaaaaactaccaaaatatcaacaataaatggcatcaaaatggaacacctagaagccccgaatatagccaagggttcagtgaacggagattgaaacagaacttaaaccagcacctgaacaatcaagactgttga

SEQ ID NO: 16937 - DNA, 74 bp, Diabrotica virgifera
  misc_feature (8)..(72): n is a, c, g, or t
tgggggtnnnnnnnnnnnnnnnnnnnnnnnnnnnnnnnnnnnnnnnnnnnnnnnnnnnnnnnnnnnnnnnnnac

SEQ ID NO: 16938 - DNA, 183 bp, Diabrotica virgifera
  misc_feature (134)..(134): n is a, c, g, or t
  misc_feature (163)..(163): n is a, c, g, or t
ttatagagaacgtgattatgacagagacggtagaagatccagcagaagcagcagatacgatgacagatcaagacgcagcggaggtggtggtagtagatacagaagataagttagttttatgttcaatttgtttngaatatccaggtagtatttgagttttggntacataattatatttagaat

SEQ ID NO: 16939 - DNA, 727 bp, Diabrotica virgifera
caaaatcttaccttcgacgtctacgactatgcctgtattgcgttgttttctgatgttctgtacttctttaatatttttgtgcatagggaaatcatcatggttgcgttgtagtgtttcaatttctgtacatttctccatcagtcatatttcttttgccccttttatttcccttgatgatgatgatggtgatgtttggcatggaaactagtccatttgccacagatttttgcattttttattttccttagtatactcttatgcaactttttgtattcattgtcatttctaccttttaatttctttcgctcttccatcatttgcaatattttatctgtcatccatttttgctttttttctctttttgatataagatattaaaagtgtgttaatagatgtcttcatttcgttccattgttcttctataccactaggagcgtcttcaactattttcgcaaaattcttattaatctccgtttttactttttcctggatgttcttttctttcagtaattttatatctatcctgggtctcattttcttatgaatttttttgagtcgtatgttgatatttgcaactaactaacagtgtgtccatatgaatttttattgcagatggcattttggtcatactaatttttatcatttttttctccaattcttatgtcatagatactatttatagcattgctcaggtatctggcgactttgtccatactgctgctttgaa

SEQ ID NO: 16940 - DNA, 711 bp, Diabrotica virgifera
  misc_feature (311)..(341): n is a, c, g, or t
  misc_feature (670)..(683): n is a, c, g, or t
  misc_feature (685)..(699): n is a, c, g, or t
ggcagaaaacggtggtgatgttggtggtatcccgaatgtgtttggaaaagatggaaaaattcccacaacagacgaacttctaaagatgttggaagggatgtcggaacttagtgaagaaaataaacgggaattaagagagagtattctaagcggaggactagctagagaagcacaaaatatggctgattctgtaaaagaaaacgttgcatctggtggtattttaggagaattcacaattttattcattttcctttcaatagtttttttgattctagtattctttggttataaactgtattcatcgctgatgnnnnnnnnnnnnnnnnnnnnnnnnnnnnnnngacaaagacaacaaaagaagaagaaataagaaaatgtattgtgtgttgtaatatatacaaatttgactatcacaaacattccattatgtacctgttttttgactctttactacgtaactttgtggcagctgaacatattataaagtgactttccttgtattatattaaatatgacgtgacgtattagaaagtctaaaaaacagagcctatgagtataagagttaactgtacattttatgtcattttaagaaaattgtgttcaaagtttcttgtatgtgaaagtatctatgaagtctattttaatgttgtattgctgtgatattctatgnnnnnnnnnnnnnngnnnnnnnnnnnnnnnatgtcttccttc

SEQ ID NO: 16941 - DNA, 759 bp, Diabrotica virgifera
ttacatgactacttcatttaagttttgttggaacaatattaattttcattcgacagtaagctgtaacggatttaaatattattttacatttctgttacatctttccttctaaaatattagtgagatacataagagtaaaataatatttaatttcactagagttcattgtaaaattaaaattaatattgtcacaaaaaaaacttaaataaaatagccatgtaatagttattttctaagcgattctattaattacttaattagttaacaaagaacattgacttaaggaattgatgcgtggcaactacgcgttactcccctcaattcgtagcaaaataagccacgcccgcctgccaaaattaaactaaacttcagttcagtccgatatcctctgccggtgcgatatgtgacttaagggtctgcatcgcgccaagggaaccgaatgaaactaactacttgcacgatttcagctttctatgcatatctacgcggtatttacgaatggattcttatttttataagtttatggatacgtatttaaaacatatttcacctaaaacattgttctatttcttctattgttctatctaataaaaagcttctattttttgtggcatttacttatgtaatttattattctaaatgggaaataagccacaatttaacttaaaaaactcctacttcgaatgtcgttgccaaaatacaatatattatctaataaagtgaacgaaaaatgttgtaggtattcttcccttgatttct

SEQ ID NO: 16942 - DNA, 816 bp, Diabrotica virgifera
  misc_feature (769)..(797): n is a, c, g, or t
caatcttttgttgatgtgggtattcgtatcactacctttggtatacctggggtactacttcggatacagaaaacagccgtaccaacatccggtcagaacaaatcagataccaagacaagttcctgagcaacactggtatatgaatccaatattgtgcacactgatggcaggaatattaccatttggagcagtatttatagaactcgtttttatattcacggccatatggaaaaatcagttctactatcttttcggattcctcttcttggttttcgtcatattaataatatcttgttctcaaatatctattgtgatggtatattttcaactgtgtggagaggattaccactggttgtggcgcagctttatcgtatccggtggcagcgccctctacattttaggatactcactattttactttatgacagttttagaaataacagaattcataccgacgctactttacatcagctacactggactgatggttttcactttttggttactcaccggttccatagggttctttgctgcatatgctttcgttagaaaaatttacgccgccgtcaagatcgattaagtacatttttggttttattgcgcattatttatttgtgtgcaccgataattttggtaattcactatttttaaggctctgtgattttttaggattacaaaacaaaaaccctaacgaaatattttattcttgggatccaccagttccgtgtatgagtggtgatataggaacgtttttaggacattttgcgcnnnnnnnnnnnnnnnnnnnnnnnnnnnnngggttttcttaaacaatta

SEQ ID NO: 16943 - DNA, 371 bp, Diabrotica virgifera
  misc_feature (2)..(28): n is a, c, g, or t
  misc_feature (54)..(80): n is a, c, g, or t
cnnnnnnnnnnnnnnnnnnnnnnnnnnnattatcaatatatttatgattaaagnnnnnnnnnnnnnnnnnnnnnnnnnnngttacgagtgtgtgtactcataaattattgttcacatctacatttcaaataagaagaagatatcaaaaaccttcttgatatcaaccaatccattaattataaggagcaatcaatgttcaaagattttatgaaatacaatatgatgactgtatgtttctggattgtaagatcgggacgaatttcttgcagctctaagtactttgtagagtgtagatctatctggcattcaaaatttttcgattaaataacagcttttaatcatttatttctcggtatcttccacttagaatc

SEQ ID NO: 16944 - DNA, 734 bp, Diabrotica virgifera
  misc_feature (2)..(50): n is a, c, g, or t
  misc_feature (52)..(729): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagc

SEQ ID NO: 16945 - DNA, 711 bp, Diabrotica virgifera
  misc_feature (5)..(512): n is a, c, g, or t
  misc_feature (519)..(556): n is a, c, g, or t
  misc_feature (576)..(589): n is a, c, g, or t
  misc_feature (592)..(614): n is a, c, g, or t
  misc_feature (622)..(644): n is a, c, g, or t
  misc_feature (674)..(705): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 16946 - DNA, 681 bp, Diabrotica virgifera
  misc_feature (230)..(252): n is a, c, g, or t
  misc_feature (636)..(666): n is a, c, g, or t
gaataatcgtggttcaaggcaactcggttaaaaaatcggctaatcaggttctcactaataaggtaaacataaaaaggaaggaaatcatcggcaaggaaaattcaataaatattcggttaataaaattcaccaagaatgaataaggtggttaaactcgtactttcatcagaggtctacgattcatcctcaataaataactctcagaataaatacaatcaggtttctcaagnnnnnnnnnnnnnnnnnnnnnnnttctcaccggtttcggcaaggaaggtaagtaagaatcggattacatttttccggaaaatggcatctttcggcatacatcaaaatggtaaataccggccaaataacgggcaaaaataatttttcgaacgaaaactttcgggtaaataattttcaggttaaataaaaacggcacaaacgatttcggaaagggttaactcgtggataattccacatcaaataataacaccagaaaaaacaacttaatcgaaactcgataccatcaattaagtttttagattaatttaattcgggaaaacaccaaaaatcaattcgcacacagaatggtggtggacattggacgtttggacatttggacgtaagggtaaataaacaataacttttcgnnnnnnnnnnnnnnnnnnnnnnnnnnnnnnnctaatggtaaacgat

SEQ ID NO: 16947 - DNA, 612 bp, Diabrotica virgifera
atatatctttatatatatagaacatatattagaatatggagagattaagtttgttaaatggctatgtatactaggaattgggagggaaaatatcgtaaaaatcgaaagaagaataagtattctcagagacatgggtcgcaggaggtaaagaatagaaaagatatatagataaatgattccgatctagagaggatcaggagatataatccagatcatggagacgtgaaagaaggaggtatcgttctcgaactcgcaaggatatatcgacattcttcacgatcataccataaaacgaataccatatctataattcgataagcgacacctccagaattagagatctattccatcactacaataaaatgatatcgtaggcatgaggttagataccagactataatcaaatgttcgatactccacataaagatcgaacatcgaagaattatcatacataacaagatgggatcaaacgattcgttagatcgttattaatttctattcgtttagactgaatatattatgatgtaatactacattcatataaagttattgagggtgataatattagccgttgaaaaccgaatactgaggagaaatatatatctcgactaa

SEQ ID NO: 16948 - DNA, 687 bp, Diabrotica virgifera
  misc_feature (54)..(83): n is a, c, g, or t
  misc_feature (249)..(268): n is a, c, g, or t
  misc_feature (332)..(353): n is a, c, g, or t
  misc_feature (398)..(411): n is a, c, g, or t
  misc_feature (413)..(442): n is a, c, g, or t
  misc_feature (452)..(464): n is a, c, g, or t
  misc_feature (466)..(502): n is a, c, g, or t
  misc_feature (525)..(545): n is a, c, g, or t
  misc_feature (549)..(561): n is a, c, g, or t
  misc_feature (563)..(575): n is a, c, g, or t
  misc_feature (593)..(632): n is a, c, g, or t
  misc_feature (673)..(685): n is a, c, g, or t
gtttatttcgaaccttattcaacgaaaatcatatactattgagagactctccgnnnnnnnnnnnnnnnnnnnnnnnnnnnnnnggaccttgacgcctctagccattctaattaataattatagatagactattttcgaattccatagctataaaacattaaaaacctcatagtaaagaagcctgttaaacattattttccgtcccgaaatgtcatgcgtttttaaatctatctcattttttaagacacnnnnnnnnnnnnnnnnnnnncactacattcgaatttactcatttttatattataactattaactatttttaggaatgagcttcnnnnnnnnnnnnnnnnnnnnnngaactcttaactaaaacttaccattaaccattttcatattctatnnnnnnnnnnnnnncnnnnnnnnnnnnnnnnnnnnnnnnnnnnnncacactttgnnnnnnnnnnnnngnnnnnnnnnnnnnnnnnnnnnnnnnnnnnnnnnnnnncaattaaaaaatagtatatttannnnnnnnnnnnnnnnnnnnnaatnnnnnnnnnnnnntnnnnnnnnnnnnngttattaaaaacgtgtannnnnnnnnnnnnnnnnnnnnnnnnnnnnnnnnnnnnnnnctttgaacgcacgcgctattttgaccgtgctaaagtagctnnnnnnnnnnnnnac

SEQ ID NO: 16949 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 16950 - DNA, 242 bp, Diabrotica virgifera
  misc_feature (9)..(30): n is a, c, g, or t
  misc_feature (75)..(95): n is a, c, g, or t
  misc_feature (159)..(183): n is a, c, g, or t
ggtggaggnnnnnnnnnnnnnnnnnnnnnngaggggggggtgcacaatttactggaatagaaaaaaagcccactnnnnnnnnnnnnnnnnnnnnngaggggcagaaaaaaaaacgggctcgccccaaaaagggacgggggggggggacgcgcctttgcnnnnnnnnnnnnnnnnnnnnnnnnncggggccgcccccccccctccaggggcacaaaaaacgaggcagtccgtttcccccccct

SEQ ID NO: 16951 - DNA, 173 bp, Diabrotica virgifera
  misc_feature (3)..(45): n is a, c, g, or t
  misc_feature (56)..(107): n is a, c, g, or t
  misc_feature (116)..(134): n is a, c, g, or t
  misc_feature (137)..(162): n is a, c, g, or t
ggnnnnnnnnnnnnnnnnnnnnnnnnnnnnnnnnnnnnnnnnnnntaccttggtgnnnnnnnnnnnnnnnnnnnnnnnnnnnnnnnnnnnnnnnnnnnnnnnnnnnnagagctaannnnnnnnnnnnnnnnnnnggnnnnnnnnnnnnnnnnnnnnnnnnnngtatggaatgg

SEQ ID NO: 16952 - DNA, 459 bp, Diabrotica virgifera
cctcctgatcctcaaaaaagtcatctgggaacactgggaaggggtgggtttgtgttgtgtgttgtgtttgtgatgaactgtttttaatagttccgtatttttcgggcatttttcgaatttatttggtttttggttctaaatattgccattcaacatggctggacgtgcttgtattgtaaagcactgtaaaaataaacggtccataacaggcgactcattttttacgtttcctatggatgtcagaagtgctacagcttgggaaagagcttgtggtcgcgaagacataataaataggttcaccaggttttgaaatagctatcggaatttagaaatgctttttgaaaaatagtgttttattggtgtataaaaaatcaattctgtagtgttgtaactccaatataatttcccaaattaagttttcttttattttgttatacttgattatgttacattataaaa

SEQ ID NO: 16953 - DNA, 74 bp, Diabrotica virgifera
  misc_feature (27)..(28): n is a, c, g, or t
  misc_feature (49)..(50): n is a, c, g, or t
ttttgatataagaataaattaccttannggatacagcgtaattttattnnggagagtcaatcgataataaagat

SEQ ID NO: 16954 - DNA, 202 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggttggttnnnnnnnnnnnnnnnnnnnnnnnnnnnnnnnnngaaggac

SEQ ID NO: 16955 - DNA, 937 bp, Diabrotica virgifera
  misc_feature (298)..(392): n is a, c, g, or t
  misc_feature (808)..(808): n is a, c, g, or t
  misc_feature (878)..(878): n is a, c, g, or t
tattaatctggtctcttggtggagagacggagatcttgtcactgacgagactgagtatttttccgatcggcggaaatcccagagcgtcctcaaaattgacaagctcactcgttcacacctcctggccatatacagctgtgaggccagcaacagtcgtcttcaaccaccccttgttgtacgaactgcaatcgatatgtacctgagacccctagaagtcacacttattggaaacaatccagagttcagtgctggaagaagatacaacattacctgtcggtgtcgaggttcgaggcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatttgacagagttggagatattttcattagaacattaaagcaacaagtaaacacagcctcattaaatgtgtttcctttagttactttgtgtactttagacattatttctgaggcggcgatgggtattcaaataaatgcccaagaatcccaaacatcagaatatgtaaagtctgtgaatacaatgtgtaacatatttattggtagagtgacgtctcctatcccacatttcttgtaccgtttgacgccaacttactacagagaacggaaagctatcagaatattacatgaccagacagacaaaatcattgatattaaaatggaagaaagaagtaaacgcaaacaaccaacaggatcaaagtaaccaacaggatcaaagtactaggaaaaggcttgcatttttagattactcttgnagagttctattgatagtaaccattatctagactggacatccgagaagagttgatacgtttatgtttgcgngtcatgatactacagcaacagccataagctttgctttatattgtttagcaatgaccccc

SEQ ID NO: 16956 - DNA, 1128 bp, Diabrotica virgifera
  misc_feature (209)..(240): n is a, c, g, or t
  misc_feature (259)..(277): n is a, c, g, or t
  misc_feature (280)..(858): n is a, c, g, or t
  misc_feature (877)..(897): n is a, c, g, or t
  misc_feature (901)..(918): n is a, c, g, or t
  misc_feature (937)..(955): n is a, c, g, or t
  misc_feature (1067)..(1104): n is a, c, g, or t
cggacgcgtggggtgtaataggcagaagatgtatcttaaaagattgttgtgttattgaagataatactgtcctggcaccagaaactgttataccaccattttcaagatatggaggctctccaggtgcctatattggagatttacctgaatgccaagctgatttgatggtcgattttactagaagttactatcagcattttcaacctacnnnnnnnnnnnnnnnnnnnnnnnnnnnnnnnngctttttgtatgtgctcgnnnnnnnnnnnnnnnnnnngcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggatggagaaaattnnnnnnnnnnnnnnnnnnnnntttnnnnnnnnnnnnnnnnnntttaaaaaaggaaatctcnnnnnnnnnnnnnnnnnnntggttaattaaaaaaatgggcttttttgaataaaatataaaaagctccccccctgcccccctggtataatttttaaatgggcccccgggaattttttttccccggcttaaannnnnnnnnnnnnnnnnnnnnnnnnnnnnnnnnnnnnngcttggtaaatgggaagggtgttg

SEQ ID NO: 16957 - DNA, 112 bp, Diabrotica virgifera
  misc_feature (7)..(100): n is a, c, g, or t
  misc_feature (109)..(109): n is a, c, g, or t
taatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcttanatt

SEQ ID NO: 16958 - DNA, 920 bp, Diabrotica virgifera
  misc_feature (25)..(42): n is a, c, g, or t
  misc_feature (375)..(393): n is a, c, g, or t
  misc_feature (470)..(489): n is a, c, g, or t
gctttgctttctgatgacaaatatnnnnnnnnnnnnnnnnnncatagatttcctcaattccttgcagacacctatacgctataaccatagttacatttaatattggtgagccatgtatttataatataaaaaaagattaaaatgtcaatcaaatttactcgtagatcattatttcaaaattatctagtttttaaattattgtttttaaatgctgttttgtgaagaacgtacaacagctaggctagcggcacacccctaatttgaggcttagaaatcgaaaaagcgaccatgataggtgaatagaaaattttggtcattctttaggtcgctaaatccaaatgatgtttatttttatctagaattggtgaaacatgnnnnnnnnnnnnnnnnnnngcaaaaacgcgaaaaaacaatttcgatgatttttcaattttaactcgctgtatctttggtccctgtaaatatttccnnnnnnnnnnnnnnnnnnnncatctttgaaaaatttagataacaatgcgatttatccgagatgtttaaaaaattaaatgagaagttgttaatttctaaacaatttgtcgtcagattttgtcagttccatgtttatttaaaaactttgggtgacaaaatgttaagtttataattttaatcaccactgcattaaaacataagtcatgaagaagttttctggaaaattttaagttaaggtatgcaataggaaggaagttgtgtgattttataatatgagcggcacacccccaaaaaaggcttatttctcgagatattgaccacggtgtggtgaatgcctgattttgatcatactctatatttttgatggtgctgaaaacgaaaattagttttattttggaatttacgtgaaagaacattgtcaaaatccgcaattttttccctaaaataaacaa

SEQ ID NO: 16959 - DNA, 816 bp, Diabrotica virgifera
  misc_feature (2)..(720): n is a, c, g, or t
  misc_feature (722)..(805): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnagacgagaaac

SEQ ID NO: 16960 - DNA, 604 bp, Diabrotica virgifera
  misc_feature (327)..(344): n is a, c, g, or t
  misc_feature (581)..(602): n is a, c, g, or t
gaaggaagtttgtatttttacatctgaatctctaaaaaatgcgagacttttttggtacaagttttgtagttatacttctaggctttgtcaattctaccattgtggacaaatgtagagatggcggcataatacccccaagtgtaaatttaaagtcagattttgaacagaatgttgaagattgcaaacaggctccttgtgtagtgtatactggcgggaattgttatgtcgaattaaattttacttcacctggatatgtaccatctatatcccctaagtataaagcaacagcaatgggagtgactttagactatccttgcgagaaagatnnnnnnnnnnnnnnnnnnaatacagtttgccctctagtggaaaacgaactcgtgtcttatacatgggtaatggctctaccaagtttttatccagaatgtcttgccgatctcgaagtttcttttaccaatgacgacgataactcccttattttctgctttagatcacagatcgacgtaagaaaaccatctagattagctaaatagacacacaaaaaatttagtttttagtcagaattaggtattatgaaatattgnnnnnnnnnnnnnnnnnnnnnnaa

SEQ ID NO: 16961 - DNA, 268 bp, Diabrotica virgifera
  misc_feature (239)..(257): n is a, c, g, or t
ctgtttataaaaagaactgtttggttaaacaggtgctgcaggaggtgtgacctctgtctcatccttaactttaccaactgtttataaaaagaactgtttggttaaaccgatcgttaatgtgtacattaacaacaacttggtgtcctctggtgttagtgtagcacctggagtagatgaaggtcacaagaaccaaggcacttattccgttaatattaacaacagcttaaaaccatgtgccnnnnnnnnnnnnnnnnnnngcaagctttat

SEQ ID NO: 16962 - DNA, 782 bp, Diabrotica virgifera
  misc_feature (468)..(495): n is a, c, g, or t
cggacgcagtgtatgaagagatgcaatagatgagttgctccaagtgatactggtatcatcagcaaaaagaaaaaattttccatcgatttttaatttagtgatgacatttataaagataaggaacagcacaggaaagtaaccaagacgaaaagtctgaaattaaaatattttcgtctactgtacatagaatagttattaagagaattatattacgagactagaagatgaagaagagatacctagataatcccctaacttacaaaagaaaagacagccagacacaagttggagatatctgaaaatgaatcaaaaatgcgctaaaaagaatgaaaaacaacagctggctctagacccatacctgcagaactagtaaaacatgccccttcggccttaacccttaaacgcccaagagtgtataaaaatgtccacctaatgcgtattcccttgtaacatatttattacgtgtannnnnnnnnnnnnnnnnnnnnnnnnnnngatccagacagtccgttaacgaaagtaaattagcttatacatatatgtgtgattttattagcagagtcttgagcgatatatgagtgtgcgtactcagtgcagccttgaagaaaattgttactaaacgattctatataatttctcggtgcgatgaagataatccatatagatatcgatgtataatcacatagtctatataattatccgacaatgaggaggctgatagaaagaatatggagaaaatcgacaaatctgaattactgtcttttactgatatgtcaattttg

SEQ ID NO: 16963 - DNA, 821 bp, Diabrotica virgifera
  misc_feature (2)..(50): n is a, c, g, or t
  misc_feature (52)..(160): n is a, c, g, or t
  misc_feature (173)..(548): n is a, c, g, or t
  misc_feature (550)..(581): n is a, c, g, or t
  misc_feature (589)..(621): n is a, c, g, or t
  misc_feature (623)..(732): n is a, c, g, or t
  misc_feature (737)..(810): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnngcccacgnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcnnnnnnnnnnnnnnnnnnnnnnnnnnnnnnnnnnnnnnnnnnnnnnnnnnnnnnnnnnnnnnnnnnnnnnnnnnaaattattata

SEQ ID NO: 16964 - DNA, 413 bp, Diabrotica virgifera
  misc_feature (276)..(294): n is a, c, g, or t
aattattatcatcgtcaagattctattatgcaatatttcattaaattctgacgattataaaaatagattgaagaaagcagaaataaaaatttagaacaatgaattaagaaacagaattaaaggaaaactagctccaaatcctttcgacgatgtaaaagaaactcttcggccaaggtttcggaagctcttgacaattacctcgaaactcttcgacgatggccgctattacacaatagtcccaatgctagtaaagaatggttccgatggttttgaagnnnnnnnnnnnnnnnnnnngaaaaacgatcttggaacatggtcccgatggttattggaccacgattatgatgtttttgaatggtgataccgatggttttggatggcgatcgctatggtttgcgacgacggactcccgg

SEQ ID NO: 16965 - DNA, 108 bp, Diabrotica virgifera
  misc_feature (2)..(107): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 16966 - DNA, 730 bp, Diabrotica virgifera
  misc_feature (2)..(618): n is a, c, g, or t
  misc_feature (623)..(703): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagnnnnnnnnnnnnnnnnnnnnnnnnnnnnnnnnnnnnnnnnnnnnnnnnnnnnnnnnnnnnnnnnnnnnnnnnnnnnnnnnnaagacgagagacccttatagagtttta

SEQ ID NO: 16967 - DNA, 766 bp, Diabrotica virgifera
gccaattcacaattaaaaatggatgtgattttagatagacccaaaccgagtatggcagaccgaaaagcggaattagaacgtaagaaagccaaactacaagcactgagggaggaaaaagatcgaagacgtcgggagaaggaactgaaagaggtcgaggaggctgctagcagaactcttctgggaggaggtggcgataggaaagaattagacgatttgctaagggaagttggtgtagcgcctgtttctgaagtgttttctagtatatccagtgcaaattcactcacgccagagcctagtcgaaaccacacaccagacacttcactgcaaccgcatattttaaccaacaatgtaacagctgtaaaaaagaagcttccccaacttacagttgttccagtacaaactacaaacattcccccaaggaagttgttgtctacacgaagcagacccagacaacaactactggacatgatgtcagagacgattttggattttggaaaaagtcttgatcttcctgttcttcttccccgcttaaaggctacatggaggactggtggaggcccaggaaagcccacgcgaccgattactacgacgaatacaatcttaaccctggtttagaatgggaggatgagtttacaggagaggatgaggagggcagtttaccgccacatctcggaggatatggtgggagcaagctaccgcccgggatcctaccgcacggtcttccccaagtcaaggaggtccagccagcggttacggctttggaaca

SEQ ID NO: 16968 - DNA, 839 bp, Diabrotica virgifera
  misc_feature (437)..(479): n is a, c, g, or t
  misc_feature (688)..(688): n is a, c, g, or t
  misc_feature (757)..(757): n is a, c, g, or t
agacgaatggatatctttgagtcatctattactcagtctgatgatattatcagcatgttgacttatgcatttcaagtagcgatgagtttgattcaaaatcgagcatttagaaacactgttttgagatctcttgttggactttatagaggactggttacacctgattacgttaatatgtgccagtgcttaattttcctcgatgatccattgtctgtggctgaaattttagacaggcttgtaactggcaaggaggatactgaacttatggcatatcaaattgcttttgatctctatgagtcagctactcaacagtttttggaaagagtattagttgcattaagagccacagcaccagttccatctttgctggaagaaaaagcaaagccaaagccttctggtgaaggagagggtgctatgtcaaccgagactggagaacnnnnnnnnnnnnnnnnnnnnnnnnnnnnnnnnnnnnnnnnnnntctggatagtttgtctgatcaggataaggaacatcagaaaagaattgagaaacttcatactatactctcaggggaggtctctatagaactgcaccttcaattcctcatcaggtcaaatcatgctgatctactgattcttaaacaaacaaaagagactgtcagagttagtatttgccacactgctactgtaatcgcaaacgcatttaggncatagtggtactactagcgatcaatttttaagagataacttagaatggttagccagagcaacgaattgngccaaacttacagccacagctcggctaaggagttattcatagaggccatgaacaagaagcattacactaatgcaaagttact

SEQ ID NO: 16969 - DNA, 461 bp, Diabrotica virgifera
gaagaagaagattcccctattttagaagagaacagcgcaccgaattccattgagaactgatatacagaatgagcgaagagatgtttaaaaatgatagggttatgctgttagagcagaaaagaacgtgtatgagagtcaatgtgacttacacagcgctggtttttgacagattatctagggttgaagttattgattgcctctgaggtatggagcataagaaaccgcagctaagggagcgatagatccataaaatgacaattaataaacggatgatcgatcatgagaagaaaaaaataacttgtgatcatgtgcttgctagctatatttcaagactgctatacagaaagtagtcgacggctacgtgaaagaagccccagttttatagactgaagcgaaaaagcaatacctaatgcagaacaagaggtgaagtaataaatgagtagataagagcagatcgacga

SEQ ID NO: 16970 - DNA, 904 bp, Diabrotica virgifera
  misc_feature (751)..(751): n is a, c, g, or t
atttaatgtagctaaatgagtagcattatcctataaaggagttcttcaactcttgcaacggtaagaatcgatgaaatacaaaatggaagaactgattaagaagaatgtgaaggtatatgggcagtttcaggtaaaatcctttgtggatccgaatgaattatataatgtaggtttaagacaagtatgtgaaagtgagtgttagacattgttttgtagagtttgtaaaatttgtattctccgttaccagtgcagttgtgatgaatatttggtgaggaataccttgtgtaagcatgtgcacttggtaagaatgtatgagtagcatgtgggtactaattctgttttagatgatactgcaaggtgtttggagaaacttcaattatcaaatcaaggcatgaggaggaaagtaatgagtttgtcagagggaaggtagaaaaggtggacgaattagacgaccaagattttatcaaatttacgagtgagtttcaaggaattaaaaaaatttcagaaaattacaaagaagcgaaaaatggaaaagcagaagtattttcaaataaagaaagaaattgagtaatcattaaatttgaacatttttttagctcacaagtattttgtcttctgtatctgtattgaatttttattatagttgtataggctttacaagaacgttagttaatttaacattattatagagtttacttgattagcaatattagtaatatgtatgcatacttaggttaggtctgaattttanagtcatgttaagtaatgttatttatagacatttatatcagagttgtatttttatctggatgtactacgtctttcggcgaggtttagagggggtttaccttcgccatttttaccaataaggaccgcccctcctttgatttctcagatatttaat

SEQ ID NO: 16971 - DNA, 626 bp, Diabrotica virgifera
cgtccggatctgctcgttccccgaaaaaattcgttttttccggggtcggggtccatcaaaaaaacttcgggtatgtccattccgaacacgggaggccggtctaccccccctcggcgactggactctctccgacaaaaaatctttctttcctttttttcatacgaggcgccgtttttatgcaaaaaaataaaacatcttaacgcttaccaagtatttgaggtagtttccatatgcatagaaacttagttcaaatactttctaaacgctgagatgtttgattttttttgcataaggacggcgccgcatatagaaaaaggggcaagaaagattttttgtcgtcaattgaacgaggaattcgggaatgatttttagtttgacatatctcagtggcgtgctatttttttcttcaaaaaattcagaccattgcccgtacgcgcgccggtgatgagtatggaattcttctgttatctgtaaaggagatcattttgaacatttcttgcagctttgcacctagttgaggtcttatttgtaatattttctgttgttgttctagtttggtattattatattggataggttttgatgatgagttgtgaggtgaaatatgagcgccggaaggtttgatt

SEQ ID NO: 16972 - DNA, 996 bp, Diabrotica virgifera
  misc_feature (367)..(384): n is a, c, g, or t
  misc_feature (390)..(428): n is a, c, g, or t
  misc_feature (627)..(654): n is a, c, g, or t
  misc_feature (687)..(706): n is a, c, g, or t
  misc_feature (737)..(791): n is a, c, g, or t
  misc_feature (802)..(907): n is a, c, g, or t
  misc_feature (909)..(993): n is a, c, g, or t
gcggtccgggaatcttcttctttcttctcaaatggaaaaaatttactctttcttcgtaaccttcggtggtaattcagaggattcactcaattcaatcaattcacatcttctcactctcttttcgaaatttcaaaagtggctcaaaaaaaatctcaaaatcttttcttcggtaaaaataaaatctctttcaaatcaatctttctttcgtaaacggaaaacgttctcttcgttctctcaaatcatcatctaaatcttttctcagaaaataaatctcaaatctctatcctctccaacaataatcaatcttaatatattcaaatacatcttctctctctcaatctcaatattaaatatcttctcagggacnnnnnnnnnnnnnnnnnnctatcnnnnnnnnnnnnnnnnnnnnnnnnnnnnnnnnnnnnnnnctctcatattttcaaataacgttatctaacttaaccttcatcatcattaataatcttctaattttctctaaatttttctcatctaaaaataatcaaatttaaaattaatcttaaaatttaagtaatcggatcggataataatctcaagtaattcaaaaaaattcggtataatcttaagtaaaaatatcatcaggtttannnnnnnnnnnnnnnnnnnnnnnnnnnncacccggttattaaaaacatcggtctttttcgnnnnnnnnnnnnnnnnnnnngccgcccaccggattaatttggaagggccgnnnnnnnnnnnnnnnnnnnnnnnnnnnnnnnnnnnnnnnnnnnnnnnnnnnnnnngctcgggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnctc

SEQ ID NO: 16973 - DNA, 935 bp, Diabrotica virgifera
  misc_feature (857)..(857): n is a, c, g, or t
tctcctagcgtccgcaataaaccagcatatctatgttttatacatctgacaaaggctttcgatcgcatccaagtcaaagatgtcttacacttactctatagaagaaacataccaatcaatatacaaaccatcgaaaacatctacttccatattcgaatacaggcaaagataaatggaaaactaacacagtttataccagtacaaagcggaattagataaggtgactcgttaagcacacttctctttaatataataatggacgaaataatagaagcagtacataaaagtcatggttacagaatggggaacaaagaaatccgaatattatgttatgcagacgacgccgcattaatcgccgagacagaagacgatcttcaaagattaacacacatattcaatacaacagctaagaaatacatatataatatcagcagaaaaaaccaaacgtatgacaacatctaaatacccactacgatgtaaaatcgaaattgatgggaaaataataaagcaggaagcaaggtttaggtatctgggaataaatataaccagttacggagatgttgaagaggaagtacggcaacaaagcttaaaagcaagtaaagcggcgggatctcttaatgacacaatctggaagaaccaacacctaagacaagacacaaaagcaagaatctataaagcagcaattatacctattttgacatacacggtggagacaagacctgacgcatctaaaacgagacgattactagaaacgacagagatgaaaatactccgacgaaaatcagggaaaagtctgttgggtagggagagaagtgaaaacataagatcatggcatatagaagacataaatgaatggngtgacaaaacagaaaaaggagtggaactaacacattagtagaatagcagaggataggatagtacgaaaagcacgatat

SEQ ID NO: 16974 - DNA, 807 bp, Diabrotica virgifera
  misc_feature (781)..(803): n is a, c, g, or t
agagaacagaatatgttgtaaatttgcgctattttcgacgaaatttgagggcttaggagaatgaagggggaaagatcgtcgaatcgaatatttgcaagaagcctgaagtatgagggacaggaacctatcgaactccccactgaagatgatgtaacacttatcgttaagaaccttatcggcccagattccggaatcgtcagtgttaaaaaacaataatccggaaactatatatcgtttcggaggagtactgattatctgtaaaggaagactaacatctctcacacctgtatgatgagatgtgatttcatcatatattatactgagattttccgaaagagaaaaaacgaaagagagatgataatatggagaagtcaactgcaaagacaaatgatgaatggagacaaaattagcgatgaactgatttgattgactttgctatacctatgaaaggaaatgattataatttgatagaatatatttgtatatctttgatagaggttgtttatgacagcatgaaaagaaagacatcttagacagaacaatgcagaggatatgaatatatcaggattgcatagtatagaatctcagatagagagtttatagagaggaggtatatgacagatgtttcgcgtggtgatgagaaacgtgtcttttcgaatgaaagacagagtctcgcctggccacggaagaatttgaatgaacgcgtaacgatgaccgggctaatgtagatagacattatattttgttattgaaggctgagatgcagatgtgtatgtaccgnnnnnnnnnnnnnnnnnnnnnnnagag

SEQ ID NO: 16975 - DNA, 792 bp, Diabrotica virgifera
cattttcgacggcacccttcgtttcgtcttttcaaaaaaggtcacgccaaaaatctaatgctttttcttaacacaaatttttcaatcaaaactaaataacaaataacaacgccctattctcccgatgaaaaaatctaatcctattattcgttcggtacacttctagctttttcccaacgcgtcgcggattcatttttcaaacaaatcggtgtcataacataaaggcggaacggtcggacgggtatataacattttcgtataactcgtataactatataactaacacacatcggtgtacgtttcactttcggtttcgatttatgtttggtttcggaaaataggaatcggtgggcagcatcggggagagatgttggtatgcagggacgtaacatatataccatctataactctctaatttataggcttcggtctaatcggcgttataattacatggttttaatatcggaaaaatacttggattaagttacatcaaatacatctaaatttggggcttttcaacgattgtcatttgtttcgagcttccgtcatattatgttgtataatctgtgtataatattaatacatatacacggattatacgacatatgacagatgctcgaaacaaatgagaagcgttgaaaagccctttagagttacaatcgatttgggcccgtacttttcacctccggataactatatgatcggagaggtaaaagagagtgcgtaaattgagtataatattttttgatacaattgaatgtgaggtgtattgttatcgatgagagatctaga

SEQ ID NO: 16976 - DNA, 1026 bp, Diabrotica virgifera
  misc_feature (185)..(225): n is a, c, g, or t
  misc_feature (230)..(262): n is a, c, g, or t
  misc_feature (303)..(388): n is a, c, g, or t
  misc_feature (390)..(488): n is a, c, g, or t
  misc_feature (490)..(512): n is a, c, g, or t
  misc_feature (514)..(648): n is a, c, g, or t
  misc_feature (650)..(662): n is a, c, g, or t
  misc_feature (665)..(903): n is a, c, g, or t
  misc_feature (905)..(937): n is a, c, g, or t
  misc_feature (943)..(992): n is a, c, g, or t
  misc_feature (998)..(998): n is a, c, g, or t
atttcttcttcaaataataaaatcttttcttcgtaaatgtaaagaaaaattctctctctcaacatagttaattcgtatcgtgagagaatctttctctctctcttctaaaagaaaaatttcatctcttctccggtacctccgtgtatcagggattaatctaattaataattaatcatcatttatcnnnnnnnnnnnnnnnnnnnnnnnnnnnnnnnnnnnnnnnnncatcnnnnnnnnnnnnnnnnnnnnnnnnnnnnnnnnntcgaaacgttattcgtttttcaaatatcatctaattttttnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnncgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnctcatnnnnnnnnnnnnnnnnnnnnnnnnnnnnnnnnnnnnnnnnnnnnnnnnnncactantaaaatttttggatcccaattttttttg

SEQ ID NO: 16977 - DNA, 478 bp, Diabrotica virgifera
  misc_feature (50)..(71): n is a, c, g, or t
  misc_feature (81)..(96): n is a, c, g, or t
  misc_feature (98)..(137): n is a, c, g, or t
  misc_feature (202)..(240): n is a, c, g, or t
  misc_feature (245)..(275): n is a, c, g, or t
  misc_feature (286)..(453): n is a, c, g, or t
  misc_feature (455)..(469): n is a, c, g, or t
gcggtccgatttttctcttcatctttcaaataataaaatcatctttttcnnnnnnnnnnnnnnnnnnnnnnatcttcacgnnnnnnnnnnnnnnnncnnnnnnnnnnnnnnnnnnnnnnnnnnnnnnnnnnnnnnnncattttctccgtaccttcgtggtatcagggattaatctaattaataattatcatcatttcattcnnnnnnnnnnnnnnnnnnnnnnnnnnnnnnnnnnnnnnnattcnnnnnnnnnnnnnnnnnnnnnnnnnnnnnnnaaggaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnntaaatatgg

SEQ ID NO: 16978 - DNA, 717 bp, Diabrotica virgifera
  misc_feature (3)..(123): n is a, c, g, or t
  misc_feature (131)..(243): n is a, c, g, or t
  misc_feature (252)..(711): n is a, c, g, or t
cannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatca

SEQ ID NO: 16979 - DNA, 918 bp, Diabrotica virgifera
  misc_feature (340)..(358): n is a, c, g, or t
  misc_feature (413)..(429): n is a, c, g, or t
  misc_feature (431)..(511): n is a, c, g, or t
  misc_feature (571)..(700): n is a, c, g, or t
  misc_feature (702)..(714): n is a, c, g, or t
  misc_feature (721)..(721): n is a, c, g, or t
  misc_feature (754)..(785): n is a, c, g, or t
  misc_feature (789)..(789): n is a, c, g, or t
  misc_feature (793)..(810): n is a, c, g, or t
  misc_feature (832)..(832): n is a, c, g, or t
  misc_feature (841)..(858): n is a, c, g, or t
  misc_feature (860)..(879): n is a, c, g, or t
  misc_feature (885)..(885): n is a, c, g, or t
  misc_feature (894)..(894): n is a, c, g, or t
gtccgattttcaaataaataaaatctctcttttacggaaatgtaaagaaaaaattcttctctctacaacggatagttaaatctacgtatcgcgagtgaaactctctctcactctttcacaaatgaaaaaatttcactctttcggtaccttcggcggtaatcatgggtatctcactcaattcaataaattctcatcatctctcactctctcctcgaaatctctcaaaatgatgctaaaaataattaaaatattctcctcatcggtaaatataaaatatctttcaaataattctcttcgtaacgaaacgttatctcgtttttcaatatatctaattctctcnnnnnnnnnnnnnnnnnnncttatctcaacaataatatttatcaattaaataatttttatcattaattaatatnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnngttattatttaatcttttcatcatcattataatttttaatctttttcataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnntggatanatataaagtctcgcctggccatggataatttgnnnnnnnnnnnnnnnnnnnnnnnnnnnnnnnntaancaannnnnnnnnnnnnnnnnngtggattggaagggtggatganaaaaaatgnnnnnnnnnnnnnnnnnngnnnnnnnnnnnnnnnnnnnngcttanattttttanagacgagagaccctatagagttta

SEQ ID NO: 16980 - DNA, 72 bp, Diabrotica virgifera
  misc_feature (8)..(25): n is a, c, g, or t
  misc_feature (36)..(71): n is a, c, g, or t
tatagagnnnnnnnnnnnnnnnnnnggttttttagnnnnnnnnnnnnnnnnnnnnnnnnnnnnnnnnnnnng

SEQ ID NO: 16981 - DNA, 853 bp, Diabrotica virgifera
  misc_feature (9)..(27): n is a, c, g, or t
  misc_feature (70)..(93): n is a, c, g, or t
  misc_feature (101)..(213): n is a, c, g, or t
  misc_feature (222)..(851): n is a, c, g, or t
ctcgtaaannnnnnnnnnnnnnnnnnntaatcatagttaattcgtatcgtgagagaatatctttcttttnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngt

SEQ ID NO: 16982 - DNA, 847 bp, Diabrotica virgifera
  misc_feature (2)..(582): n is a, c, g, or t
  misc_feature (590)..(617): n is a, c, g, or t
  misc_feature (621)..(685): n is a, c, g, or t
  misc_feature (693)..(693): n is a, c, g, or t
  misc_feature (704)..(704): n is a, c, g, or t
  misc_feature (716)..(794): n is a, c, g, or t
  misc_feature (801)..(844): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatccannnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnaagcttanatttttttaanagacgagaaacnnnnnnnnnnnnnnnnnnnnnnnnnnnnnnnnnnnnnnnnnnnnnnnnnnnnnnnnnnnnnnnnnnnnnnnnnnnnnnnggggtgnnnnnnnnnnnnnnnnnnnnnnnnnnnnnnnnnnnnnnnnnnnnatt

SEQ ID NO: 16983 - DNA, 804 bp, Diabrotica virgifera
  misc_feature (2)..(17): n is a, c, g, or t
  misc_feature (19)..(61): n is a, c, g, or t
  misc_feature (77)..(796): n is a, c, g, or t
cnnnnnnnnnnnnnnnncnnnnnnnnnnnnnnnnnnnnnnnnnnnnnnnnnnnnnnnnnnngtacctcgtgtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattaa

SEQ ID NO: 16984 - DNA, 790 bp, Diabrotica virgifera
cgcatacgtacttcgtctgagtgactgttctcatattttatttaggcttaggacgagtgctagacttcgagccgtattagaaatagtcttataccctactacagagaggatctccgctcgcacgcgattagagggatgatatctgaaaatctcaaacgaatctccacatctcaacctcttcatgacattccgtttgtgagagtatggatcctctctaagggtttcaatatgaccgaacaagctcccaggttgcaccgaatggatgaatggcgagactaacgcatgaaacaacactcttaacgccaaactgaaggagatactccaaaagagcgcttcacactggacttgattcatactgtttcccccaccatgggaatgtctggacgtagcgatgctctacccgatacttgtcaatatcccgagcatcttgatgatgccccaggttgcaaaggtgaccaccatcccattggtggcatacaaattgaataccgactggcaacacgaggaaataacctatatccgtaatgtattttagatagactctaggtttagttgacgcaatcgctgacagtggatgtacttgcattgtcatctgtacgtacgcgatgcattgtctaataccgtgaatgatattgcagatgcacaaatcatttccctgccatctggatgttctgtgccagaatctacaccagcaagttgctgatgtgaatgcagagatcaatttgcatatatcggagaagcaaaccagctgcatttgagcttaagatggtagatgagggacataaatgct

SEQ ID NO: 16985 - DNA, 853 bp, Diabrotica virgifera
  misc_feature (774)..(774): n is a, c, g, or t
gcggtccggcttttccgggggtcccagccacctggtggcatttcgcggcctttcgcaaaacttcgactcacgtctttcaccctcggaagggctttctttaaattttctttcattcgaattaaacctttctcaaatttcgcctcacacctaatccttcaccagggtcccaattcattccgtcgaaattcatcttttcttttcatcaagaattccctcaactctcattttcattcttctttcggtggttaatgctacattcggtcttctaactaccaatagagtggatatgctcgggcctgggttaacaggtcttcgtaatatttttcaatttatgttggtcttaactaaacggggttttttctttttcagaaattttaagataggttccaggtagagttttaattacccatgtaggaaggcgtttaatttcatttcataacggttctaatcattttctggccacttcaccaatcacttcccaaggtaatttggaaacgggtggtacttcttttcaaagagtaatacggcaccaaacttaaatttcttttctcgaaggtttgaaacacttggagctaatttcgttttggctctgggtttaataactaagcccttctctttctttggattctttaatctaggtattaaataactaaactaaaactaaaactaatcgaaattaaggagagaggtggacccatttctttctctaactactgtcgcaaattctctttcgaaatattctcatggagggttctgggacgtaaattcagattncaatttctggttttttcgcaaatttggccatcttaattggttctttctcttggggattcccaggcctccatggataaac

SEQ ID NO: 16986 - DNA, 333 bp, Diabrotica virgifera
  misc_feature (4)..(32): n is a, c, g, or t
cccnnnnnnnnnnnnnnnnnnnnnnnnnnnnnctaaatattgataaacaatttttttggactgtcctgtaagtcaggaggcctccatctccctttaaaaggaacctagaaactacaaccaggatcaattatatagcagtaattactcctcacgctctacaacacatttccctaaatcttatgaccattcactcattgttactcttgtgtattgataattactctttctttaagcttattctctagtagtcagacagaaatgtcgacttatgtacatatgtactcgtccacgcccatatatatctatatgtaacagtagacttatttaatcatc

SEQ ID NO: 16987 - DNA, 748 bp, Diabrotica virgifera
  misc_feature (2)..(43): n is a, c, g, or t
  misc_feature (51)..(163): n is a, c, g, or t
  misc_feature (172)..(534): n is a, c, g, or t
  misc_feature (536)..(630): n is a, c, g, or t
  misc_feature (638)..(655): n is a, c, g, or t
  misc_feature (666)..(666): n is a, c, g, or t
  misc_feature (673)..(705): n is a, c, g, or t
  misc_feature (707)..(725): n is a, c, g, or t
  misc_feature (728)..(744): n is a, c, g, or t
cnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatccnnnnnnnnnnnnnnnnnngctggatggangggttgnnnnnnnnnnnnnnnnnnnnnnnnnnnnnnnnngnnnnnnnnnnnnnnnnnnnagnnnnnnnnnnnnnnnnncgag

SEQ ID NO: 16988 - DNA, 676 bp, Diabrotica virgifera
  misc_feature (148)..(165): n is a, c, g, or t
  misc_feature (459)..(486): n is a, c, g, or t
  misc_feature (496)..(513): n is a, c, g, or t
tagttctagactctctttcacgctcccgattatctctgtgaggactactgtcgcgtctattacttgatgccctcatacacatgcgagacgtaaatactatatccatataattagcgtctatgtttattaacgagagtatgaggaaacnnnnnnnnnnnnnnnnnncaaatatcactattcttatttaagagagatattgtatgaaaaatagtattgtaaaccgactatgttaaatagcttctttgtaatgcaaagcgatccccatttatttataacataaatgaattagacataaaaacaatatatatattatcaatatacttaaaatcaggcatatcttaaatattaatgacaaagatttctgatggacgtggagtaagattaatatatcaataaatatttaattcttaaaaacaaactgggattaaactatttcaaatttataattatgaaataagnnnnnnnnnnnnnnnnnnnnnnnnnnnncttataaggnnnnnnnnnnnnnnnnnnggaaagtgattcaaagtttagaaaggcagataaagatgatgtcaagaaagtgtatatttagaagaaatatatagctttaatatgggtactctgcaacattttcttcacctgtttctaatagacagcaaatcttgccaatgatataaaggatcgcccgccctct

SEQ ID NO: 16989 - DNA, 848 bp, Diabrotica virgifera
  misc_feature (125)..(125): n is a, c, g, or t
ctcggaggaaatattcctgtgtagactatttccattcctccattgattgagattttgcatggtataacgagactagaatttctgtcttttcttgcctagacacacaaaaattagctggacaactntattaacatgttacatgacggaatcgtcgcatacggatggatgcatcattactactcagattcgcatgaatcatatcacaaagaaccggtagtgtaaatcactatactgttgtctccacatattgctactttacaggctgaattaggtgaatattacactgagtaccacatatactgccatatcctctgcccattcgcttcattattgtcgatgccccgacaaatatgtcaaactgtctcttattcttgccagagatagggaagaagtgatgattgagtctaccaattctaggtaaccaagtgaaataccaggagatctttcttgcctccgacctgtaaaccagaacatcgtgtagcttacttcatagaagattaggcaattactcttcaccattggcattgaaatgtgacttatccattcgaagctgctttctatgtgatcaataagaaccgtcgagaagaacttttctattacatgcatcagcatattgttgatagatataacttttgaaagtctctgccgtgcaccaataggagtacaaagatacattgatggcacaaaagtgatccctgaagattatttaccttaactagacagatagttgtctagtagaccttgcccctctcgtgtagataagcataatctctccaaccttacaatagatgctgatcagataactcgagatatcgatgatcttgattgatggagtcacagaatcgttg

SEQ ID NO: 16990 - DNA, 292 bp, Diabrotica virgifera
  misc_feature (4)..(46): n is a, c, g, or t
  misc_feature (56)..(168): n is a, c, g, or t
  misc_feature (175)..(210): n is a, c, g, or t
  misc_feature (214)..(284): n is a, c, g, or t
cggnnnnnnnnnnnnnnnnnnnnnnnnnnnnnnnnnnnnnnnnnnntaccttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgtnnnnnnnnnnnnnnnnnnnnnnnnnnnnnnnnnnnntaannnnnnnnnnnnnnnnnnnnnnnnnnnnnnnnnnnnnnnnnnnnnnnnnnnnnnnnnnnnnnnnnnnnnnngatgagct

SEQ ID NO: 16991 - DNA, 789 bp, Diabrotica virgifera
  misc_feature (9)..(24): n is a, c, g, or t
  misc_feature (26)..(40): n is a, c, g, or t
  misc_feature (46)..(68): n is a, c, g, or t
  misc_feature (76)..(187): n is a, c, g, or t
  misc_feature (199)..(562): n is a, c, g, or t
  misc_feature (564)..(693): n is a, c, g, or t
  misc_feature (698)..(759): n is a, c, g, or t
  misc_feature (767)..(767): n is a, c, g, or t
  misc_feature (771)..(771): n is a, c, g, or t
  misc_feature (777)..(777): n is a, c, g, or t
atcttcacnnnnnnnnnnnnnnnncnnnnnnnnnnnnnnncttttnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagnnnnnnnnnnnnnnnnnnnnnnnnnnnnnnnnnnnnnnnnnnnnnnnnnnnnnnnnnnnnnnaagcttanattnttttanaagacgagaaac

SEQ ID NO: 16992 - DNA, 674 bp, Diabrotica virgifera
  misc_feature (33)..(52): n is a, c, g, or t
  misc_feature (138)..(151): n is a, c, g, or t
  misc_feature (153)..(169): n is a, c, g, or t
  misc_feature (171)..(218): n is a, c, g, or t
  misc_feature (222)..(253): n is a, c, g, or t
  misc_feature (262)..(452): n is a, c, g, or t
  misc_feature (454)..(673): n is a, c, g, or t
atttcttttcaaataataaaatatctttcttcnnnnnnnnnnnnnnnnnnnntctctctacacatagttaattcgtatcctcgagagaaatcttctctcatcttctcctaaaagaaaaatttcatttttcgtacctcnnnnnnnnnnnnnncnnnnnnnnnnnnnnnnntnnnnnnnnnnnnnnnnnnnnnnnnnnnnnnnnnnnnnnnnnnnnnnnntccnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 16993 - DNA, 907 bp, Diabrotica virgifera
  misc_feature (305)..(323): n is a, c, g, or t
  misc_feature (426)..(456): n is a, c, g, or t
  misc_feature (760)..(760): n is a, c, g, or t
atcgagagaatcgggaaataaaagaatgccaaaaatggtactctcatgaagaccaatagaaaagagaaggaaatacaggccaatgaaaagatggaaggacagtgtgtacaaagatctgaagaaaggtatcattgagagatggaaagaactaacataggacagaaggagatggagggagctcgccgaggtggtgaatgagggtataaaaagactgatgtgtaattaagtaaaatttctaagacttaaataaaatataatcagaaatgtaaacattttagccctaggcctacaaggcttgttgagcnnnnnnnnnnnnnnnnnnnctttttaggtattttgaactatacagtgtgtctatgtcgcacttatacatactcgtattatacttacttatgcgaagaattaccaacaaataaatacttgacnnnnnnnnnnnnnnnnnnnnnnnnnnnnnnncatagttatttatttaacaaataattattgacaatggtgctcattaaatacgtcaatcatatagtgcgacagaaacgcaccatatagtgcgatgcgcggcggcttaaaagtcgagtagacgggcataatgaaaatttaaaaaaacaacggtctcaattgaaataagctttattactcgctagaattttgaaactgaatgtttcagcttcaaattaggtacttggcaatctcaaaaataataatttacatattaagttttcaaacctcgataattcgtgcgtatcttcgcatttttagattttanattgtttataactagaaaactatcaatttttgagaaaatacacgagaacgggggttttgtttagatggatcagaaaacctaaaaaaatccgggcaataaagttgatctttttgatttgttaaaaaaaatcgtttaaacatttcgcct

SEQ ID NO: 16994 - DNA, 729 bp, Diabrotica virgifera
  misc_feature (13)..(65): n is a, c, g, or t
  misc_feature (67)..(81): n is a, c, g, or t
  misc_feature (83)..(127): n is a, c, g, or t
  misc_feature (135)..(548): n is a, c, g, or t
  misc_feature (550)..(628): n is a, c, g, or t
  misc_feature (630)..(687): n is a, c, g, or t
  misc_feature (689)..(705): n is a, c, g, or t
  misc_feature (707)..(727): n is a, c, g, or t
tatttttatttcnnnnnnnnnnnnnnnnnnnnnnnnnnnnnnnnnnnnnnnnnnnnnnnnnnnnncnnnnnnnnnnnnnnncnnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnncnnnnnnnnnnnnnnnnnannnnnnnnnnnnnnnnnnnnnag

SEQ ID NO: 16995 - DNA, 892 bp, Diabrotica virgifera
  misc_feature (229)..(247): n is a, c, g, or t
  misc_feature (293)..(317): n is a, c, g, or t
  misc_feature (429)..(429): n is a, c, g, or t
  misc_feature (583)..(605): n is a, c, g, or t
atacaggggagttcgttgagaggggtccgaaaaaaaatctatccttattaaaactcaaaatcgtcagattaagataaggtaaattaagtaccgtagaacagtgtatatttaaaaaatttgacggtttgacctgggcgtaaggaaatgggcgagtcacaaagtttcacaagaaaaaagcgaatatttcgagaaataaacgtcagatcgaaaaactaaaaaatacgtattnnnnnnnnnnnnnnnnnnntatcgaatgataccaaacacgacgccccacgtagaggggtgggggnnnnnnnnnnnnnnnnnnnnnnnnncctgcgatatttcgcgaagtaaacatcagatcaaaaagtgcaaaatgcatgtattcactatttttgaaaaatctatcgaatgacaccaaacacgacccaccacggaggaggnggtgggggggttagtttaaaatattaaaaaggagcccccattttttattgcagttttggattccttacgtaaaaagaagtaacttttattcgagatatttttcgaattatggatagatggcgctataataggaaaaacgattgttggaaatggnnnnnnnnnnnnnnnnnnnnnnngtctccacttaaatgcaaaactttacttaactttttttggttttaaaacctaatattcacaacccaatagcgctcgagtagctgcaaaatttagaatactttcctcccctactatagcgtttatttgtttaataaattccttatttgcttatttccgtgcaacttttgataaacataaggtcatttaccaagcactaggagagatttgttagtgggatcttttatggtaatagcaatatatttacattatattaaacaaatcagtactagttgtttcataccctaat

SEQ ID NO: 16996 - DNA, 91 bp, Diabrotica virgifera
  misc_feature (13)..(31): n is a, c, g, or t
ataaaggtagttnnnnnnnnnnnnnnnnnnngtatatttgtataattatttagctatatagggttattcgaggaaatctttttcatctgtt

SEQ ID NO: 16997 - DNA, 1096 bp, Diabrotica virgifera
  misc_feature (151)..(168): n is a, c, g, or t
  misc_feature (1012)..(1036): n is a, c, g, or t
gggtttggttgatatttacattattttatctaccagatgcaactgacctacaaacctacctttttaatcttttgatttttgagttgcgcgttgttgccagacgtcaatttgcatatcaaaatgtattttcgttttttggtcaaacggatcnnnnnnnnnnnnnnnnnnataagactttttgttgttctgaagctatttccttgtggcatttttatgattaattgtttatatgggaaggtttttttgtggtttatttcccatataaatgattaatcataagacttttttgctctacattgtgccttctacctatacctttaaggaaccgctgtgtctaggtacacgctggcgtgtgcgcaagtggaagggttgggtacacgcgaaacgtcatcaagtcagtgacgtcactgtttggcatgcactgttactggtctggttttctgcatacacgctaacttgagaatactgcgagtgtcagagtgagtttagaatttatctaatcgcgttgtgttacattttaagattgattagtaaagagattttttatttgtttggtgtttgtttttaaattaactatggagtgtagacaattatttagttattttaatgagtttaacaacattttaaaacagtatgaaaaagataaaagacaaaaaaatcgtgattaagggtagcagaggtattaagataaaatatacaggggcgattgattagtgtgataaagctcagtagatccgctatagtaatagatattatagcaataaaagtttataacaaaaattgtaacaaacttttgagcttattattaccaaaataattagaatgttacagggcgttcgataacattgtgggagaacaaacttatggtttttttaatagaacaccctatattttattttatgttcaaatcttaacgtccccatcacaaaaatataaaagataccgggaatttaccaagttataaccaatttttctatgaaaaatcgaaataaagttccaattccctggttannnnnnnnnnnnnnnnnnnnnnnnnacacacattggctatatataaataaaagggggggagaaagaaaatttaaactcccccatt

SEQ ID NO: 16998 - DNA, 804 bp, Diabrotica virgifera
  misc_feature (2)..(17): n is a, c, g, or t
  misc_feature (19)..(62): n is a, c, g, or t
  misc_feature (70)..(182): n is a, c, g, or t
  misc_feature (191)..(748): n is a, c, g, or t
  misc_feature (760)..(798): n is a, c, g, or t
cnnnnnnnnnnnnnnnncnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttaaattnnnnnnnnnnnnnnnnnnnnnnnnnnnnnnnnnnnnnnnattatt

SEQ ID NO: 16999 - DNA, 855 bp, Diabrotica virgifera
  misc_feature (2)..(24): n is a, c, g, or t
  misc_feature (178)..(200): n is a, c, g, or t
  misc_feature (204)..(225): n is a, c, g, or t
  misc_feature (273)..(291): n is a, c, g, or t
  misc_feature (345)..(365): n is a, c, g, or t
  misc_feature (588)..(610): n is a, c, g, or t
  misc_feature (613)..(667): n is a, c, g, or t
  misc_feature (674)..(693): n is a, c, g, or t
  misc_feature (697)..(730): n is a, c, g, or t
  misc_feature (761)..(795): n is a, c, g, or t
tnnnnnnnnnnnnnnnnnnnnnnnctctctcctacaacggatatgttaaattcagtaatcggtcgagatgaatctctttcatctctctctcaaaatgaaaaatttctcttcctcgtaccttcgtgtatcagggatctctctcattcataatcatcaatctcttcctctttcgaatctnnnnnnnnnnnnnnnnnnnnnnncccnnnnnnnnnnnnnnnnnnnnnncctctaacgaaacggttaactcgtttctaaatatcatctaattttccnnnnnnnnnnnnnnnnnnnctcaatctaaacaataatatttaatcaattcaaataatttttctcattaattcnnnnnnnnnnnnnnnnnnnnnagggatcgagctctaaataatataaatctttcaatctcaaatatttaaattctttcaaaatcaaataattaagagattaaaaatattcttcataatctttcaaaataacggttatctaacttcatttctcatcataattcatctaacttctcatttttcatcaaatttttctcattaaaataataaatttcaaattaatcttaaaatttaagtaatcggatgnnnnnnnnnnnnnnnnnnnnnnncgnnnnnnnnnnnnnnnnnnnnnnnnnnnnnnnnnnnnnnnnnnnnnnnnnnnnnnncaccggnnnnnnnnnnnnnnnnnnnntggnnnnnnnnnnnnnnnnnnnnnnnnnnnnnnnnnnattgaagagccggggtattttggaccggggnnnnnnnnnnnnnnnnnnnnnnnnnnnnnnnnnnngtggaatggaggggtggatgaaaaaaaaacggtcttatttaatctataaagaattttatt

SEQ ID NO: 17000 - DNA, 902 bp, Diabrotica virgifera
  misc_feature (765)..(784): n is a, c, g, or t
  misc_feature (879)..(879): n is a, c, g, or t
tcacgttaatatacttgtaatttactcattataaaaatatggatactgaacttaataacgaaagtgatgctgaactaagtgagcttgaagataacaatgaagaaattccaaaccagatagaggaatcagctgattcctcggattctgagaaatctgcggatgatattgattttgttatcgataaggagggagtgccagactcgacccaggaaaaatcagaaaaagagaagctacttgatgaaatattcaaagattgtccaatttcattcaaagaaaaaaaaccgaaggtcaaaaagattaaaaagaattcttttatcagacaaacacttgcagacttagggtttaatgatgatggaacactaaggagtaaacctcaccataaacagaaaaagctgcttactaagaatcaacgagatgaagttaaaaaagccttaaagaagtcagttataacaccagaattcgaaaaattgcatgtagtaccgcctttggatgtatcggagaaaaaattaaaggaacaaagaaagaaagaaaggtctctaaccaaaggatctaaatggtatggactgcctgcaacagaattaactgacgaagtcaagagaaatttggaagttttacaaatgaggtcagttttagaccccaaacatttctacaagaaaaacgatttgaaagtattaccaaagtacttccaggttggtaaagttatggactctccacttgattactataataatcgtctcacaaagaaggagaggaagaagacactannnnnnnnnnnnnnnnnnnntgctgaatttaacaaatacaataagaggaaatacaaagaaatcatcacagaaaaacaacaaactcattataaggcttggaggcaagcaaagaggntaaaaaagaaaaaatagtagggc

SEQ ID NO: 17001 - DNA, 775 bp, Diabrotica virgifera
  misc_feature (2)..(16): n is a, c, g, or t
  misc_feature (35)..(63): n is a, c, g, or t
  misc_feature (71)..(183): n is a, c, g, or t
  misc_feature (192)..(746): n is a, c, g, or t
  misc_feature (758)..(758): n is a, c, g, or t
  misc_feature (769)..(769): n is a, c, g, or t
cnnnnnnnnnnnnnnncgtgagagaatatctttcnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagcttanatttttttaanagacga

SEQ ID NO: 17002 - DNA, 968 bp, Diabrotica virgifera
  misc_feature (5)..(771): n is a, c, g, or t
  misc_feature (778)..(815): n is a, c, g, or t
  misc_feature (849)..(871): n is a, c, g, or t
  misc_feature (880)..(899): n is a, c, g, or t
  misc_feature (928)..(956): n is a, c, g, or t
atgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgggacctcgatgttggattaagtttataatggnnnnnnnnnnnnnnnnnnnnnnntggtcgacnnnnnnnnnnnnnnnnnnnnagttaaaccggtgtgaagccagttgttgnnnnnnnnnnnnnnnnnnnnnnnnnnnnngtacgaaaagga

SEQ ID NO: 17003 - DNA, 338 bp, Diabrotica virgifera
  misc_feature (2)..(20): n is a, c, g, or t
  misc_feature (56)..(84): n is a, c, g, or t
  misc_feature (201)..(231): n is a, c, g, or t
cnnnnnnnnnnnnnnnnnnngttaactgttaaataaaaattgatacattagaatannnnnnnnnnnnnnnnnnnnnnnnnnnnngatttttatttgattgttggtgtgaaagcctggatgtaaaacaaattcgacgttttgattttataacgatttttatttttgagctattaacgtaaagtatttttacgatacgacttnnnnnnnnnnnnnnnnnnnnnnnnnnnnnnntgagtttttaagtattaacatctattaatataatatctgtatttagtagtggtgattagaatacaattttgctattgttcatattattatatccaattaataacttt

SEQ ID NO: 17004 - DNA, 675 bp, Diabrotica virgifera
ctttgggcgccggttactgtgtagcagatgcggggagttttatgtgtatttgttcttaagaagaaaattattatattctatacttggataaatgtgtgttatagtttgctatcccgtggtgaagataaatatctttgtactgattttgtattgtttcactttattttcaatactcatttacattcatgcgttaaaaattattattgaataaagttcgtacgctgcttgaattatcacgaacgagtgctatttggcaaggataatgcactcgattccatttatgatgagagagtatggcaacgtatcgctatagaatactcgatctcttaaattccacaccaattatacgataccctctagagaataatagatattctggtataccgtcttgtaatgatatatctttaatgtacgggtggctaatctaatttaatcctgaaatctaaggcttgccttcttcttcatcataaggtgtcgattcttaacgtatggtgtagtgcagaatggctatgtcaacattgattgctgttaatgtgtttatacaaggttcaagatgtatcaatacaattattgaatctttggtgaccagagatgcttataatacctgattcgatcgagccacataccttgaccagaagaatactttcgaagcatcccagacctgagttttttcct

SEQ ID NO: 17005 - DNA, 659 bp, Diabrotica virgifera
  misc_feature (2)..(15): n is a, c, g, or t
  misc_feature (17)..(46): n is a, c, g, or t
  misc_feature (53)..(84): n is a, c, g, or t
  misc_feature (95)..(130): n is a, c, g, or t
  misc_feature (135)..(162): n is a, c, g, or t
  misc_feature (206)..(226): n is a, c, g, or t
  misc_feature (231)..(245): n is a, c, g, or t
  misc_feature (247)..(285): n is a, c, g, or t
  misc_feature (291)..(309): n is a, c, g, or t
  misc_feature (314)..(356): n is a, c, g, or t
  misc_feature (495)..(544): n is a, c, g, or t
  misc_feature (569)..(590): n is a, c, g, or t
  misc_feature (599)..(624): n is a, c, g, or t
  misc_feature (626)..(652): n is a, c, g, or t
cnnnnnnnnnnnnnncnnnnnnnnnnnnnnnnnnnnnnnnnnnnnntacctcnnnnnnnnnnnnnnnnnnnnnnnnnnnnnnnntcatttatccnnnnnnnnnnnnnnnnnnnnnnnnnnnnnnnnnnnncatcnnnnnnnnnnnnnnnnnnnnnnnnnnnncgtaacgaaacgttattcgtttttcaaatatcatctaattttcnnnnnnnnnnnnnnnnnnnnncttcnnnnnnnnnnnnnnncnnnnnnnnnnnnnnnnnnnnnnnnnnnnnnnnnnnnnnngggacnnnnnnnnnnnnnnnnnnncatcnnnnnnnnnnnnnnnnnnnnnnnnnnnnnnnnnnnnnnnnnnncattttaaaatacgttatcacttctcctttcacatcatcctctcttcctcccccctaaatttcctctccaaatataaatttaaattctcttaaatttagtaacgatgataatattcgtattaaaaaatcgtatctttannnnnnnnnnnnnnnnnnnnnnnnnnnnnnnnnnnnnnnnnnnnnnnnnncgtttcttaaaaacacgtcttttcnnnnnnnnnnnnnnnnnnnnnncgcccaccnnnnnnnnnnnnnnnnnnnnnnnnnncnnnnnnnnnnnnnnnnnnnnnnnnnnnagttttt

SEQ ID NO: 17006 - DNA, 1018 bp, Diabrotica virgifera
  misc_feature (180)..(200): n is a, c, g, or t
  misc_feature (209)..(223): n is a, c, g, or t
  misc_feature (225)..(299): n is a, c, g, or t
  misc_feature (311)..(550): n is a, c, g, or t
  misc_feature (552)..(602): n is a, c, g, or t
  misc_feature (611)..(667): n is a, c, g, or t
  misc_feature (675)..(704): n is a, c, g, or t
  misc_feature (712)..(726): n is a, c, g, or t
  misc_feature (728)..(746): n is a, c, g, or t
  misc_feature (783)..(799): n is a, c, g, or t
  misc_feature (801)..(853): n is a, c, g, or t
  misc_feature (867)..(902): n is a, c, g, or t
  misc_feature (909)..(934): n is a, c, g, or t
  misc_feature (942)..(1014): n is a, c, g, or t
gatgaagtggttcacctgtatactccttgttggtgtctgcgccagccaggtactattagctcctaccgaggaaaaaaaagatttagctactgttttgttgtattgagcagctgtacgtgacttttatatcgccaagatattcttttagagccttgtgtttgacgaatcattagttgatgnnnnnnnnnnnnnnnnnnnnntatttaatnnnnnnnnnnnnnnngnnnnnnnnnnnnnnnnnnnnnnnnnnnnnnnnnnnnnnnnnnnnnnnnnnnnnnnnnnnnnnnnnnnnnnnnnnncttttaacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnattattagnnnnnnnnnnnnnnnnnnnnnnnnnnnnnnnnnnnnnnnnnnnnnnnnnnnnnnnnnatataagnnnnnnnnnnnnnnnnnnnnnnnnnnnnnntgcgcgannnnnnnnnnnnnnngnnnnnnnnnnnnnnnnnnnatttttattcgaagctgaaatgaagcgttggatgagnnnnnnnnnnnnnnnnncnnnnnnnnnnnnnnnnnnnnnnnnnnnnnnnnnnnnnnnnnnnnnnnnnnnnngacgagagaccccnnnnnnnnnnnnnnnnnnnnnnnnnnnnnnnnnnnngattagnnnnnnnnnnnnnnnnnnnnnnnnnntggggggnnnnnnnnnnnnnnnnnnnnnnnnnnnnnnnnnnnnnnnnnnnnnnnnnnnnnnnnnnnnnnnnnnnnnnnnngtgg

SEQ ID NO: 17007 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (150)..(150): n is a, c, g, or t
  misc_feature (168)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtggagnccaggttggtttctatcnnnnnnnnnnnnnnnnnnnnnnnnngaaagga

SEQ ID NO: 17008 - DNA, 914 bp, Diabrotica virgifera
  misc_feature (463)..(482): n is a, c, g, or t
  misc_feature (717)..(734): n is a, c, g, or t
  misc_feature (850)..(850): n is a, c, g, or t
atacaattatccattttattgccaaaggaataatgacactaccgccatctttcgaagttggaagtaaacatctatgtgactttttttctggtaaaagtatagggtatttgcggtcaatttaacaagataagatatattatgcactttacttaacttgaaacgcggcgttagggtttatcaggtggagcgcggcggaagcgctcgcatatgtacaaagttttagatgatatttacaaccttttgagattagtattaaaatggtagacaattgaaggaataactccgtttctctccccagatatttttggttgtgtcttcttttatcaaaattcgaaatttttttaatcgatctacattttgtaatctattacaattacattatagttgatttttgctgtatgttaaaaaaacttctaagtaagtttatttctaattaggatacttgtgaccaactagcttgtcnnnnnnnnnnnnnnnnnnnntcctgttttgtttgggtaaattcatggtagagactcatctaatacgtcatgactcatgtcatacgatccaggatagtattgtactacaatttcctaactataattagaaagaagcttgtgaaactgtttccagttatcatttctttcaattgatgacgcaccaacacacaactgcacatatatgtgcactcttgcattgttctggtcccctttttctttgccaaatggcggtcgnnnnnnnnnnnnnnnnnncattcaatcgatcaataagttggtataacattcgccattgatttttccctttttgaagtagtcaatgtggattataccgcgtgattcctaaaaaacggtcaccatgactttattgnctgacaaacctaccttttgccttctttggcgacgatccaccccgagaaacccactgttttgact

SEQ ID NO: 17009 - DNA, 629 bp, Diabrotica virgifera
gaataagatattttttagtttttgtaacatctgaatttattaaaaggtggacagggatcctagcttttgtgttagggactctaaactatgcatctaatgaaccatctcagaccgcctcgatagtctttgacgctggttacagaaactttgcctgagcatgtgtctaagaacagtaagctgataacagagaaatgctttaaaggataaaattgactattcacgaggattatggataaaactttacatttccatctacagtctggaactacgataacgaacaccgtaaatggtggaaccataattccaaacgagtctaccaccaatatgaaatttattatccaaattgatatacaatctgctggcgagatactcttaaggaagggggggctccgctacctaatggcacgtaccataatcttcgtgtaatcttcaacatgattgatcatttatacacgtgacaggcagcagagcaactcgtcttaacatagcttatcctagtcaatgttcttcttcaacttccgatactcttatcactacgagttgattctctgctaaaggcataccatgaaacctaccaatacccgcatcgaatgactcccataccttaaccagcagaatattatcgactt

SEQ ID NO: 17010 - DNA, 643 bp, Diabrotica virgifera
  misc_feature (445)..(466): n is a, c, g, or t
aaattgtaaaaatataaccttactgtcaacgataagtaatacctagggccggtatttcaatagctacttaagcttttgcttagctaagcctgtgtcaaaagttaaggagaagcttaagctgggtgccgtatttccatcattctcttaactaaactgatgctcagctgtaaagttaattggtttggtacctctgaatacgtcaaagtgccagagctaactgttctgaggtaaaaaccactactgttgacatttaattttatcttgtcatctgtatcaatgttatttttacttcacttaattttgtgtacatggtacatgtgtttttagtttattgtctatattttctctggttatatttttattgttattttgcataagcaatagatccgtctttgaaattttgtttattggatattccttaaaatgtcaaattggaatgtaagannnnnnnnnnnnnnnnnnnnnncctaccaagcattgtagaaataaacaattttcatgtgcctacaccttccaaaagtagtaagaattttaataatcgttattacgattaacaaattaatagattattatttaataatccaataataacgttattacttaaaagttggttttcaaaacaactctataattaatattctat

SEQ ID NO: 17011 - DNA, 343 bp, Diabrotica virgifera
  misc_feature (6)..(6): n is a, c, g, or t
  misc_feature (8)..(24): n is a, c, g, or t
  misc_feature (26)..(86): n is a, c, g, or t
  misc_feature (88)..(133): n is a, c, g, or t
  misc_feature (138)..(170): n is a, c, g, or t
  misc_feature (172)..(233): n is a, c, g, or t
  misc_feature (238)..(239): n is a, c, g, or t
  misc_feature (241)..(294): n is a, c, g, or t
  misc_feature (303)..(341): n is a, c, g, or t
atattntnnnnnnnnnnnnnnnnntnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnatatnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnngaggnngnnnnnnnnnnnnnnnnnnnnnnnnnnnnnnnnnnnnnnnnnnnnnnnnnnnnnngtaaaagcnnnnnnnnnnnnnnnnnnnnnnnnnnnnnnnnnnnnnnnat

SEQ ID NO: 17012 - DNA, 720 bp, Diabrotica virgifera
  misc_feature (347)..(364): n is a, c, g, or t
  misc_feature (442)..(462): n is a, c, g, or t
  misc_feature (508)..(535): n is a, c, g, or t
  misc_feature (540)..(563): n is a, c, g, or t
  misc_feature (611)..(630): n is a, c, g, or t
  misc_feature (662)..(674): n is a, c, g, or t
  misc_feature (676)..(699): n is a, c, g, or t
cgcgcccgcggtcgggtggttactgattcttctctcctttttcggttttaattagcgacaccgacaaatatcatttagtgagagtgaattgagtctcgtgtgacaatatttttttatgtatcgagcaaaatgtatcttttgcaccatgtatatcagcgctaattatttaatacggatgtatctcattatgttcaacattagaagagctgaaagattaacgtttttcttggcaaataacgattttaagtgcttcgttttgaaatgaaaagtcattcgcttttatatatatcgaattcgataagaaatccattcattttatccatgaacgacagacttataagtaaacnnnnnnnnnnnnnnnnnngtatatatttttagagatgatacttaacgataaaaatttattcattaggtagttcttaaataaaaattcagattaccnnnnnnnnnnnnnnnnnnnnngatattatctacttttatatattatgattcttatgtttaataaccnnnnnnnnnnnnnnnnnnnnnnnnnnnnctatnnnnnnnnnnnnnnnnnnnnnnnncattaaaaaattgcctatttagtaaaaacatataggtttaacaaagtnnnnnnnnnnnnnnnnnnnnccctgcttattaccaacatgtctttgtgtacnnnnnnnnnnnnngnnnnnnnnnnnnnnnnnnnnnnnnagcccgcgcgacgttgaccgc

SEQ ID NO: 17013 - DNA, 494 bp, Diabrotica virgifera
  misc_feature (414)..(414): n is a, c, g, or t
  misc_feature (417)..(417): n is a, c, g, or t
  misc_feature (444)..(444): n is a, c, g, or t
  misc_feature (461)..(461): n is a, c, g, or t
aaccgatcataaggaaagttccagtcgacaaagttaaggtttaaaaagttaattctagataacgcgttttattaaaattcagccacaatgaacgaacctcctagaatttactatgaagaagaaagtcagtcagacaaacttctcaggaaatctaaagaaacacctgtctttccaattgctattggtatttgtgctgcagcagtaggatatggaatatacgcctataaaaacaaaggaaaaatgagcacaagtgtatacctaatggcaccttcgagttggagcacaaggagcggcagtaggatctttaacactaggtttgatatacacaatggatcatcgacatttcctgaagaaaccagaatagttacctttttacaagaaattatgcgctcttaatggtgtacgatgtatctnganagtatttataaattatcattttttaancatgtagtaaactaggnatttgatataaaaaacgtttcaggatatatcta

SEQ ID NO: 17014 - DNA, 761 bp, Diabrotica virgifera
  misc_feature (28)..(562): n is a, c, g, or t
  misc_feature (569)..(606): n is a, c, g, or t
  misc_feature (626)..(639): n is a, c, g, or t
  misc_feature (642)..(664): n is a, c, g, or t
  misc_feature (672)..(694): n is a, c, g, or t
  misc_feature (724)..(755): n is a, c, g, or t
tgataatattagtattatcatcattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 17015 - DNA, 229 bp, Diabrotica virgifera
  misc_feature (159)..(175): n is a, c, g, or t
  misc_feature (177)..(194): n is a, c, g, or t
ctgttattagaaggaaagatcttcagggtatataattaacgtggacaaatttagtattagggggtttccaaataaagagtcgtgagtacggggtttcctcgtgtagaaaatgttatatatccacgtttatatatgatgattatgatggattgataaccnnnnnnnnnnnnnnnnngnnnnnnnnnnnnnnnnnnggtagtagatgatgattttggaactaatacttgtc

SEQ ID NO: 17016 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17017 - DNA, 934 bp, Diabrotica virgifera
  misc_feature (880)..(880): n is a, c, g, or t
  misc_feature (918)..(918): n is a, c, g, or t
agtaaagaccagtgaagtgaagttactgtggacattattcttgataaaaaaaacgttttatgacctcttcaaattaacgactacgattgagaaccatccacacccatagcgacccgaataccacccaaacatggatcaaatcccccctccaaaggaggttaagatcctcgaaaccgccgaggatatccaggaacgtcgtcaggaagtcttatcccgctacgacaacttcaaagccgacgctagagctaagagggagaagttagaagattccagaaggttccaatacttcaagagagacgccgatgaattggaatcatggattttggagaaactacaggcagctagtgacgaaagttacaaagatcctaccaatttgcaagctaagattcagaaacatcaagcctttgaagctgaagtcgctgctcatagcaatgctatcgtcgttttagacaatactggtagagagatgatcaatcagaaccattatgagagcgaaactatcagaagacgtttggaggaacttcatagactttgggaacaacttctttccaaacttgccgaaaaaggcaccaaacttcaacaagctctcgttcttgtccagtttattcgccactgtgacgaagttatgttctggattaacgaaaaaagcgcttttctttccgccgaagagtttggacatgatttagaacacgtagaagtcttgcagcgtaaattcgacgaattccaaaaagacatggcttcccaagaataccgagttacagaagtcaacgaactggctgataaattgctacatgacggacagagagagagaccaaatcatcacaagaaaagaagaataaataacgcttggcaacgccttaagcaatgacattgatgcgtncagacaaactgtatggcgctcatgaaatccagcgctancacagagatgctgacg

SEQ ID NO: 17018 - DNA, 64 bp, Diabrotica virgifera
  misc_feature (14)..(15): n is a, c, g, or t
  misc_feature (34)..(35): n is a, c, g, or t
  misc_feature (47)..(49): n is a, c, g, or t
  misc_feature (57)..(58): n is a, c, g, or t
cgactcactatagnnggaaagctggggtacgccnntgcaggtaccgnnngtccggannattccc

SEQ ID NO: 17019 - DNA, 860 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(754): n is a, c, g, or t
  misc_feature (777)..(777): n is a, c, g, or t
  misc_feature (782)..(794): n is a, c, g, or t
  misc_feature (797)..(842): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnaaataataataacatattttaanatatnnnnnnnnnnnnnccnnnnnnnnnnnnnnnnnnnnnnnnnnnnnnnnnnnnnnnnnnnnnnctcatccctaaaatattt

SEQ ID NO: 17020 - DNA, 794 bp, Diabrotica virgifera
  misc_feature (476)..(495): n is a, c, g, or t
  misc_feature (564)..(564): n is a, c, g, or t
  misc_feature (640)..(640): n is a, c, g, or t
  misc_feature (705)..(706): n is a, c, g, or t
  misc_feature (754)..(754): n is a, c, g, or t
acgacgtagtttatggatgcctccatatcggcctttgacggtaatccatgaatattatattatactaatacgtcactacagagttctaaaaacaatagttttttacataaaaccagactagaaatctaaaaattaaaggaataacgcagaaaatacaaaaaaatcgccgatataactttattaatctatgaaatgccaatagtgtcaagttttataaatgtgattagtgtcaaaatttgataacagtggagtaaacttgcctgaggttggaccaattacaaacaagctttacgcgggaaatttgaattacttatcttcttttaaaaacagattatagtactttttgtattcgatttaattttactctaacttcacggaagaagtaactaaaatatatactctgaaaaaataaagtctacactcttctttacacctgtacttgatggatatcatatttaggcgctgagtagcgatgnnnnnnnnnnnnnnnnnnnntaaaactatttataaataaagtatatagattgttttgtttacgaatatgttttacaattgtataataantatttaagacgtttattactgttgatattcgaaagatgaaagtcagtattttaattgttaataacatttaataggncgagagccagcgacagtcaaattattactctttatagtatggtactaaggggtgctgtatatgannggtaggatttcataagtgattttcaatactattgtatttgggtatggngtaataggctaatatttgtatacgatttttcagcgctgcc

SEQ ID NO: 17021 - DNA, 903 bp, Diabrotica virgifera
  misc_feature (679)..(679): n is a, c, g, or t
  misc_feature (708)..(708): n is a, c, g, or t
  misc_feature (859)..(859): n is a, c, g, or t
  misc_feature (872)..(872): n is a, c, g, or t
atcaggaaatggaccgggttttggaccagcagatttagaatagctcaacacatagatggttttgccatgttaatcgccaaaatcaagcacacttaattacgcaagaagcatccaattggcttattgcacttggtagtgtttttttgtctcgctgtccatattcccacgagttgggacgaaaaactgccaggtactgaggtgagctgcagtgctaaggctctaaaccccgagttcgctagctctctggggtttcgtttaaggcaacactttctcccatgagcacgatggtgttacactttgagattatacgagcattattgtccctgacccattataggagcaggtctgcattcaacatacctgcccccccccctaaaggtgtctccacacgcgacagaaaaacctttcctggaggcgggcaagcaagcctacgagctacaggactgtgtagatggggtgggaggtaggcctaaagtcgattagttatcagttgtactagttgtgttgttagatttagttttctcatataatcatggcccctgcaaaacaaaatcaagaggaatccatctattcgcaaataattgtgccaatatttcgaactgaacctcgattcttttaacaaatttatattggcagtaagctttccttttctacagccagtatttggttcacaatgttncgctttttttgccttcataaatatattcncttagtgtgtggaaactcgcattctttttaggtttacctcgaggcatgccttcggacattcctttgcgtatcgaggcaacagtacgctctcagaagctggtgctgaaggtttgcctgtagggccctgattggggcatggcaacctatttgngacagatacaggntccgccacccgtctctactcttccctttcca

SEQ ID NO: 17022 - DNA, 884 bp, Diabrotica virgifera
  misc_feature (326)..(345): n is a, c, g, or t
  misc_feature (363)..(378): n is a, c, g, or t
  misc_feature (380)..(393): n is a, c, g, or t
  misc_feature (727)..(728): n is a, c, g, or t
  misc_feature (817)..(817): n is a, c, g, or t
attttttgaaaggaggtatcagcatctgtttcgtccagatcctcattaaaatacatataaaaatggcttttggagatttaaaaacagaaaagggagttaaggagctcaactccttcctagaagacaaaagctatgttggaggctatatcttaagccaagccgatgtaaacgctttcaatcagcttccaaaagctccagctgccaatttaccccatgctttacgttggtacaatcacatcaaatctttctcagctgatgagcttaaacaggccggagtctcaggtaaccccttgaaatctgctcctaccaccacagcacctgccaannnnnnnnnnnnnnnnnnnnttgatctatttgcctccnnnnnnnnnnnnnnnncnnnnnnnnnnnnnntacgtgaagaaagacttaaagcctatgcagaaaagaaatccaagaaacctgaattaattgccaaatctagcattgtacttgacgtaaaaccatgggatgatgagactgacatgaaagaattagaaaaagtaaccagaacaattgaaatggatggtctcatctggggagcatcaaaactcatgccagtaggatatggtatcaacaaactgcaaattatgtgtgttgttgaagatgccaaagtatctattgatgaattagtggagaagattcaagaattcgaagactacgttcaatctgtagatatggtatcaacaaactgcaaattaatgtgtgnntgttgaagatgccaaagtatctattgatgaattaagtggagaagattcaagaattcgaagactacgttcaatctgtagatattgctgcngtcacaaaatttaaacaactggtactatatttcttatgtatttttatgaattaaagcatcattttaa

SEQ ID NO: 17023 - DNA, 404 bp, Diabrotica virgifera
  misc_feature (191)..(216): n is a, c, g, or t
tagttgattactatagtatctgtttactattctcatatttaagagagcaacacctataaaggttttagtcgacgatatatctttattaatctatgttatgacgataaggtcttgctgtttttatgttgttcagagtcttttattaaataacattagcattgaactagcatgagtatatatataattcaacnnnnnnnnnnnnnnnnnnnnnnnnnncttatactgcctgtactgaaagattatatttctttttgtattcaattttattttactcttacttcactgaagaattacctattagacaatgtctgaatatatatgtctacacactactatcaccagtcttagagattattaaatataggagctgagtagagcagtcataattttggattgtttgctaa

SEQ ID NO: 17024 - DNA, 839 bp, Diabrotica virgifera
  misc_feature (762)..(762): n is a, c, g, or t
  misc_feature (794)..(794): n is a, c, g, or t
gtctcctacgtcacttcttcgttttttattttgtctcacagagttattcccaacatggttagttccattcttctgtgtgcgactctcagtttggtagctgagtattttgttacggtaaatatttctgctccgtatgtcaaaactgggaggacgcattgatcaaatacttttctcttcagacatgtgggcaactcagtttccatatgctttccacccaagaccaatttttctcttcagttcatgggtctgattcattatcattctctttgccttattcctatgcggggtcggcttccctaattacatttctccactcaattctatcttgggtcatatcaatgttaattccctttaccaaaatgtcctgccttatcgtctccccccaggtcttctttggtcttcctctcctactccttccaggaatctgcacttcagctattcttcgtattgggtgattaacatctcgacgttgaacatgaccaaaccatcttaacctatgcactcttattttggcatcaattggtgccacacctagacttcccctaatatactcatttctaattttatccttctttgtcactccactcatccatctaagcattctcatttccgccacatgcattcgttgttcctctttctttttcactgcccaacattcagttccgtacatcatagccggtcttatggctgttttatagaattttcccttcagcttcattcgaatttttctgtcacacaacacatcgcttcttttcactttantcatcccaaccctaattctactgcatgcatcntcatctatttcttttatactctgtaataccgatcctaggtactta

SEQ ID NO: 17025 - DNA, 296 bp, Diabrotica virgifera
  misc_feature (171)..(188): n is a, c, g, or t
  misc_feature (194)..(217): n is a, c, g, or t
aaattgatttttggtagcactgagtatctgaggattgatagttaactcctaagtattctttgtatagtcgcatataaaagagctaaacagttaaaggtggttattgtagaatagatattccccataatcttttagtgctgagatggtcttcgatttttaagatattccgcnnnnnnnnnnnnnnnnnntcttgnnnnnnnnnnnnnnnnnnnnnnnnctaaagatttttatatcattaatatcaaacatttttcggcctgccctctatctatacactcttcttgaaatttagtttt

SEQ ID NO: 17026 - DNA, 489 bp, Diabrotica virgifera
  misc_feature (10)..(10): n is a, c, g, or t
ccttacgcgnccgatcatttcttccgaagcggacaataaaatatagtgcgggagtttgtaagatctagggaattaatcaccacgacggagggcagttatcagtgggcgatacgaatttatctttagttgagttaaccgaatatgtcgtaccgtgcggctccttaagaactacctgagaacgaccgaatgataactttcttcatatgacgagcaaatggagcaaagatattacctgtaaagtaactaccatggaaaattgttctgcattgaaaaggtattcgggattcgatatccctgactttttcggacagacttcggctttatttattcactagattcttatatactaagatcattatacttttaatatatgatagatatacctctgctccttgaagttctgtcttatcgtaacctaactgttagataaagactattcctaagattgtccctccgttaaaatatgctatcattaatcttcatatatta

SEQ ID NO: 17027 - DNA, 104 bp, Diabrotica virgifera
  misc_feature (5)..(98): n is a, c, g, or t
cggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaac

SEQ ID NO: 17028 - DNA, 129 bp, Diabrotica virgifera
  misc_feature (7)..(118): n is a, c, g, or t
taatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgagaaac

SEQ ID NO: 17029 - DNA, 348 bp, Diabrotica virgifera
gggcattccaatttttaacgttaacaacctttgtgagaccggaaccagaggaagagagaagcgcaaaaaaacgagagaaaaaaggaaaagggagaagcgatttttcactgacccacaccaggagaaaaggaaaagcagagggatgcagtacagatacagaaagtataaaacaatgagaagcaactgagaagcatgaagatgagataacaaataactggcgtaaacagagctatgcaaggatactaacgaagcaggagagaaaaacgctaaatatgttaagaaaaaatatgtagctcttcatcctgctgctctcagtgagtagagacgagtgacagaaaaacacgatga

SEQ ID NO: 17030 - DNA, 140 bp, Diabrotica virgifera
catttacggggccggccaaaggggggaagagagcgagggagcctgtgggccgccagcacgagaggggaaaagagcagaagagggaggggaggaaggagagggcgaagcgatttttttttgggcggggcaaagaggagacg

SEQ ID NO: 17031 - DNA, 98 bp, Diabrotica virgifera
gacgagaaaaccacaataaacaaacagcccaccgagaacacacctacaggcacaataaaggatttcaggaacattttgttcaccagctcaacaacagc

SEQ ID NO: 17032 - DNA, 240 bp, Diabrotica virgifera
gccccacgggaccgagaataaccttttatccctttcgtattgaaatgtaaattaaaatactgtaaacttatattttactaaacaaattaaattatttaagtttctctgggacgagaaaatgagactaaaaaaatagtctatttagcaacactcatatagggataataatggaattcaggaacattttgttcaccagtgtattaaaagcatggcctttggtgtttaagataccgacgcgcc

SEQ ID NO: 17033 - DNA, 562 bp, Diabrotica virgifera
  misc_feature (2)..(437): n is a, c, g, or t
  misc_feature (444)..(481): n is a, c, g, or t
  misc_feature (501)..(514): n is a, c, g, or t
  misc_feature (517)..(532): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttgaatnnnnnnnnnnnnnnggnnnnnnnnnnnnnnnnattaagtctgttcgactttttaaattttac

SEQ ID NO: 17034 - DNA, 908 bp, Diabrotica virgifera
  misc_feature (43)..(61): n is a, c, g, or t
cacaagagttgcagctgaaacctttaaaatcccaaggagaacnnnnnnnnnnnnnnnnnnnggagtacacgctggaaaaccaggatacccaacaatattctcgtacgaagaggaaaggtgcttcgtacaatgtattcagcgccttagtgatgttggttttcctgttactgggatggaattgcggcaaataataaagagctatttaaattgccaaggaaaaaatattactcgctttaaggataatactccaggtatcgattgggtcaaatcatttttaagtcgccataaggaccttactgcaaggatagcctcaaacattaaacgaagcagagcagcactcaatgcagaccaaatgactgaatacattgaaaatttaagacaaactataactggtgtggagccagatgctatttttaattatgatgagactaacttaacagatgataccgaaaaaaaaagctattaactaaacgtggggttaaatatcctgaacgaatttgtaactcttcaaaaagtagcatttctcttatgatgtgtggaaatgcagctggtgagctactacctccttatgtggtgtacaaatccaagaatttgtgggacaccgggactgaaaatggcccctctggtaaacgttatgcaaatactgcctctggttggttcgaatcacagacatttgcaaattggtttaacaacattctattgcctaggcttaaaaaaattcagggaaagaaggtcctttttattagacaatttgtcttctcatattaatgtcctgcatttgtgtcgaaaacacaacattcattttatatatttgcctccgaataggacccccgttacacacccgttagatgctgcattatttgctccaatgaaaaaggcctggaagggaaattttatctcaatataag

SEQ ID NO: 17035 - DNA, 906 bp, Diabrotica virgifera
  misc_feature (787)..(787): n is a, c, g, or t
  misc_feature (799)..(799): n is a, c, g, or t
caatattttaatgaataattacatgatatataaaggtataaaatttataattacaataaatcttatgaataaataaaacgttgccaaaagttgtaaaaacccaaaataagctgactaacaatgctaaaaatactttgaaggaaaaatatcgatcttataatgataacatgcaattggatttgtagttttaatatacaaaatgtcgttttctattcaaaacattcaaggaatactttaaaataacaagcaagagatgttaagtacaataacaagatgtctatataattagactgttaattcattcaaaacctaccatttttcaaatccatttttgcagttttgttcaaggatgacatgtctatgtgcagaagatactgcaacggacaagacttgatggtctagtatgatgaatttcatatatttctaatcacaaaaatggaatgaaaatccaaatcattcaaactaagacatctttccatattaattacaaatcctttcatcatcaattcgtctcttattgctcatccttgtccttagccccgtgctttaaaatgcgggtgaattcaacataatcaaacaagccattcttaataggagcctccctgtacatctcgtcaacttcatcgtcagtgaatctatcacccatggacgtgaggagctccctgagacgttcttcgttgaggacacccattgttgtcttcgtcaaagcagccaaaagcgtttttaattacgtctttctgggtctgtgcccttgtagacgttctccaaagagagttaagacaatggntgaagtttatgngaccaggagcttcattcatcatgccatctagatagtcatccaggtgggttttttacctaaaagaagcaagcatatcatgcagatcttctttatctacaaaccattca

SEQ ID NO: 17036 - DNA, 449 bp, Diabrotica virgifera
  misc_feature (19)..(19): n is a, c, g, or t
  misc_feature (210)..(210): n is a, c, g, or t
aaagagaaaaggaagagantaaatagtatttgtgtattgttattagataattatttgaatatagttatttgaaaggagagagaataaatatagatgaaattgtaattgtatgaaaaatattgaatggataaaaatatgtaattgatgagaaatttagaaaatgttttggtaatgtgaatagatggttaaataaaattgattaatagaaanaattgatagatgtaattgaagaagttaaagtttgtgagtgaagttgctcaaccctggaactttagctgctgcagatgcaacaccagggaaaggaaagaaaaaggaagaaatgaaccaagataagaagccgcgaacgcctaaagacatgaaggaaaaggaacagttagaagaattagatgctgcagaagccggtcttgttgaagaacccaagaacaaggaccctttttttgaactaccta

SEQ ID NO: 17037 - DNA, 173 bp, Diabrotica virgifera
ttttaaggggccgatgagagtggggaagcccgtttcccctttgaaaatatgtggaaaatagagggacaggatgggtacttggtaacgacccatttacatcataggagtttctcaagagagacgtaataggacacagggaaaatttgggtgatgagaagacttcatgggggacg

SEQ ID NO: 17038 - DNA, 342 bp, Diabrotica virgifera
aacagaccaccgagaaaaccccaacagggacggaccctgcttttgaagaaaacgagcggcaagcagctgcaacacagacacgccatcgtttactatgataccgacgcacaccgaagagtgcaaagccaaaacgaaagagtacccctcctcgaagcgaatggagtttggtgaaggcgaatctgatccaccaacaagaggttgtgtattcccaacctagaaaagtggtcaaactaacaatgactacgacgagtctctgaaaagagactaggacgaaatttaacccactacggcgatcgtcatcagccagtaacatgcccatagttcctcgaccaggacagagaa

SEQ ID NO: 17039 - DNA, 237 bp, Diabrotica virgifera
  misc_feature (213)..(213): n is a, c, g, or t
cggacgcgtgggttttgattgaattctgaaaactttaccgatggcaatagaatagcctaaaagagcgcaatgactcgattttttgagtgactaaagatctttttgtttagaaaatctcttctgttactgctctatgagaaaactccatatgtagttaaatagaaatagcaaaaaaatgtggtgtatcttaatcgccagttcaagcttgagtanaaacaagagaacatcctgtacatc

SEQ ID NO: 17040 - DNA, 468 bp, Diabrotica virgifera
cccccctttcgcgcccgcccgcccatagcgctgttagattcccctcctttttaatccgtgattatcttctcagatggaggtataagattggtcggtagtgatgagtctaataatatacatatgcgacgcccaaacacaagctttcaacattggtagtataggagtactgagtccacttttccggatatagatttaccatcagccgatagagcggacatgcatagctactattaggatacgactatatctaagtatttagatggacggcagttatgtaatgatttatcgaattgttttagcccttctgaagcactatataccctggataaacggatgcttgctctaatgagaccactatttaatgcacccattcaagctgttttcacccactgtaacatgtatcttctcacaagatagagactagactgaggtcttcgtatcaggtggctccattttatcctgtaatat

SEQ ID NO: 17041 - DNA, 91 bp, Diabrotica virgifera
  misc_feature (5)..(43): n is a, c, g, or t
  misc_feature (46)..(76): n is a, c, g, or t
  misc_feature (83)..(83): n is a, c, g, or t
gaagnnnnnnnnnnnnnnnnnnnnnnnnnnnnnnnnnnnnnnnagnnnnnnnnnnnnnnnnnnnnnnnnnnnnnnnttttaanagacgaga

SEQ ID NO: 17042 - DNA, 517 bp, Diabrotica virgifera
ccttcacgcgcccgccgcaccagacgcgtgactgcgtaatcccctctgttaaagataaaaggaaataatataattgtgaaacaaacgtgagagagattcgcagtatattttttaatacatgctgaggtaatcatcatgcctggaacaacagggaagcaaggcttgtccctgtaatcgtcatacattctagtttcaatatctggtatcactagatccgcaaagactgcttgaactcaacatccagcatgcttatttcagagactcatataagcttatctatatcttgtatttgtagatcatccgatttacttaaagtatctgtgttatacatatattactcagccatgactatgtgtcataacgagtgataacaagaaaagcattatataactaactaataatcagctattcatacaaaacataccaattctagaggaagctgctagtagtaactggtaatacctaagggtcaatacctaccacatcttagatagtagatgtaacttacattgcatac

SEQ ID NO: 17043 - DNA, 432 bp, Diabrotica virgifera
gacaagagaaagacgaacttaccgcacaagaaacagacaacggaaaccaggaacacaccgccaagaagaaaacagaaccaaggaaaaaagaaccagcaacaaagaaacgagaaccgcagaaggcccaagaacagacgaccagaaacacaggacaagacagggcagaaaaagacgcacagacccaaaaacagactgaaaattttgatgaaatacaaacgaactgtgcggaacatttatctaccaaagtcgctgctttgtcaaaaatacataaaaagcccttctggtaacagcacctatgagaatggactggacatacagccacgaaatgaaaatttcaatagaaaagactaaaggacttcatagcacaatatgctaataatagccacgctatccctaatccacttctctagatcccgattgataaaaaaacaa

SEQ ID NO: 17044 - DNA, 533 bp, Diabrotica virgifera
  misc_feature (7)..(504): n is a, c, g, or t
  misc_feature (506)..(532): n is a, c, g, or t
aaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnt

SEQ ID NO: 17045 - DNA, 490 bp, Diabrotica virgifera
acaaggaactagcccttggggcttagggataattagtaaacactttccatgtatgatattctggattataagagggtacgtgcattgcttactacgttgagacgcatattacataccttgtttgtatggaatggtaagtggtgtttaaatgagtagtatgtcctttcgctaaagtaagaactcctatattcaagtaacgtgcttccatatgaatggttctgtaattaatccagagtatccttcgtcatgattgacagatgtataagtattagaatatcagacgcctactgagagtattttatataaaagagctagaactttagcatctaaaaacatgttccagtttacataggaagaacgaacaacactctatgggttattatgagaagagaatgataaagtttttccagttaagaatgctgatgagagtatacaaatacgctgtggatatctacactacgatgattactatatgatagacacatccaag

SEQ ID NO: 17046 - DNA, 51 bp, Diabrotica virgifera
  misc_feature (31)..(32): n is a, c, g, or t
aaaaactttaaaccaatattacaccctattnntcactttgtttcccggcta

SEQ ID NO: 17047 - DNA, 734 bp, Diabrotica virgifera
  misc_feature (336)..(359): n is a, c, g, or t
cctttcgcgtccgctgtctactctaccaccagccattaagaaattattgaattttagtgttattttatttaaagttaagtaataataattagtattattacattatctctattttaaattacgccttgagctggtggtgtgtaaaggatcaaaatgaagcgagatgataataccaaccaagattctgagaatgtaaggaaattagttattggtactatagagtagttatactaatactaagaaatttattatattgatcattatagtttatcactatagtcatatttatataattaatattgagatatttttcatcctacgcctctagttataaannnnnnnnnnnnnnnnnnnnnnnnttaaaacatccagatttaaatctttcatatttgtaaaatataacattagttattcattgatatataattatgataattctgtataaaatttttattaacacgtaaagttaatttatgttatcgctttagtaatagtctgatactactaatatcaatacacttgatatttaataaaaatatgtaaatttaatagatgaatttgataacatttttttcacctcattatttattacatgatcagttttagtatctgatataaaggctcgtctgtccactgattactatgaaggaatcggcttattttagatcgtgataatgtagcataacgatgcacgttttttattgaaaagtgtcacggatgcctgctgcaacaca

SEQ ID NO: 17048 - DNA, 1021 bp, Diabrotica virgifera
  misc_feature (705)..(722): n is a, c, g, or t
  misc_feature (731)..(753): n is a, c, g, or t
  misc_feature (761)..(783): n is a, c, g, or t
  misc_feature (787)..(844): n is a, c, g, or t
  misc_feature (847)..(871): n is a, c, g, or t
  misc_feature (884)..(1012): n is a, c, g, or t
cacctacacgtgtgtcagcgtactgttcattgttaccgctaaaagcaaataatacttcttgtagaacaatcttgagacgatactctccgtacattgtccgatttatactagcccaatcaccatgcgttgcgctatagggatgcaacgcttttccctcgacacgattctactttctagtttcatatctgttatcactacatccgcgctaaactgcttgaaacaccatccagccgcttacttcagtgactcctatcagcttatgcatatcttgtatttctagatgtccgatttagcttaacagtcgctccgctagactagacttctctgccctgactttgtgtcctgacgagtgatgaccggataggccttaataactacctcatactcagctattattacatatcatactgattctcgagaaagcttagtgagtctgctgtatacctcaagcataatacctaccacattttagcatagtagatcgtaacatgcattgcatacttatgacaaccacatctctaataatactacacaactttgggaggccaacgccctcaaatcccacccccccccccattttagtggggaaaaagagaccgggggggtttacccccccccccgcgttccccagagggggtaataccccggggggcctcccccccgcgggcaaaaaaatttctcccccccgggggggggttccccggnnnnnnnnnnnnnnnnnngcccggggnnnnnnnnnnnnnnnnnnnnnnnataaaaannnnnnnnnnnnnnnnnnnnnnngccnnnnnnnnnnnnnnnnnnnnnnnnnnnnnnnnnnnnnnnnnnnnnnnnnnnnnnnnnnctnnnnnnnnnnnnnnnnnnnnnnnnnccaccaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccccac

SEQ ID NO: 17049 - DNA, 113 bp, Diabrotica virgifera
  misc_feature (2)..(58): n is a, c, g, or t
  misc_feature (72)..(107): n is a, c, g, or t
annnnnnnnnnnnnnnnnnnnnnnnnnnnnnnnnnnnnnnnnnnnnnnnnnnnnnnnngggttttttaagcnnnnnnnnnnnnnnnnnnnnnnnnnnnnnnnnnnnngggggg

SEQ ID NO: 17050 - DNA, 133 bp, Diabrotica virgifera
  misc_feature (6)..(102): n is a, c, g, or t
  misc_feature (120)..(132): n is a, c, g, or t
ggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggggaaaaacagggnnnnnnnnnnnnng

SEQ ID NO: 17051 - DNA, 738 bp, Diabrotica virgifera
  misc_feature (227)..(268): n is a, c, g, or t
  misc_feature (280)..(582): n is a, c, g, or t
  misc_feature (586)..(608): n is a, c, g, or t
  misc_feature (618)..(646): n is a, c, g, or t
  misc_feature (648)..(676): n is a, c, g, or t
gggccggattcccgggcccccttcacgcccgttcatgcttattaacagagtatttctgcctagtaaggagggatcatcctatatagagatcgtgagtgacgacggtgaggggaatcttgtctttgtcaaagaatccggtatgtgttgtgccgtgtgcatcggagatgattaatcactagtcatctatccatcattttcggatttacaagagctacaaaattaaaagnnnnnnnnnnnnnnnnnnnnnnnnnnnnnnnnnnnnnnnnnncaatgttattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcnnnnnnnnnnnnnnnnnnnnnnncaggaattcnnnnnnnnnnnnnnnnnnnnnnnnnnnnngnnnnnnnnnnnnnnnnnnnnnnnnnnnnncctcgcctgcccattgattaatttgaacggccgcgccatcctgaccgtgctaagggagcaca

SEQ ID NO: 17052 - DNA, 1149 bp, Diabrotica virgifera
  misc_feature (16)..(38): n is a, c, g, or t
  misc_feature (50)..(67): n is a, c, g, or t
  misc_feature (774)..(774): n is a, c, g, or t
  misc_feature (1097)..(1116): n is a, c, g, or t
gtgatagggttacctnnnnnnnnnnnnnnnnnnnnnnngaattaagtccnnnnnnnnnnnnnnnnnntttcgggcagtaattaccgatggcctagccatgagagatttcatgaatatttctttaagtctatctaaattctccaaagaatgcatcatgaggataacaacaagaaaagtatattatataatatctgaagaggaatcaggacctcgacgtcctttggtgtggtgtgaattacctgtgaatttttatttcaaagagtataatgttgttggtgttaatgatcaatataatgaaatttatttagagttttcaacaggtttgttagctcgttctctttcaattttaaagcaagtagttaaaacactcaaaatcaagctaaccaataaacaatctccttgccttacgttggaaatggatttggttgctgaagaaatttccagccaagttgttcatgacataccagtagaggtaatttcaagaaaacattggagtgattatgaggaacccagatttaatgattttcatgtttccatacaaatgccaaatttaaaagcacttaaaaacatagtagagaggttaagaaacatgagtcacagccttatagttagtgctaacaaaaatggtaggctaacattccaaattaagaccaatgtagttaacgttgcagcccattttacagatttaagtgttcagagctttgcagttggccaaattcctacaaccgatgatgatgatggagaagatctaaatttaatttcttcaaccattgnaaataaaaaagtttttaatgtttctcactggattacaaataagtaattgtagaacactatgtagcatagtccatggaaaaatggtaaagttgtatatggaacagccagaagcggtattcatacaagaatttttgactgatttaacagttaaaaaaaacagttcttaaataaaacaatattgggttcctctatccttcttatcattggaaccaaaaaagttgatttctggatttcccttgggccctaacttctaattctccaaattcaaataattaagaaatgggggggggggggttctaaaattgggttcccctttttttccnnnnnnnnnnnnnnnnnnnngggggggccaaacactttttcaaaattttttgt

SEQ ID NO: 17053 - DNA, 437 bp, Diabrotica virgifera
  misc_feature (184)..(208): n is a, c, g, or t
ctccctttaagcggccgaacatgtaaacacattacatgagttatccttttagtagtaatatgttataatagaaatgtacataattgccgctgagaaagaacttcagaatcacatttattgccccacaatttagttgtaggtggtgactgctagaatcgctcgattcaaatacctacaacattannnnnnnnnnnnnnnnnnnnnnnnnctgatttatatagagcaaaacaaagcctagacattagaagaagttacgcgttgtgtacaggcacatcttgctatctatatcctatatgagagttctgagaatggctccaaacttgctttaatgattatactttgtttttattattgtttctagatgtacgctgaacaggacgttaaaatgaacccctaatttatctattttatataataatcaaacacctggacaaaat

SEQ ID NO: 17054 - DNA, 624 bp, Diabrotica virgifera
  misc_feature (155)..(172): n is a, c, g, or t
  misc_feature (432)..(460): n is a, c, g, or t
  misc_feature (465)..(487): n is a, c, g, or t
  misc_feature (489)..(501): n is a, c, g, or t
  misc_feature (506)..(523): n is a, c, g, or t
  misc_feature (530)..(552): n is a, c, g, or t
aaaaagcccgcgaaagagaaagaacgcgatagagatagggaacgagagcgtgatagagacagagagcgagaaaaggaccgcgatcgagaaagagaccgagacgatcgtagaagtagtagagatatgttgaaagaaaaagaaatggaagaagaggnnnnnnnnnnnnnnnnnnccgaaaggagagcaagagaaaaggaagctgcctatcaagaacggttaagagcttgggaaactagggaacgacgcaaagccaaagattatgagaaagaaagagagaaggaaagaacaaaggaagaggaatgagaacgcgacgctaaaaggttaatagaattcttggtagattatgatgatttttgagactgccttataatattacaagtttattaagatttaatattattatatgctgatctgtggattaaattttttcgnnnnnnnnnnnnnnnnnnnnnnnnnnnnngtatnnnnnnnnnnnnnnnnnnnnnnngnnnnnnnnnnnnnatatnnnnnnnnnnnnnnnnnntttagtnnnnnnnnnnnnnnnnnnnnnnnttaagttgtatattttagttaattatagtaggttatattacagctagttcctgaagatttttttcgccctgt

SEQ ID NO: 17055 - DNA, 201 bp, Diabrotica virgifera
  misc_feature (6)..(99): n is a, c, g, or t
  misc_feature (104)..(176): n is a, c, g, or t
  misc_feature (179)..(179): n is a, c, g, or t
  misc_feature (189)..(189): n is a, c, g, or t
  misc_feature (193)..(194): n is a, c, g, or t
taatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcnnnnnnnnnnnnnnnnnnnnnnnnnnnnnnnnnnnnnnnnnnnnnnnnnnnnnnnnnnnnnnnnnnnnnnnnnttnatttatatantaanntttatta

SEQ ID NO: 17056 - DNA, 307 bp, Diabrotica virgifera
  misc_feature (244)..(244): n is a, c, g, or t
gtaaaaaccgaataaacaagagatttaaatacctgactcaaatgggatatttccttcctgtattgtacttcaaattcagtcagtttaagatttttttcaataatttccagaatgggcgtataatagacccagcagtcgcctatgcttgatatagtttttccattttatctttaagactaagttttcactctaatgggcatataaaacaacataattctacatcccaccagaatgaaaacaatgngaaccttctctggttacacctccgacgcttctacaatttgcaaatcatacggatgctgagact

SEQ ID NO: 17057 - DNA, 587 bp, Diabrotica virgifera
  misc_feature (76)..(93): n is a, c, g, or t
caagctttctctgtttacagttaattttcattttaataattgactccacgtagaaactaaaaaaacaacagggtcnnnnnnnnnnnnnnnnnnttttacattagatactacgtaggccacaaaggtaagttcggccacgaattcctcgagtttgagttccgaccggatggcaaactccggtacgctaacaactccaactacaaaaacgatacaatgatcagaaaagaagtgtacgtacaccaatgtgtaatggaagaactcaaaagaatcataatcgactcggaaataatgcaagaagacgactccctgtggcctcctccggaccgtatcggaagacaagagttggagatcgtcatcaaagatgaacatatctcgttcactacctccaaaactggctctttgatcgacgtgagtcagtccaaagatcctgaagggctgagatgtttctattacttggtgcaagacttgaagtgtttggtgttttcgttgattggtctacattttaaaattaagcctatataaagtgtaaaatgtatttatcttttttaccttattgtaattcaataaaactctcagtttgtaagtat

SEQ ID NO: 17058 - DNA, 139 bp, Diabrotica virgifera
  misc_feature (7)..(30): n is a, c, g, or t
  misc_feature (40)..(40): n is a, c, g, or t
  misc_feature (67)..(67): n is a, c, g, or t
  misc_feature (94)..(94): n is a, c, g, or t
  misc_feature (117)..(117): n is a, c, g, or t
taacagnnnnnnnnnnnnnnnnnnnnnnnntcgataatanagattgcgacctcgatgttggattaanagttataattggtgtagcagctatatnaattaagtctggtcgacttttanattttacatgatctgagttaaa

SEQ ID NO: 17059 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17060 - DNA, 261 bp, Diabrotica virgifera
  misc_feature (5)..(100): n is a, c, g, or t
  misc_feature (175)..(191): n is a, c, g, or t
  misc_feature (193)..(208): n is a, c, g, or t
ccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtagcactgagagagccctattgcctttattataagataaccacgcagtttttagtccctgcgcatcagcnnnnnnnnnnnnnnnnncnnnnnnnnnnnnnnnngtcgaatttagaagagctaaacaattaaaagtttaactgtaaaatacatagtt

SEQ ID NO: 17061 - DNA, 54 bp, Diabrotica virgifera
  misc_feature (2)..(18): n is a, c, g, or t
  misc_feature (23)..(50): n is a, c, g, or t
gnnnnnnnnnnnnnnnnncgagnnnnnnnnnnnnnnnnnnnnnnnnnnnntaag

SEQ ID NO: 17062 - DNA, 230 bp, Diabrotica virgifera
ccccccccaccggccggtctggcggacatcgagaggatatcttactgcttggaatttgtctttgttgatgatagataaggcgtggtcacaataattgttccctagtataagcataaatcccttttgcattcctttcccaaaaacgtactctaattttaattattactctgtagatgcgaataaattaacaggtgtttgtagaaagactgtctctgaatagtgagaagcta

SEQ ID NO: 17063 - DNA, 919 bp, Diabrotica virgifera
  misc_feature (867)..(867): n is a, c, g, or t
gtttttgtagaacaccttgaaaaagtgtttgcaccagtagatttattcgaagatgaagaaataaatagctatttagatgctccctgtcaactatcaccacctgctagatcaattactccatcagaaattatggaagagataaagaaaatcaactcccataaagctccaggttatgatctaatagtgggagaaattctcaaacatttaccaagaagagctatcgtgtttctcactactttatgcaaccgaattcttcatctttcctactatccaacgcaatggaaatttgctgaaattatcatgatcgccaaacctggaaagccaccaacagaagctgcctcttacagacctataagcctgctgcctatactttcaaaaatatttgagcgactactgcaaagtagaataaatagtataacctccataaataatttaataccaaatcatcaatttggctttagggaaaaacacaccacaactcagcaatgccataggatagtaaatttaatcagagacggtttagaaaacaagaacatttgcactgcagcatttctagatattcagcaagcctttgataaggtttggcaccaagggctgttatacaaattaaaaacaaacatgccgagtcagatttacttacttctaaaatcatacctttccgacagacatttcgatgtcaaaatggaaaaagataacagaagataccaactcataagggcaggagtaccccaaggcagtgttttgggaccatttttgtacttattatacaccgctgatataccaactaccaacgaaacaactatcgccacgtttgccgatgatacagcaataattgcgcttgaccatgatccagtagtggcctctaancagctacaaacacatttagatcgattacaaaactggctccaaaatggaaaat

SEQ ID NO: 17064 - DNA, 765 bp, Diabrotica virgifera
  misc_feature (2)..(619): n is a, c, g, or t
  misc_feature (621)..(677): n is a, c, g, or t
  misc_feature (681)..(699): n is a, c, g, or t
  misc_feature (707)..(737): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnntatnnnnnnnnnnnnnnnnnnnctgtctgnnnnnnnnnnnnnnnnnnnnnnnnnnnnnnnctaagaagcttatattattttaaagacg

SEQ ID NO: 17065 - DNA, 244 bp, Diabrotica virgifera
  misc_feature (9)..(9): n is a, c, g, or t
  misc_feature (50)..(50): n is a, c, g, or t
  misc_feature (87)..(87): n is a, c, g, or t
  misc_feature (109)..(126): n is a, c, g, or t
  misc_feature (197)..(235): n is a, c, g, or t
ttgatatangaaataattacctttaggataacagcgtaatttttattggnagagtcaaatcgataataaagattgcgacctcgatgntggattaaagtttattattgtnnnnnnnnnnnnnnnnnntaagtcctgttcgacttttaaaaattttaattgatcttgagtttaaacccggggggaagcccaggttgggnnnnnnnnnnnnnnnnnnnnnnnnnnnnnnnnnnnnnnnaaggggccc

SEQ ID NO: 17066 - DNA, 943 bp, Diabrotica virgifera
  misc_feature (693)..(693): n is a, c, g, or t
  misc_feature (843)..(843): n is a, c, g, or t
  misc_feature (904)..(905): n is a, c, g, or t
ggaaggacgacttatcttcgataaccttaaaaaatccatcgcttacactttgacatcgaacattcccgagatttcgcctttcctcgcatttatcctctgtgacgttcctttacctctgggcaccgttaccattctctgcatcgatcttggaactgacatggtacctgccatttccctggcatacgaggaggcagaatcagatataatgaagcgaagacctagaaaccctttcagtgataagctcgtcaacgaaaggttgatatccatggcgtacggtcagattggtatgattcaagcggctgctgggttctttgtgtacttcgtcatcatggctgagaacggtttcttacctatgaaattattcggaattaggaaacaatgggattccaaagcagtcaacgatcttactgattcttatggacaagaatggaccttcagagacagaaagaccttggagtacacttgccacaccgctttcttcgtctcgatcgtcgttgtacaatgggccgatttgatcatttgcaagaccagaagaaactcaatcgttcaccaaggaatgaggaattgggctctcaactttgggctcgtcttcgaaaccgcactggctgccttcctgtcttacacgcctggtatggataaaggattaagaatgttccctcttaagttcggtctggtggttgccagccatccccnttcatgttgtccatcttcatatacgacgaggtacgacgatttattctaacgacgttgtccaggcggctggttagaacaagaaacctattattaagtattaatatcagagtactgccactcagtgggattgctgtgacagcacagcctcgnataggggaagacttcgctgaaacacaatagcaagccagccaggtatcagcggtggagaggnnaaaacgaagtctttacctatcgatacttgtacaaaact

SEQ ID NO: 17067 - DNA, 286 bp, Diabrotica virgifera
  misc_feature (18)..(48): n is a, c, g, or t
caaaagttgaacatttannnnnnnnnnnnnnnnnnnnnnnnnnnnnnngtgtagtaaatttatcaagtgccatttatgaagatcaagtaggaaaattcgattggaaacgatcgttcataggaaaaagcaaatttgcagaaattgattccaagagaatcatcatcgccactgaacagaatgttttagctagtttaaacctcaaaaatggtcagattttgtggagacatgtactagaagaccccaaagagtatgaaattaaattattatacatagacagagacatata

SEQ ID NO: 17068 - DNA, 582 bp, Diabrotica virgifera
  misc_feature (3)..(25): n is a, c, g, or t
  misc_feature (62)..(83): n is a, c, g, or t
  misc_feature (102)..(152): n is a, c, g, or t
  misc_feature (169)..(192): n is a, c, g, or t
  misc_feature (230)..(259): n is a, c, g, or t
  misc_feature (287)..(318): n is a, c, g, or t
tgnnnnnnnnnnnnnnnnnnnnnnnggggaagaacacaacgccccctttccctcaaaaaggnnnnnnnnnnnnnnnnnnnnnntaggtttacttcataaaannnnnnnnnnnnnnnnnnnnnnnnnnnnnnnnnnnnnnnnnnnnnnnnnnnactcaaaactcaggggnnnnnnnnnnnnnnnnnnnnnnnntggaaaaccatcatttggttttaaattttccaaacggnnnnnnnnnnnnnnnnnnnnnnnnnnnnnngaggggaaaggggatttttaggggggannnnnnnnnnnnnnnnnnnnnnnnnnnnnnnnaattttttccaggggccgggaggaaggggaagggtgggaaaattcgggggggggggggaggatttattagggaaagggttggaatcaggaattattcttttaggatattaaccagcctcctttcggatggggggggaactttggggggggtggaccagctcctttttgttgggggcccccgccagacccaccagatgggaatccgccggctccacggtagtacccgccgccatggttggagaaataataccccccatacccccc

SEQ ID NO: 17069 - DNA, 191 bp, Diabrotica virgifera
  misc_feature (147)..(171): n is a, c, g, or t
gatattaggtagtccctctaataaattttagaaagtgataaagaggggttgtgaagaagtggagtggaggttatttttggttattttttcccctctaaaagaagagtgaaacaggagaagtggttggggagagtagtagggatgagnnnnnnnnnnnnnnnnnnnnnnnnnagttataagaggagtgagaa

SEQ ID NO: 17070 - DNA, 890 bp, Diabrotica virgifera
  misc_feature (34)..(52): n is a, c, g, or t
  misc_feature (148)..(173): n is a, c, g, or t
  misc_feature (216)..(236): n is a, c, g, or t
  misc_feature (397)..(417): n is a, c, g, or t
  misc_feature (826)..(826): n is a, c, g, or t
  misc_feature (850)..(850): n is a, c, g, or t
gagattatccgtcgattaacgggctgttaagagnnnnnnnnnnnnnnnnnnnactgtaattaccaaataccgggaaaaaattgtcaaataacacatatataaatgagataaatcatattattcaataaacataagtttttttatggannnnnnnnnnnnnnnnnnnnnnnnnncttgcagaacatggatatctcggacatttttgtatatttgatnnnnnnnnnnnnnnnnnnnnngtttaaaaatgtaagataacaatgatgctagactcatagagctattttttgagaggccagagctctaaaaagcagaacataatgataatagcgatgtaaataagagggaaaacgtgtgtgaaattatagcagctaactttgaagacaataaaacagccggnnnnnnnnnnnnnnnnnnnnncaaaaagtaattatatagaccaaaaataaaaatatgagtataaaatatagatcataaataaactgttttatatctccaaatctcatcacataaatttaatgcgttttattctttttgaaattatctagcctcatttttaaaatgctatcattcaattcttgctccaaaccaaagtgacagtacgtaagagagaatgcacctttagagatacaacgatacaagtttggatttagaggttaatataattgaaattttgaaggataacagtcaattgtgacagtatcgataacaaattgtatgtcagatcatcgattacatgatctatgatcgtgtaattttacaaataattggcgtttgagaaacccatcactgggttaacagttgatccaatctgacagccgattagatngatcggagatttgaataacgtttncgaaaccggctgttagtctaccttgcaaacacatagatag

SEQ ID NO: 17071 - DNA, 200 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (168)..(193): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccaggttgttttctatcnnnnnnnnnnnnnnnnnnnnnnnnnngaaagga

SEQ ID NO: 17072 - DNA, 799 bp, Diabrotica virgifera
ctaaacttctgtgacaattttgtgctactcttaaatgggggcctaaacaataccgtgtcgttgttaacctttgataatccaccaaagttttcgtcaagtgataactactgggaccatttttgtgataacaagcggtaagttgaaagtgcagtgcagtgcaacatatcctggagttaaaaaataaagtgacaactgggcagaatggaggatggtcacgcaaaaacagtggacgaagtacttaggtacttcgacgctgatcaagaacgaggtctttcacttgatcaagtcaaaaagaatcaagctaaatatggacccaatgaacttcctgcggaagaaggaaaatccatatggcaattagttttagaacagtttgatgatcttctagtcaagattttattattagccgctataatttcctttgtattagctttatttgaagaacacgatggcgcattcaccgcgttcgtagaaccttttgtaattcttttaattcttattgcaaacgcagtagtaggtgtatggcaggaaagaaatgctgaatccgccattgaagctcttaaagaatatgaaccagaaatgggcaaagttgtccgacaagacaaatccggtattcagaaaatccgggcgaaagaaatcgtacccggagatatagtagaagtgtcagtgggtgacaaaattcccgctgatattcgtttagttaaaattttctcaacaacactccgtatcgatcagtctatcctgactggtgaatccgtttctgtgatcaaacacacccgatgccatttccgacccaagagct

SEQ ID NO: 17073 - DNA, 920 bp, Diabrotica virgifera
  misc_feature (66)..(890): n is a, c, g, or t
  misc_feature (901)..(902): n is a, c, g, or t
aaaaggtgacgataacatcgtcgtcatacactacacctaaccttcaaaatatcagattgggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaactatgnnagtcccagtactctaatc

SEQ ID NO: 17074 - DNA, 893 bp, Diabrotica virgifera
  misc_feature (258)..(279): n is a, c, g, or t
  misc_feature (564)..(588): n is a, c, g, or t
  misc_feature (717)..(717): n is a, c, g, or t
  misc_feature (725)..(725): n is a, c, g, or t
  misc_feature (796)..(797): n is a, c, g, or t
  misc_feature (808)..(826): n is a, c, g, or t
aaaattcacagggtttcaaatccggtgaatatggtggcttattcatgtgacgtcattaaaaaattcctcagtgacggagtggacatgtcactatgtatgcgttcgttttcagaatcacaaaaggatcgattgtttataaaccactttaatttatggctaagacagaacacgaaaaaataaactgactattttttcttacatgcccatgtagattaggcatactacttgtttttaagtgtaaacactccttaatgtacnnnnnnnnnnnnnnnnnnnnnngcgtaatacagtcaagtcactgaaagtgattgctatgaatgtaaataaaatagtttatattgagatttgtttactgacaaaaacgttacaaggcagtagaaaatattgttcgatatgtggaatatttccaaaatgtctgttaagatgcacgaaatttagtgtgatattagtctgatgattagggaagttttctatttgctatttctatcaacgtttttattactataaatatattacaaacgtttctgttgagcacagaaagtgttttgccacgtgcaaggctgnnnnnnnnnnnnnnnnnnnnnnnnncaaaaactgtgggaagcaatgaaaagaatgtacgttagaaagaaatgggtgaatataaccaaagacaatattaggcaatggcaagctaggcaatgaaataacaatccgcgcaagaaaaggccttaaaanatgatttnggtctatccactacactttttaacattggctttggccagatggtatagaaaatgtggtgcaattggtgtannagcacaagagnnnnnnnnnnnnnnnnnnnccaactcatttttggaaaagactggaaggttaaagaatatataaggaattaaagcaagaatatgagc

SEQ ID NO: 17075 - DNA, 686 bp, Diabrotica virgifera
tgagctatttgacataattaatctcgagtcaccatctgaatgaaaaaatagctttaacgaaagtgcaggatctgattttaaaatatggaatcccgagaagaaaaggacagagtacgaggaaggtgtcgtgccgctccacagttaggagcaccaccatgaggagctcctcgatctgcacctcctgatgatcgagtgactgatgcccacaaaactccgccacaaaaccgcccacctggcgtacaccactgcagtagagcgtaagttcctcctccacaacaaagacctcctggcgcccagatggaaccgagaaaaacaccacagaagcctactccggaagccccagaaggaaaaactgacagcaatactggctataccagaaaggaaacaattattaacagcttccctaaacattatgttatggcagctagaagtaaaagaagtacttaggacatttactgctcataaatccgaagtgatgtttctctattacgagaatccttattcaagacacggcccatattttatgtcgctatctaaggtacacagaacccttatatgatgtagattgaacaccattgcctcatataaaaatgcagatgatacttgccttatggagaatattgttcttaatgtttctataaatgttgcactatgatgtcactacacaaatggctgctactgctaga

SEQ ID NO: 17076 - DNA, 887 bp, Diabrotica virgifera
  misc_feature (701)..(718): n is a, c, g, or t
tcaaaagttgatagttttgaagttgtaagcgatttaaaatccgaaaaatgacaaaaatacacattttcgcattttaaatcgcttataactttgggactcgtaacttttgaggaagatgtcaggaaacttgttttatttagaatgtcccaaacaatctaggaaaagatgtttttcggaggaaaatgggagatttttgaaagcggtgcgcgccgcaccggcagggaaccggatggacgggcataattaacagttagaaaactgcggtctgggttgaggttggacccgatcactcttcggaatcttgagggggagtgtttaaactttagtccaagttattggcacccttaaaagtactaatttgaatgtgagtttttgggcctcgaaaatgcgtatgttctcatttttagattttaaatcgcctatagctcgaggattgtcaatttttgagagaacaagatgcctttcttgtttggaatgacccaagaaccctaaaagtgtattttttggagcaatgaaaggtgatcttgtgtatttgtttgaaaaagttgtttgaacgatttctgcccaaaaattccgtccggcaccctccagatttgtttaaaggggacatttttgagaaaccgaattggagatgtttttcagacgggagcggtctcaccacatgagcttgaatcatggatttgaatcaaaacgataccgtnnnnnnnnnnnnnnnnnntgttctacaatatcgtattagtttctgaaaaagaataacctcatttaaatttgtaatgttcaaaaaggctcccaaattttactaaaacgcccatttcagtgcgctcatttctttatttctattacagccaagctcgatggcgtcaacaacccctccgtaaatcgcgaac

SEQ ID NO: 17077 - DNA, 880 bp, Diabrotica virgifera
ggaatttactcccgactttcatttgacttcaccatgtacatgtttacatttcattcaaaacgattctgtaaaatacaagggtggttcgccaaaaaagaaaaaacgaagagattccgagtcagttgttagtccaaaaatagtcttaggaacaacttctggtgttttgctgttatattcaatcacaaatgctggcttagaaaattcattcaatagtgacacaaatcaagcaattaactgcttatccaccgttgaccataacatcatatattcaggtttagaacagaatgttgttatttggaatttagaaaaacaaaaagttatcaacaaatggaaggttggaaatgaaaaagtaacagcaatattggcaataccagaaagcagtcaattattaacagcttcaagaaacattaaattatgggacctagaagtaaaagaagtacttaggacatttactggtcataagtccgaagtgatgtttctctattacgtgaatccttattcaagagacgggtcatattttatgtcgggctctaagggagacagaacccttagttgttggagtttgaacaccaatgtctcagagaaaaatgcagttgctaatttccttatggaggatattgttcttaatgtttctataaatgttgaggatgatggaactacacaaatggctgctactgttagaagtggagtggtgcacttttataggcatacattaaatggcaaatctggtaagccaataaagcccaaaacaacaattcaagtagtttcagatactgggtcaatctgaagaagaagtagttaatcctattagaatttttggtgcctttcatagagatagtgaaacattatgtataggacatggtacagatgtgctacttac

SEQ ID NO: 17078 - DNA, 926 bp, Diabrotica virgifera
  misc_feature (318)..(339): n is a, c, g, or t
  misc_feature (520)..(533): n is a, c, g, or t
  misc_feature (535)..(568): n is a, c, g, or t
  misc_feature (786)..(813): n is a, c, g, or t
caattatgtaagaaaataataaaaatgtactaaatggtttcttaaaatataaaatgttaatgttgttatgaagctatttccttgtggcatttttctaatcaactattttaaatgggaagttttgctaaaaaaatggttttattaacgtttgttggattcgatcatgattgatccttaacaaaaactaaaacttgtttgagataattataaccagaaatataaatataaatgcaatagaaaacagtttgtttgacgttttgagttatgtacagttcgaaaattgttacatatccgaatagataacatattcccagtgcnnnnnnnnnnnnnnnnnnnnnngcgatatatttttaaaataaccttttttctggaaaatcattccagccgatgaaacacatgtttttgaaagggaaataaagtacatattatatggaaaaagaaaaaaaggacttatctaaagtcatgctataaccaataattatattctttgttatttcgattgacaacactgtctcttacnnnnnnnnnnnnnngnnnnnnnnnnnnnnnnnnnnnnnnnnnnnnnnnnctgttagctattctacactaaatctattttattctattataacttaggtaaacattagcattgtgtttatatgggattaaaccacagattaaatttccacttcagaaatttcctattttttgaaaacgatttccgtaggggaaatcgaaatgtgaaaaacaaacgcaaaatgtaattttttagtacatcatctttcagctgtgataaaatccccacannnnnnnnnnnnnnnnnnnnnnnnnnnncatgataaactttgacagcatagaaaggttttgtaatttatgaaattgaccgatggtttgtaaatttaacctgaaaaaaagaaattatttaacggcccattaaataccttttt

SEQ ID NO: 17079 - DNA, 934 bp, Diabrotica virgifera
  misc_feature (104)..(131): n is a, c, g, or t
  misc_feature (142)..(163): n is a, c, g, or t
  misc_feature (250)..(267): n is a, c, g, or t
  misc_feature (845)..(845): n is a, c, g, or t
  misc_feature (848)..(848): n is a, c, g, or t
  misc_feature (854)..(854): n is a, c, g, or t
acttactacagttttatgctgtcacactttcatttaattttgtttttagtcttttactgttttactggactttactaatactacttttacttctacttattgtnnnnnnnnnnnnnnnnnnnnnnnnnnnngggaaacccgnnnnnnnnnnnnnnnnnnnnnnttcatcaatagaacgtcaaaatgattggcaaaatctttaaaaaaccgattactttaattactcttttgcgttgtaaatattacgcgnnnnnnnnnnnnnnnnnnctttaaaaatttccggcgaaagttgcattagtaatccgctagttagtgataccagcgaaactcagagcatataacgtcgcgttataaaatgacagttgatacatctgacaactcaagaagtaacgcaagtagttaagttgaatatgatacatcacaccaattcgacgattataacttaactacaggataactttacgttatatttaacttgagtgatacatcacagggttgattttctataaaggctattggtaaaatctgcactcggctggattcttatttgggatatggaccttgaaaagtaaatttaaaaccacctttagccaaatttttagtttcattgttggccccagaagtgttctatcgcaggaaatgtgttttttcgaaaaaaatttccctgagcgatactttgctcaagcaacaacaacaaacttttgtttgatttttttcagatgttttaatcaaaattaagctcaggaaaatatttgaaattttcaaaaaatgtttaggttatgtaggtaatttttgatagtttctaactagttattttttgtgtattttccgttcttttgaatggncgnggttgnatttgtcattttctcccatggttttggcacataaattcaactgcatgtcaatgaataactattttttaatcatttttttt

SEQ ID NO: 17080 - DNA, 895 bp, Diabrotica virgifera
  misc_feature (219)..(249): n is a, c, g, or t
  misc_feature (263)..(281): n is a, c, g, or t
  misc_feature (368)..(390): n is a, c, g, or t
  misc_feature (792)..(793): n is a, c, g, or t
  misc_feature (824)..(824): n is a, c, g, or t
gaatttgtcttagatgcgcaccaatagccgactctcccatactattaacataatcacattactcatatttataataatgttatgttaataaaagataagctatagaagactattcataagcctaaacccatatccaaaagtgtgtaaacagaagaagaagagctgtatttgtgaaacaactgattatcattttaaccaacactaactacctctttaggnnnnnnnnnnnnnnnnnnnnnnnnnnnnnnncgaaaaattgtgcnnnnnnnnnnnnnnnnnnngataagactagaaattgtaaccaaattagaaaaaaaattaatgtagatacattgggtctattcagaaataacatataaagatgcacnnnnnnnnnnnnnnnnnnnnnnngttatatatagtggatgggtatgaagatacgacactaaaaaattcacaaaatgtattaacgaacttattgtttggatataaacagtggcatctctagactttgctgtcggagacttccaatgaaaccccaaccaaaagacataaaaaagatcaagccagactgcataaaaaacataattaataacttatattcatttagttctcttacttttcctaactggtagttttattgggttaaatttggctgtctgtgatttaagtttcatgttagctaatatgttttatgttttagttatttttttctttaattttggatcgtgttttagaggaaattttcccattttcgcctcccgtatattcgccactagtatcaagtaatttaataaatcgacgtcagcagannagtatcagtcgtaagtttggtaatacatggntgaaaaagtaacaattaggtaaaatacaatgaataatattgtaatcaaatatgttctaacactatgtactg

SEQ ID NO: 17081 - DNA, 93 bp, Diabrotica virgifera
gaactctttacacttatcccgaaaatttccgggccgcaaaactctgattgcccgcacatatgccaaggcaaacgtcaaagtagcacccaattt

SEQ ID NO: 17082 - DNA, 887 bp, Diabrotica virgifera
  misc_feature (714)..(752): n is a, c, g, or t
  misc_feature (810)..(810): n is a, c, g, or t
  misc_feature (843)..(858): n is a, c, g, or t
  misc_feature (860)..(883): n is a, c, g, or t
aattaacttgaaaaataaacacaatattagtagttataaattccaattaacataaacaaaatgagctaatgtcactgtcactaaaataaatgataaacgtcaaaatttttagtaaacaagatataaacgtaaaaaatatactgacattgttacagttaaaattcctttaaacatttttcaacgttaattattgatataaattacaataattattgtattaaataaacaactttatttatttgcagtttatatacgattaatattaaaagtggcatgcgtcacttgaatctaacttcagcccgtgagtaatgaattattactcacgggtacagcaatgggtgctattatctatgaaaaaatagcgaataatgagcatgttattaaacggtcgtagaaaaaaatataaaatcagtaattatttaaatctattaatattatgcttatttcgatgcgtccccttacttcgactgcctttaaaatgaccaccagatccaggcattttttcctcttttcaaaacaataattttcaataataacgttttcgctttataagttttagaacccatctgtcgagttgcagctacacaggtcaggcatcgcgagcgttgttgtatacaaattagttttagctcaggtaggtaccataataaatatagctataacttcgtttttatttcgaacttcttaataaaatttgttttcttaataaaatgnnnnnnnnnnnnnnnnnnnnnnnnnnnnnnnnnnnnnnngaacgtaaaagtccccttaaaacagaaaattaaatatgtcgtactttttatttaatgngcaaccatttttatttatcataagataacttcnnnnnnnnnnnnnnnngnnnnnnnnnnnnnnnnnnnnnnnnccgc

SEQ ID NO: 17083 - DNA, 738 bp, Diabrotica virgifera
  misc_feature (4)..(41): n is a, c, g, or t
  misc_feature (52)..(74): n is a, c, g, or t
  misc_feature (265)..(338): n is a, c, g, or t
  misc_feature (343)..(377): n is a, c, g, or t
  misc_feature (379)..(706): n is a, c, g, or t
ttgnnnnnnnnnnnnnnnnnnnnnnnnnnnnnnnnnnnnnnacctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagcattaaagttatatataaaataaaatt

SEQ ID NO: 17084 - DNA, 923 bp, Diabrotica virgifera
  misc_feature (193)..(212): n is a, c, g, or t
  misc_feature (249)..(266): n is a, c, g, or t
  misc_feature (792)..(792): n is a, c, g, or t
  misc_feature (830)..(830): n is a, c, g, or t
ccgttgtgtcatcaccatcacttaaaagtgttgaaacaattttactttaatgatattatctttatttcattattttcgttatagtgtcttaatgtgataccacgtaaaatggtgaatcaatatgcttcccttattccaaatagtagcttgttctagaggtcaaaggaatatgtcagaaggacccccaaaaccnnnnnnnnnnnnnnnnnnnnttccagtccacagagctattgaggaaacaaataatgnnnnnnnnnnnnnnnnnnctttctctggtaattttcattccagtaaatattgcaaaaaccaaaattacttcaaaagcaattattaaagatgaagatccaatccataccgaaattatacttgaaacggtagaaccaaacactggttcaaaattatctagaagacacttagttaaagaaaattatcgtttactggaagaaaatagagaactgagctccaggtttattgaactagaaggtctctcagtcaacaaaataacaaaacttagagaaaaagtaaacttacttcaattggccaattcacactttaaaaaagatatcgaagagttagaagaaaattatgagcaggtattgtacgaaaacaacgcgttgaaaatcgagttagagaagttaaaaatatgtaaaaaatgtgaagaatataggaatgaaatagccaaatgtaattcagataatgaaaaagttatgaatgaaaacgaaatattaaaagcaaagaggaaagaacttactgaagatttggctatgctgaaaacagtagtttatagattanatctgcaaattggagaggtaccaagaacttctacgaancaataacattccccaaacagtcgtagaaccataccataaacgagaggtcttagaatcttcccagtagtaagaaattctgtcagaagtacatcg

SEQ ID NO: 17085 - DNA, 475 bp, Diabrotica virgifera
  misc_feature (400)..(400): n is a, c, g, or t
  misc_feature (426)..(426): n is a, c, g, or t
  misc_feature (436)..(436): n is a, c, g, or t
  misc_feature (448)..(449): n is a, c, g, or t
tggttgtaaactaatggagttataaaaaatacttttcttacattttttaaacgaatattagttttgttttaagtatggctgctgccacagtagttattgaagaaaaaagtgacgctgtcgatagacagaaagtttgtccttttttactaagagttttcgttacctcgaatggttcccaccataaaccatctgattatattaaaggaaacactcctcaaaacgaactacaaatttacacttggaaagatgctactctacatgagctgactcaattagtcaaagaagttaatccagaggctagacgaaagggaacaaaattcagttttgcttttgtgtacccagatatgagacagtctgtgtacagaataagagaaatcggaaatacagtaactggtgttanaggaccagacgatttgaagacattgngtctcttaangcttaatattgnncgatatctcgatattgctatcactgc

SEQ ID NO: 17086 - DNA, 217 bp, Diabrotica virgifera
  misc_feature (3)..(59): n is a, c, g, or t
  misc_feature (64)..(64): n is a, c, g, or t
  misc_feature (84)..(84): n is a, c, g, or t
  misc_feature (91)..(91): n is a, c, g, or t
  misc_feature (97)..(120): n is a, c, g, or t
  misc_feature (160)..(215): n is a, c, g, or t
atnnnnnnnnnnnnnnnnnnnnnnnnnnnnnnnnnnnnnnnnnnnnnnnnnnnnnnnnnatatnaagtctcgcctggccactgnataattngatggnnnnnnnnnnnnnnnnnnnnnnnntagcatatcattagttttttattgaagctgaatgaagggnnnnnnnnnnnnnnnnnnnnnnnnnnnnnnnnnnnnnnnnnnnnnnnnnnnnnnnngc

SEQ ID NO: 17087 - DNA, 645 bp, Diabrotica virgifera
  misc_feature (2)..(412): n is a, c, g, or t
  misc_feature (541)..(560): n is a, c, g, or t
  misc_feature (570)..(590): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagaaaaaaattacctttaaggataacaaggggaatttttattgggagagttcaaaatgcataaaaaaaaatttggcacccccggaggggtgggatttaagggttttaaaattgggggggaagacggnnnnnnnnnnnnnnnnnnnnggggtcgaannnnnnnnnnnnnnnnnnnnnctggggatttggggggtttaaaacccggggggggggggcgccgcggggtgggggg

SEQ ID NO: 17088 - DNA, 865 bp, Diabrotica virgifera
  misc_feature (288)..(337): n is a, c, g, or t
  misc_feature (607)..(607): n is a, c, g, or t
  misc_feature (766)..(766): n is a, c, g, or t
  misc_feature (791)..(791): n is a, c, g, or t
  misc_feature (805)..(806): n is a, c, g, or t
ctaaatacgtcgctaaaaagttctaaaaacaactgttttttatataaaagcagacaaagaatctaaaaattacataaaaatttcataacactggagtaaacttgtctgcggttggatcaattacaaacaagcattacctcgcggtgaatttgaattactccttctggtttaaagacagagcatagctagagccaattcaggcgcttatgcactgggttgcatgagcccaaaattcagaagatattatgaaataatcagataccgtatgcgagaataatttacgccatnnnnnnnnnnnnnnnnnnnnnnnnnnnnnnnnnnnnnnnnnnnnnnnnnntgtacttacgacttacggtttcaaaattccccaaaccaattatatgtatattcccttatttatgacctgctatttacggccacctttataatacggaagtggccaaataatcacatatttttaaagcccattttatagaaattgaatgtgaatgtcggccgaaataattttgttaaaatcattttgtctatttgttgatcgaaattcccagtactatttattaggacctattgtatctacctaaacaggagattaaatgacctgtatcgnggtcggtggtcacaaggttcttaaaatcctataataaaatgtaaaagcgttgtaaaagagaaacgtttgtcactatttataagtatgatttaaattcacaaaagttggccgaaaaatatggtgtaaaaactcaaattatcaaaggatataaaaaataanaagggaattggaaaaattctttaanaaagcttaacatcnnaatctgtttttttccgtagtatacagtatatacttaccttaagatttgttttatattat

SEQ ID NO: 17089 - DNA, 322 bp, Diabrotica virgifera
  misc_feature (2)..(150): n is a, c, g, or t
  misc_feature (170)..(192): n is a, c, g, or t
  misc_feature (202)..(236): n is a, c, g, or t
  misc_feature (243)..(292): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggagaaacaccctatagnnnnnnnnnnnnnnnnnnnnnnnggttttttannnnnnnnnnnnnnnnnnnnnnnnnnnnnnnnnnntgggggnnnnnnnnnnnnnnnnnnnnnnnnnnnnnnnnnnnnnnnnnnnnnnnnnncacttttttggtccccttttttgtggacta

SEQ ID NO: 17090 - DNA, 808 bp, Diabrotica virgifera
  misc_feature (191)..(280): n is a, c, g, or t
gggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtgcatggaataatggaataggacctcggttctattttgttggttttcggaaccccgaggtaatgattaataggaacggatgggggcattcgtattgcgacgttagaggtgaaattcttggatcgtcgcaagacggacagaagcgaaagcatttgccaaaaacgctttcattgatcaagaacgaaagttagaggttcgaaggcgatcagataccgccctagttctaaccataaacgatgccagctagcgattcgccgacgttcctccgatgactcggcgagcagctttccgggaaaccaaagctttttgggttccgggggaagtatggttgc

SEQ ID NO: 17091 - DNA, 464 bp, Diabrotica virgifera
atttattttatatatatcgcctattttttaaaatattgagagattttgttgtttaatgctttatactaagaattgggagagaaaatatcatttttatgaaagaaaatttatttcttgtaccttgggtctcaggaattattaattagtaatgatatatatattattttccgattctagagaagataggagaatatcactattattgaaccgtgaatattttagataacgttctcgatctgcaatagatattcgacattcttctgtcttaccatataacaaataccatctctatattgattagcgacacctccataattagatatctttatatctactacaatcaaatatatgtaggcatgagctcagataccagactatattaatgctgatactccacatacagatgaacatgaagaattatcatacattacaagatgtgataatcgactgtaagatattattat

SEQ ID NO: 17092 - DNA, 116 bp, Diabrotica virgifera
  misc_feature (6)..(94): n is a, c, g, or t
  misc_feature (96)..(112): n is a, c, g, or t
taatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnntttt

SEQ ID NO: 17093 - DNA, 577 bp, Diabrotica virgifera
  misc_feature (13)..(50): n is a, c, g, or t
  misc_feature (57)..(120): n is a, c, g, or t
  misc_feature (488)..(524): n is a, c, g, or t
tttaatcaccccnnnnnnnnnnnnnnnnnnnnnnnnnnnnnnnnnnnnnncaccccnnnnnnnnnnnnnnnnnnnnnnnnnnnnnnnnnnnnnnnnnnnnnnnnnnnnnnnnnnnnnnnngatgaattgattaaccatagtgaaaacgagatgcactctaaataacttttattaacttgttattctcgttttgaaacttacgagccgtctgatacctgtattagataatcattcctagagcaaacggactacacccagttgctcattgaccaccaaagacactgcatataatctcgttattctccatgtcgatgtagtcattatgctgtagacaatatttagatttgctccaatgctctgattgtccgaccaagtcgtgaattgtatcataacatgcagaatgaaattaatgccctaacagacttcctatcatgaaagtgtactgcatgttattgaaattactgatcagatattatgaaatgagaacnnnnnnnnnnnnnnnnnnnnnnnnnnnnnnnnnnnnnctctcaacaggcaacgttatgataaaaataacatacctcgcagtaatctcata

SEQ ID NO: 17094 - DNA, 581 bp, Diabrotica virgifera
ttataagccgagatgaaacatatttagtgagaggttaccttataaagatgaatacacaattatatattgaatagaataccacaacaattgtcttccagctgtaaactttttataaataaccagtataaaattatgccaataatttgagtttcgatttagagtaatttatgaatcatcaattcctactccatcaccacatttttacttattgttctgtgaaaatctttatatctgaaatacgtttcaaaactacatttctttgtcattattccacacgaaattcagaagctgaatttttttttttcagtaaacgccacgagatcgattcgtagtatcatatagtgaaatttttattaatacaatgactataaattcttattgagacatattctttgtcggttactcgccaagacatctagtttgtcgcttactatgcggatgtcagtcaaaccagcctccaaatttttgttctacctcgatgtaatgtattagttctgcctgtccatgtgactgccactaatgtacccataatactcatttccgaactatgctgcactatgagctatcacagacatgactat

SEQ ID NO: 17095 - DNA, 639 bp, Diabrotica virgifera
tgatagtgagtttatttccttcttgcgacccaacatctaaatggagtttagcaagacacggactaagaacgggagtaggacaattgactgtgccatctagaatttgattacccccctgccgctataggtagttaggacgaaagagtagtatgaacgcgacagtaagagaaggtagggagtgaagaggaagacgtgaatccctggaagagaagctcacgtcgtatcgagactgcttagaatacctctattgaatatttgccgtgggaagtgccgtatacaagtactcgaacaagacttttaacccgtaacgttaaggtgagctcttacaagacggacagtgatgtatgagaccgagagagatccgacaatactactcatattgaattctttaagctgctagagccaccaggccgaatataacaccagtaaatagctggtgtggaaaggagaacagtatggaatgtcgacctggaaagcttcgtaggccacgtgatatcgtgactactaatcagtgagtaggcagactgaatctcagagacgtctgttaagtgtagctagctggatgagagaaaaatcgaccctaaaaaaattcaccgtccttagaatttacccgttcctatctttttacaacgaaaataa

SEQ ID NO: 17096 - DNA, 799 bp, Diabrotica virgifera
  misc_feature (141)..(165): n is a, c, g, or t
tttctgtgtgtggttggtaacggtggtgattttgaatcgatacatccagttcttaaatggaataaagaaaattcccattttttgtattaaaaataccccagctagcagtagcgtttttcttttggtgtgtgttctagtgcnnnnnnnnnnnnnnnnnnnnnnnnngtgtatagtttttttgctgatcagaggattataactttgttttagagctacaaaagataaaacatgaagcaaatccaatggactctgattctggcgcagttctggttcgttttcgtgaacgcagaaccgtctgtgcacattctagctgaaaatctagaacaagtcatcacgtccacgacgttagaatggattcctttcaacggtgacgataaaggttttctcaagaacgccgttgtagcagcttaccagactatagaagagccaaaaagcaacgaggccgaagtgtctgagaatgaaactggtggaaacggcttagtccaaaagtcagtgtatgtctgccgagccaagattaacagcgtgtggatctccgggcagctcagaccaaacagaaacgtttgtgtcgtttccctttacaagaaagtctctgattataaagagttcgatgtcctcgtcagcatagagggaagcgcaaggttgagttggatccacaagaacaaatacactttgatatcgcaaggagctgttactagcggagaaaacgccttgaagagttttgtagcaaggagagaggcgaatagccataacaaagaaagttccctctcttactatgtcggcaaatatagtccaaacagaa

SEQ ID NO: 17097 - DNA, 545 bp, Diabrotica virgifera
  misc_feature (412)..(429): n is a, c, g, or t
atcaaacaaaaatgtctctgacaatgattggtggtgtgaaaatccccatagtggggctaggaacatggcaggctaccaatgaagaagaattggaagctgccgttgaggcagctctggaaactggataccgccacatcgatactgcatctgcataccaaaacgagcatgtcatcggcaaagttctcaacaaatggttgacgtctggcaaacttaagagagaagatattttcattactaccaagcttccaatgacacacatccatcccgatctcgtcgaaacagctcttaaagaatccttacagaagcttcagctggactatgttgatttgtacttggtgcattctcccatatacatgaaatttgttgaagctggaaagccaatggaacctctacctactgaccatctggctgnnnnnnnnnnnnnnnnnnagcaagtagatgcgaaaagaaccagaaccatcggtatctccaacttcaacgtaaaccagatcgacagaattcaaccagccaacactcaagtggaactgcacgtttactaccagcag

SEQ ID NO: 17098 - DNA, 389 bp, Diabrotica virgifera
aagttaacaacttctctgcaactaatttttataaaaatgtttcataattacttccgtttatttgttacgttttctttaactgttattttaggtgttacaacttaggagatgaacttgcacaaagtgtttgtatatggaactttaaaaagaaatgaacccaatcattcttggtttgccaaaaatgctgagggatattacaaatacattgatgatgctaatgacagttgaaaaattgccgctaattatagcttcgatatataacgcgccatttattttataaaacccccgatatgtaattaactaatataatagagatataggtactttatgtcttcttccatattcatgatatatcatcaaaccagttagccaatgtatacgctacctac

SEQ ID NO: 17099 - DNA, 734 bp, Diabrotica virgifera
  misc_feature (8)..(120): n is a, c, g, or t
  misc_feature (129)..(319): n is a, c, g, or t
  misc_feature (321)..(495): n is a, c, g, or t
  misc_feature (497)..(542): n is a, c, g, or t
  misc_feature (550)..(693): n is a, c, g, or t
  misc_feature (696)..(722): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnngcccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnnnnnnnnnnntatagagtttat

SEQ ID NO: 17100 - DNA, 746 bp, Diabrotica virgifera
  misc_feature (31)..(51): n is a, c, g, or t
  misc_feature (178)..(207): n is a, c, g, or t
  misc_feature (214)..(244): n is a, c, g, or t
  misc_feature (267)..(281): n is a, c, g, or t
  misc_feature (283)..(635): n is a, c, g, or t
  misc_feature (640)..(667): n is a, c, g, or t
  misc_feature (689)..(708): n is a, c, g, or t
  misc_feature (710)..(728): n is a, c, g, or t
atttcttttcaaataaaaaatccttttacgnnnnnnnnnnnnnnnnnnnnnctcaacgatagttaaattacgtatcgggagagaatctcttcaccctctaaaagaaaaatttctctcttcgtaccttcgtgtatcagggattcttcattcataattctcataatttcataaccttcgnnnnnnnnnnnnnnnnnnnnnnnnnnnnnnctctccnnnnnnnnnnnnnnnnnnnnnnnnnnnnnnntaacgaaacgttactcgttttcnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcnnnnnnnnnnnnnnnnnnnnnnnnnnnngccactggattaatttgaagannnnnnnnnnnnnnnnnnnngnnnnnnnnnnnnnnnnnnnagttttttaattgaaagt

SEQ ID NO: 17101 - DNA, 468 bp, Diabrotica virgifera
tatcaagaatctgttgagagacgtaagacatcaatatagacaacccatgatattagagaaggacttgccgtaagattctctgagtatttattacgatatattaaagtcacctccgacaccgtaacgattacccacacaggagcattgagggggcaatagtgcgtgaaggacacacttaacggaaaatcatatgaggacagcacccttattatgctacttctgcgagatagcctcacactttgggcgagtgacacgaagggcgaagctgatgcgactcatgaggctggtgataattcttagtgtggagtgtcattttttagacagttattcgagactaatgaagttgcatgtatgttgacgtattcgtgtaacttgagggagaagcttgattgagtggtcttatgttcatcctgctgaaacttcgatagataaaaagttgtaagagataagtgaatcagtagattaata

SEQ ID NO: 17102 - DNA, 474 bp, Diabrotica virgifera
  misc_feature (199)..(216): n is a, c, g, or t
aaagagcaagccattttttgtgtgttgtgggatcaggtatattagaagaacagagagaagggtaaaaagagcgaaggcgaaagagcaaaaaccctttttcttttattgtagaagagggagagagaaggaagcaccaggagagggagggcgcgcgggcaaaaggacatctgagagggaagggaaaagggagacgaaagcnnnnnnnnnnnnnnnnnnagactcctcgccccgcccgaccccaacagggagagggcgacagaaagagaagtccacgctaaaggagcagcagaattcggaaatctaggaatggaccaaggagaacacaaaagaggcagcaggaagatgatagtctccgagggaaaaaaagacccacaagcgatatgcgcaaagcggccggagacggtgcgactggaacagaagacaaagcaagagatcgtaggagacatcggaatcaaatgctacgacgaggaagga

SEQ ID NO: 17103 - DNA, 562 bp, Diabrotica virgifera
  misc_feature (107)..(129): n is a, c, g, or t
  misc_feature (131)..(146): n is a, c, g, or t
  misc_feature (279)..(299): n is a, c, g, or t
  misc_feature (301)..(319): n is a, c, g, or t
acaatcttattatgtttcctaacagatacatctatgttttgtaccctgagtctcaggactcattacctaacaattctctatttattatattcgcaaccacaacagannnnnnnnnnnnnnnnnnnnnnncnnnnnnnnnnnnnnnnacatattttctctcgataggaaagtaagtctcattctaactacaaccaatgtattcagaaaactaaacaagtctatttataaaccacatctttatagataaatatatttacataataactattaaatactccnnnnnnnnnnnnnnnnnnnnncnnnnnnnnnnnnnnnnnnnatcactcaccaactagacctcatagttttcatattgtacaatatgctataatttatttatctatattattatctttctcttttatagactcttatagtacaatatcaatttaaatcagttaaatttagcgctcacgctactattagtacaacggcgttgtatattacgaaccaatactatagcaatcaagactggcattcgccaaccttttcttcgcctgtatacgaaaaacatgtctttttg

SEQ ID NO: 17104 - DNA, 1014 bp, Diabrotica virgifera
  misc_feature (426)..(467): n is a, c, g, or t
  misc_feature (469)..(503): n is a, c, g, or t
  misc_feature (506)..(531): n is a, c, g, or t
  misc_feature (533)..(546): n is a, c, g, or t
  misc_feature (548)..(572): n is a, c, g, or t
  misc_feature (576)..(604): n is a, c, g, or t
  misc_feature (606)..(626): n is a, c, g, or t
  misc_feature (628)..(663): n is a, c, g, or t
  misc_feature (672)..(743): n is a, c, g, or t
  misc_feature (745)..(832): n is a, c, g, or t
  misc_feature (834)..(858): n is a, c, g, or t
  misc_feature (871)..(890): n is a, c, g, or t
  misc_feature (915)..(948): n is a, c, g, or t
  misc_feature (975)..(1012): n is a, c, g, or t
gtcggatatttccccccctacagtcgatcagattttgatttaatgatagtaaattagcattgtgagggaatactttatctctataacagaccaattacttttttgcacctatgtgtatccagggattattagtctcgtaattctgtatttctcatccccgccttcaaaagcgctactaagttagaattttcatcggaacccaatcaattccaagtaattttcctggaacgaaatgttacccgcttttacatatatctaatttctgaagaagtaaatcagattatatttactaacgatatctttataattgaatgtttttatgttatcacatattaactatctttagggatgagctcatccatcaaattttatatcaccattcaatttttaaataacaatcaggattaaaaagtctcatattttagnnnnnnnnnnnnnnnnnnnnnnnnnnnnnnnnnnnnnnnnnncnnnnnnnnnnnnnnnnnnnnnnnnnnnnnnnnnnnccnnnnnnnnnnnnnnnnnnnnnnnnnncnnnnnnnnnnnnnncnnnnnnnnnnnnnnnnnnnnnnnnncacnnnnnnnnnnnnnnnnnnnnnnnnnnnnnannnnnnnnnnnnnnnnnnnnngnnnnnnnnnnnnnnnnnnnnnnnnnnnnnnnnnnnncgaatggtnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnctttttagaatcnnnnnnnnnnnnnnnnnnnnctttatttcaattgggggtgggttnnnnnnnnnnnnnnnnnnnnnnnnnnnnnnnnnnctaatcaattaaaaaaatccttttggnnnnnnnnnnnnnnnnnnnnnnnnnnnnnnnnnnnnnncc

SEQ ID NO: 17105 - DNA, 240 bp, Diabrotica virgifera
  misc_feature (2)..(21): n is a, c, g, or t
  misc_feature (44)..(66): n is a, c, g, or t
  misc_feature (72)..(131): n is a, c, g, or t
  misc_feature (178)..(196): n is a, c, g, or t
gnnnnnnnnnnnnnnnnnnnngttttttagaattgaagttatgnnnnnnnnnnnnnnnnnnnnnnnggggcnnnnnnnnnnnnnnnnnnnnnnnnnnnnnnnnnnnnnnnnnnnnnnnnnnnnnnnnnnnnccaaattctttttgaaataggaaggaagctccccttaggcttaaccnnnnnnnnnnnnnnnnnnnaggggcaaaatgctttttagggaatggggggctctgaggggtgg

SEQ ID NO: 17106 - DNA, 111 bp, Diabrotica virgifera
  misc_feature (9)..(62): n is a, c, g, or t
  misc_feature (65)..(83): n is a, c, g, or t
  misc_feature (85)..(107): n is a, c, g, or t
attattaannnnnnnnnnnnnnnnnnnnnnnnnnnnnnnnnnnnnnnnnnnnnnnnnnnnnngcnnnnnnnnnnnnnnnnnnncnnnnnnnnnnnnnnnnnnnnnnncact

SEQ ID NO: 17107 - DNA, 684 bp, Diabrotica virgifera
  misc_feature (311)..(331): n is a, c, g, or t
gcttattttttaggcttagataagctatattttgtttattgatagatcatgaaaattgatgagcacagatattttatgtttcactgaaagagaaatcgatttttcgtaccttgggtatcaggtagtattaattgataattatatattgattactctttcgaagttaaaacctttaaagaatcatcatctgtattggaaactatttattttatctaattctttcgaaatgtaaggctattctgattcttgaatatatctacatatctttgaataaataaatcattttcatgtattcaccatatgtgtatatnnnnnnnnnnnnnnnnnnnnnctatgaaatatctttagctatgaccgtaactttaaaatttgtatgtataacctaatttctaccataacaattacgattaaaaatgttcacacttgtaaaatatgttactatgttattgttatgtatcattatttttatttcttatatgattttttatatacactataaatctaatttatttaaatataaccacgctgagaatattatactaagaaaaatgcgtatttcgacccactacatagacttaccaccggaattcgcatacctttttttcacctggacattatgccacatgcccttttgtcttatacataaaagactcccctgcccactgcctcattaccgtgggcgcg

SEQ ID NO: 17108 - DNA, 1010 bp, Diabrotica virgifera
  misc_feature (15)..(693): n is a, c, g, or t
  misc_feature (695)..(923): n is a, c, g, or t
  misc_feature (928)..(987): n is a, c, g, or t
ccttacgcgcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnncccaaatttttttggattataaa

SEQ ID NO: 17109 - DNA, 403 bp, Diabrotica virgifera
accacaagttaactttactttgtgaaaccggccgttaccgtcacggtacggatcagatcacaatcaaagcaccgtcaagagggcttttcattcacagtcatttgtttcgggcttctgtcgtgtgtcacataatattaatatatctacgtcatacgttttgatataaccaatgatacaaaccaaagacgtatgacgtggatatattaatgttatgtgacacgtggcagaggctcgaaacaaatgacaatcgatgaaaagccctagtcaagggacaacccattcgcacacaatccgggcagatcaccgtcagcctacttcaccattcaggtcgatcaagatgcaaggttatagatagagtctaaatagagttcttagtatttgcactaatgatctccattctttg

SEQ ID NO: 17110 - DNA, 228 bp, Diabrotica virgifera
cgtattgacgtaaaagagcactcgactgtcggtcagttgtggatctatttttattaatagaacgagtataaagttatacttatactcagcaactaaccaattacttaactactattataggactcaaggtatatagtctgaaacttctggatatggaagccccgccggccaagtcgcttctttgagcgtcgggcccttaggccccattctattccaagatcaaatcct

SEQ ID NO: 17111 - DNA, 738 bp, Diabrotica virgifera
  misc_feature (12)..(29): n is a, c, g, or t
  misc_feature (46)..(64): n is a, c, g, or t
  misc_feature (195)..(228): n is a, c, g, or t
  misc_feature (232)..(261): n is a, c, g, or t
  misc_feature (274)..(732): n is a, c, g, or t
atttttctttcnnnnnnnnnnnnnnnnnnctctccttcgtaaaagnnnnnnnnnnnnnnnnnnncttacacatagttcattcgtattcgtgagagaatctctttctttctctctaaatggaaaatttcttttcttctacctcgtgtatcagggattatctcattaataattctcatcatcttctctcattttcgnnnnnnnnnnnnnnnnnnnnnnnnnnnnnnnnnnatcnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatc

SEQ ID NO: 17112 - DNA, 511 bp, Diabrotica virgifera
gcccctttacgggcggaaaggggaagagagcaaagacggaaaaatttttgaaacgtaggagagcactggaaccaaggaaaaaagaagaacgaaaagaaccgcagaacgaaacacggcaacaagaacacaacgcaagcaccgcgaaaaaagacgaggcggaccataaggaacaccagaagccggagaccgcgcaaccgaaagcacttctgagatagtatggaaaaaggagtctaaagaatacgaagatagaatataacgacctttattgtctccactgcacattctacagggcgctgccgtaagaatttcacgagtaaaatccctgcagatttcaataatctagcaatactttaacgataacacaaaagagacaccaggaagacaatagtcttgcagcaaaaacatgacccgaagtgatatgaggggagctcccggattacgtgtcttactgcaacataagaccacgcttgaatcgtaggagactaagtgataatttgctacaactagatag

SEQ ID NO: 17113 - DNA, 302 bp, Diabrotica virgifera
  misc_feature (2)..(63): n is a, c, g, or t
  misc_feature (69)..(91): n is a, c, g, or t
annnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatcaaaaaaataataagaag

SEQ ID NO: 17114 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17115 - DNA, 882 bp, Diabrotica virgifera
  misc_feature (786)..(804): n is a, c, g, or t
  misc_feature (846)..(846): n is a, c, g, or t
  misc_feature (863)..(863): n is a, c, g, or t
  misc_feature (867)..(868): n is a, c, g, or t
aatcttattaactgctgccttgaaaagccctgtagtggatgtcgcaaaccaggttctcgagttcctgagccaagatattcttcttcttccgacgcctcttttaccattcacctttcctcttttaccattcacctgcaaaagggattttaacaggttatatttttttcatttcttgtgatgtggcctaaatattctaattttcttcttttcaccgtgcacattatttccttctctttgttaagtttttggagtattttgccatttgatattttgtccatccagaatatcttaagaattcttctatatgtccacatttcgaacgcatccagtctattcgttgttgcttccgttagagtccaagaatctactccatataagatgtagaatatataacatcggaggagtctgagtttcagttctaaattcaaattgtgtgatttgaacagtttggacacttggatgaatgctgcccttgctttttctattctagcttttatttcttgggagtggtcccactgctgggacacgttctactactttttggttgatggtaaactgtaccttctcaatggtgattatcatgactttagttttagaagtgttaatttttagtccatatttgctactaacttctgctttgttcattcaaagttgtaacccttgtgcagtgtcggcaaagataacggtatcatcggcatatctaaaattgtttaatagttcgccctttaacaggtttccttcttccatgtgttctagccccttgggtttcttggaaagttgcctctnnnnnnnnnnnnnnnnnnnggggtgatatacatccttgtcgaaatatttttatatcatctngtacttcatattgactntaanncggagtgactgatt

SEQ ID NO: 17116 - DNA, 384 bp, Diabrotica virgifera
acaccttaccaatgtaacaacagacaatacaccaaagatggaatcgagtattaccacaactgagtatacatgatgtgcacgaagtcttacatgccgttactaagacttatggactcaacgctctatccgctacaacgaacactttcaaaggaccgatgattctatttccgcatcaggactgataagaatagattcctccgaaagagcaaccgccgtcgacgttagtaaccaaagttgtgaaaagacactcaaacaagatatctagagatctcattaaatctgagcatcttaccagcgacactactaatgcctattaggtattgcattatatctaagcgctgaatgctgctacagcttcaaaagattataaccacgtcacagata

SEQ ID NO: 17117 - DNA, 626 bp, Diabrotica virgifera
accagactccgtaatgggtatacgcaacgtatcccctattactgttatcatccatgaaagaatgtaagagagcataccaatccataaaatacacatcacgaacgctacaggaataggggatacgttgcgtataccagactccgtaatgggtatatcatttttagctattggcgcaggagtaccggaagcagtatcgagtatagtagtcgtcaaaaaaggaaagggtgctatgggaattagcaattctttggggtcgaatacatttgatattttgctctgcttaggagtcccttggttattaaaagcaactgtagtttcctctaataaatgggtaaatatcaactcttcggggcttcaatatagtacagttactcttctagttacactcatagctttttattttgctttaacttgtaataaatttaaattagacaaatggataggactctactgtttaatcatttatattttgtttgtgattttagccactttgatagagctgaatgtattttttccagttaattcacctacctgtggtagatagaactatatcatattggtatataatatattagagtatttatgaattatatttttcatagaaccaataaatcaaatatattttt

SEQ ID NO: 17118 - DNA, 222 bp, Diabrotica virgifera; identical to SEQ ID NO: 7599
  misc_feature (6)..(28): n is a, c, g, or t

SEQ ID NO: 17119 - DNA, 872 bp, Diabrotica virgifera
  misc_feature (202)..(273): n is a, c, g, or t
  misc_feature (282)..(836): n is a, c, g, or t
  misc_feature (841)..(841): n is a, c, g, or t
  misc_feature (846)..(869): n is a, c, g, or t
atttcatttacaaaaataaaatcattctttacggaaaatgtaaaggaaaaaatttctctcttacaacgatcggttcaattcagtaaccgtggaggggaatcactttcatccctctataaatgaaaaatttctctctcttcgtaaccttcgtggtattcatgaggattaattcaattcaataattcatcataatttattatcnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaanaagcnnnnnnnnnnnnnnnnnnnnnnnnaga

SEQ ID NO: 17120 - DNA, 909 bp, Diabrotica virgifera
  misc_feature (106)..(164): n is a, c, g, or t
  misc_feature (601)..(601): n is a, c, g, or t
  misc_feature (633)..(647): n is a, c, g, or t
  misc_feature (803)..(803): n is a, c, g, or t
  misc_feature (806)..(806): n is a, c, g, or t
  misc_feature (810)..(810): n is a, c, g, or t
  misc_feature (818)..(818): n is a, c, g, or t
caaaaaacttgtggaatggaaccaaataggaaccattttattattccttatagtaagagttcttctagatgtcaattctgtagacaacggtgtaagtccagcacgnnnnnnnnnnnnnnnnnnnnnnnnnnnnnnnnnnnnnnnnnnnnnnnnnnnnnnnnnnnagccgaaagaagaggaagagtcggataatgaaggcgaactaaggatagatgaaggaaaagacgaaatggaaatgaagcctcatccaatggagaataaggtcttcgtgtggaacgatatcgtagtaccaatggatattgaagtagacgattcaaattacgagtacaccgaagataaagtagacgacaacgtttccttagacctttccattcggactcagtctcctctggacagtgaaaatagctgcttgggtcaagaatctgtaactccaaatagtattcatcattcaccactggctagtacggaaaagatccctacccatggtaatgacatttcagtggctcaacacaaacgggtctttaagtgtcctcattgtactttttgggcctccacggcttctcgtttccacgtccacatcgtgggccacttaaacaaaaangcccttcgagtgttccttatgcgcgtaccggnnnnnnnnnnnnnnngacatcaccaaacacattaaacttaaatcagttcgggaccaagctcacgagcaagctaaagttttgatgactgatgaaacgggcagaagaaactataccaaatacaacaagtacctgacagaaattcctgtgacgagcgagcagtgcatggatacnagntggntggttgtngccacaagaccaaaacaccacgacagaaattcctcaccttcgaccagcaaaactgatctacctaagttaaataagattccaaacaaacaat

SEQ ID NO: 17121 - DNA, 758 bp, Diabrotica virgifera
  misc_feature (91)..(112): n is a, c, g, or t
gttagtagaagtcaagaaaaattcttatgttaatagataagattaattaggaatatgaagagataaatacttttgattatttactagagannnnnnnnnnnnnnnnnnnnnnagtatcaggaattattaactattatatacatatttctatagtctccgactgagactcgcatattgaaaattttgtttatcgcagaaaaaaatatttgccatgaatacttatgcaaagattcgcatataccaaaataagaatatcgaaccatttgacatgtaaagaaaaattacttagtaacaaaatatagaatcgtgtatcatccctatcttcccagagataggaaataagccaagatgaaacagatggaacaagctcaccagcagctctttgtgaaaaacgagtccctattaaacaaatgtcatatcctcaagctcgccatccttaatctccatcaagaatacacagaactgtactatcgactgcagaccccttgtctgacatgtgccctagctcataaccgatctgtgcgaatgtgagtccctaaatgaatccacatcgaccctccttctgtcgaaagaaagaggcacacacccagccgcgtttttcacctgacaataaacaacgtgcctgttggaaatcgaactgacctgtcttctgtccgctgctccttgatgatgtccacgcagacgtcaaccttatctcgttgcatcaactctctcagagtctcactgaagatatcgccggagacttggatgctactgct

SEQ ID NO: 17122 - DNA, 531 bp, Diabrotica virgifera
  misc_feature (288)..(307): n is a, c, g, or t
  misc_feature (323)..(368): n is a, c, g, or t
  misc_feature (393)..(405): n is a, c, g, or t
  misc_feature (407)..(421): n is a, c, g, or t
  misc_feature (424)..(441): n is a, c, g, or t
  misc_feature (443)..(455): n is a, c, g, or t
  misc_feature (477)..(502): n is a, c, g, or t
tatgctatatcataaaaacattaacttagtaatcataatgttgttattattcgagtttaacagagctagcgcctcataattcttattgcgcgaaagaaatctattacttattttgtaaggagatgtatgtcgccatttacctatatataatttattaggaaatagattatccttatttattaacaggtatatgttctaacataccctattcttatattattacgacttgatattttatatcttccacatgaactgtatcattatataacatttattgttgaaatactnnnnnnnnnnnnnnnnnnnnatattttaatagatgnnnnnnnnnnnnnnnnnnnnnnnnnnnnnnnnnnnnnnnnnnnnnngttattacaatatacatgtaaatcnnnnnnnnnnnnngnnnnnnnnnnnnnnntgnnnnnnnnnnnnnnnnnngnnnnnnnnnnnnncagctttaataatccaattcgnnnnnnnnnnnnnnnnnnnnnnnnnncaaacatgtcctttttgtattaactatag

SEQ ID NO: 17123 - DNA, 369 bp, Diabrotica virgifera
  misc_feature (2)..(94): n is a, c, g, or t
  misc_feature (227)..(244): n is a, c, g, or t
  misc_feature (280)..(297): n is a, c, g, or t
  misc_feature (308)..(340): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagggataaacagcgtaatttttattggagagttccaaatcgataaaaaaagattggggacccccgaagggggaattaaaggttaataattgggggtaagaaggcttttattattaaagtttgggttcgcnnnnnnnnnnnnnnnnnnaatggacctgggggtttaaaacccgggggggggagnnnnnnnnnnnnnnnnnnctttttttctnnnnnnnnnnnnnnnnnnnnnnnnnnnnnnnnnggcgcaactgggaggcacccacacaaata

SEQ ID NO: 17124 - DNA, 742 bp, Diabrotica virgifera
  misc_feature (9)..(32): n is a, c, g, or t
  misc_feature (75)..(97): n is a, c, g, or t
  misc_feature (105)..(120): n is a, c, g, or t
  misc_feature (122)..(137): n is a, c, g, or t
  misc_feature (148)..(186): n is a, c, g, or t
  misc_feature (190)..(221): n is a, c, g, or t
  misc_feature (231)..(595): n is a, c, g, or t
  misc_feature (597)..(664): n is a, c, g, or t
  misc_feature (670)..(701): n is a, c, g, or t
  misc_feature (703)..(722): n is a, c, g, or t
  misc_feature (731)..(731): n is a, c, g, or t
  misc_feature (733)..(734): n is a, c, g, or t
ttttctccnnnnnnnnnnnnnnnnnnnnnnnntaacgatagttaattcgtatcgtgagagaatatctttcttttnnnnnnnnnnnnnnnnnnnnnnnctacctcnnnnnnnnnnnnnnnncnnnnnnnnnnnnnnnntcatttcttcnnnnnnnnnnnnnnnnnnnnnnnnnnnnnnnnnnnnnnntccnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnntcgcgnnnnnnnnnnnnnnnnnnnnnnnnnnnnnnnnannnnnnnnnnnnnnnnnnnnctggatggnanngggtggat

SEQ ID NO: 17125 - DNA, 56 bp, Diabrotica virgifera
  misc_feature (2)..(15): n is a, c, g, or t
  misc_feature (27)..(44): n is a, c, g, or t
gnnnnnnnnnnnnnntagaattaaagnnnnnnnnnnnnnnnnnngagatataggtt

SEQ ID NO: 17126 - DNA, 621 bp, Diabrotica virgifera
gcggggaggtatatttatggaagcaaaaaagtacccgctgtgtaggacagatgcaacttttcatagtgaaatagatatggtgttgcaccggttcattcgtttcttggatctaggatttaattattttgtacttgctaataatagatctagccctagtgatgataatgttactttaatcgaactagaataagccagaccatcttaaaacacatagcgctgtattacacacattacttgaagccttaacgagtggtaggagtagaagtcccatatatgacttacatggtcattagcaatgcctgaaaaagatgaaaatctgaatatgcactaagtcttatgaaaatacgattgagtacaaaactctcttacaaaagctattgcacaagaaaggattcaatggttttaaactaaagaaaagacttaataacccatccattatgtgatacaatatctctcaacgatagcactacctggcacttcgagtcacctttgtgtacgtcatcactggaaagctctccatatcaccaatagggagaagatgatcacagcaatgagagagtatgacatttgcatatatagtgatgaatagaacacccaggttacgagaagcactatagatac

SEQ ID NO: 17127 - DNA, 374 bp, Diabrotica virgifera
  misc_feature (13)..(33): n is a, c, g, or t
ttaaaagcaaagnnnnnnnnnnnnnnnnnnnnngaaattagtactgtgagtgaagattttatttgtatcaaagaaacattgatttttcgtaccgtgtggatgagagattagagagtaataataaggaactcctgaggaaggaagttacgcgtgaccattagcttcatagtttaatgcagaaaatataacctaatcaatttgaagagtacagcgtgccgagctgaactttcccggtctatcagggaacggatcgccaaaatagaacacctgagaaatttacctaggagcattcacgtaattcgtatgcgatatatgatatcactcgagtactcacctaaaacgattattttcttacatcgccattcagacccaca

SEQ ID NO: 17128 - DNA, 876 bp, Diabrotica virgifera
  misc_feature (764)..(764): n is a, c, g, or t
  misc_feature (779)..(779): n is a, c, g, or t
  misc_feature (798)..(818): n is a, c, g, or t
cggacgcgtgggaaaaaaagcgataacgaaaataaaccaaatattcaggatgaagacagcgaaagcgctgaggaacagcctctcgatgttggcgaacactatttggtgcgaagatctgacgacacttggcatcctgctgagattatacagtctcgatttaatgagctcgaaagacagtacgaatattacgtgcattatgaaggatacaacagaagattggatgaatgggtaccaagaggaagaataatgtcttccaggttcaatatgacagaaagtgggcagaaaggaatgttggatatgaaagtattgagagatagaccattgatcaatgacttactatctgataattctgataggaagataactagaaaccaaaaacgaaggcatgatgaaataaatcatatacaaaaaacttatgctgaaatggaccccacaacagcagctttagagaaagaacacgaacaaataacaaaagtgaagtatatagacaaaatacagattggcagatttgaaattgacacctggtattttagtccctttccagaagaatatggaagacagagtaaattatggatctgtgaatattgcctaaagtatatgagattagaaaaaagttatagatatcacatggagtgaatgtactcaacgccagcctgttggaaaagaaatttatagaaagggaaccctatctgtgtatgaagtcgatggaaaggatcataaagtgtactgtcagaatttatgtctacaagcgaagctgtttttgnaccacaaaaccttantattttgatgttgaaaccnnnnnnnnnnnnnnnnnnnnngtgaagtcgacaaacagggcgcacatattgtaggatatttttcaaaggaaaaaagatc

SEQ ID NO: 17129 - DNA, 998 bp, Diabrotica virgifera
  misc_feature (99)..(985): n is a, c, g, or t
aaaaaaatctcttctcttcaatcgataagttcaattcagtatccgtggagtgaaatcttttctttctctaaaagaaaaatttcatcttttcgtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaagggaaaa

SEQ ID NO: 17130 - DNA, 993 bp, Diabrotica virgifera
  misc_feature (16)..(38): n is a, c, g, or t
  misc_feature (821)..(822): n is a, c, g, or t
  misc_feature (831)..(831): n is a, c, g, or t
  misc_feature (847)..(847): n is a, c, g, or t
  misc_feature (905)..(928): n is a, c, g, or t
ggtgttttggtttttnnnnnnnnnnnnnnnnnnnnnnntgtaggttacatatattttaatattaagtattaaaacatttacatgatttttcgaaatagtgtacatcgatattattaaaatggcaaatgttcttacaagaattgtttcaagggcagcatgtggtagattggtcaaaagagaattttccatactttcctactaccactatccttgcataactagattaaacaaacgcataaacgattatagttttagttgcgatcattataatctaacatttcgtattaatccacaaaaatatagaatatgcaattattcagataaggggggtgaaaagccacctgaaaagttgacactgtttcagaagtttaagcaaatgtatagagattattggtatatattagtgccagttcatcttgtcacctccagtatttggtttggtggattttactacatggcaaaaagtggtattgatattgtacatatattggaatcatggcacgtcagcgagaaggtattaaatccattgagggattcaagtatgggttatctagcagttgcatatgcatgttataagattgctactccagcaagatacacagttacattagggggaactaccatttccatcaactatctgaaaaaatggggttatatcaagcctgtaccaagtgctgaaagaatgaaagaaatataccacgagaaaaaagaaaatattactaagactgtacgagaaggtataaaagaaaaaaaggaaacttttatggacagttttcacgaaaccacagagggtataaaggaaaagaaggataatttgttannaactgtaanaaaatctgctgatatncagaaaacagagtttaagaaaaaaacatagtgtagctaaatgtattgttttttaatgnnnnnnnnnnnnnnnnnnnnnnnnggtattttttaagatagtccgaaatcttttgtttacaattttttacctagaaaaggatcccaatc

SEQ ID NO: 17131 - DNA, 760 bp, Diabrotica virgifera
  misc_feature (46)..(63): n is a, c, g, or t
  misc_feature (78)..(103): n is a, c, g, or t
  misc_feature (105)..(124): n is a, c, g, or t
  misc_feature (174)..(195): n is a, c, g, or t
  misc_feature (369)..(387): n is a, c, g, or t
  misc_feature (703)..(727): n is a, c, g, or t
aagtttttgagccgtcaacatgggtgagctttcgttctgtcagagnnnnnnnnnnnnnnnnnngagttaattagtacnnnnnnnnnnnnnnnnnnnnnnnnnncnnnnnnnnnnnnnnnnnnnnccgtgtggatcaggcattagcaattaaacataacaaactcattaagatcnnnnnnnnnnnnnnnnnnnnnntacatatttaaaagcaaaaaatataagataatcaatattaaagatttttagtgccgagcttactaatacaagtctattaaaacatagatttcaactaacaaacacactcagaaatcttcctattataactcatgttattactgatagttataaatcatcatcttcatttacccnnnnnnnnnnnnnnnnnnncacaactttcatttatatgaaattaaacatgtatgataccactcacactaaaatagttgaatattcagtcagacatttaggattgcgaagcggcttcgcatacatctctttgcacatgtctattactgacaccactgatcagaaccacttcccagactcctcctctccacagatcaaatttactgccccgcgtattccagacccgtgcccctgacctcacacacctatcctcatctctctccccctttgaacgctctcatacccccgcccccccccaaattatttctataggaaccgcagcttttccccccggctnnnnnnnnnnnnnnnnnnnnnnnnnaccgcccttccgccactacccccctctctcccc

SEQ ID NO: 17132 - DNA, 591 bp, Diabrotica virgifera
ctcccggctcctttaagcgcccgctgtcttttgttcaacagcttattttctttttaacgtctacgaaaattgtatttaatgatagctacgtagtacaggtcgcgcgatatcgtccttctcttttagatacgaatatctgtttgcgcttgacgtatctgctgaaaaaaaagaagtggataaaatgaaatcttaggacatgtggaatgagtcttcttaaacctcagctcaattacaggaataacaacacgagaatcaagatgacgagtaatgtcttccgggattaaaaatatcctgtcgatatgagccctgacagctgattataaatcccattgagacacctaccgatgatcactgatttaatatctgatagatctgagaactatacaactagaacccaaaaacgaaataatggtgaaatgcatcatatacaagaaacttatgatgaaccgcaccccacaacaggtgctttggagtcatcacacgaactaataactaaagtcgaaggcatagacaaaagacagattggcagatttgaaattgacacctgaggatttagtccctttccagaagaatatgacagacagagtaaat

SEQ ID NO: 17133 - DNA, 222 bp, Diabrotica virgifera; identical to SEQ ID NO: 7599
  misc_feature (6)..(28): n is a, c, g, or t

SEQ ID NO: 17134 - DNA, 333 bp, Diabrotica virgifera
ctgtgatttctattttacttgtataataaaaaaactgactgcgcgcgccgtgcggaaaaggaactcggaattaaacataacgaactccttagagaaataaattaagtctacctattaacaatatacttaaaaggaaaaactataagagaaccaatatgaagcataccgagggccgagcctaaaaataccagtctattagagcctaggccgcacgcaacgaatacgatgagaaaccttccgatgatcaaagatgttataactgatagatatatatcatcatctacaagaaacataaatcggatacaaaaagaaaaacttcaaacatataaaact

SEQ ID NO: 17135 - DNA, 211 bp, Diabrotica virgifera
  misc_feature (14)..(65): n is a, c, g, or t
  misc_feature (71)..(90): n is a, c, g, or t
  misc_feature (105)..(131): n is a, c, g, or t
  misc_feature (163)..(200): n is a, c, g, or t
acccaaccatgagnnnnnnnnnnnnnnnnnnnnnnnnnnnnnnnnnnnnnnnnnnnnnnnnnnnntctcgnnnnnnnnnnnnnnnnnnnntccctcgacctcctnnnnnnnnnnnnnnnnnnnnnnnnnnntcccctccctcacgcccaccccccccactctnnnnnnnnnnnnnnnnnnnnnnnnnnnnnnnnnnnnnnttccaccacct

SEQ ID NO: 17136 - DNA, 600 bp, Diabrotica virgifera
tttaagccgcgaggtcacttctgcagaaccaaaagatatccctaatgacttatccacaaaactttaatgatggttacgaatatcattccaacgatatctccaatttcttaaacgttcgaagaactgaatgcgtacgaggtaacgataataaaaatagagagtggatataataggactttaggtggaattagtaagagctgattaatactaatttcttttacaacactaactagaataggattaatttggagtgttctgagaattcttcaagaataatatctagtagatctgggcactaggaagttcctatcaagaaattgagtatcctaacgattaaaatttattgtttatcggatagaacagaagactatctcagaagaaccctaacttagtacaacattgaactccttcaaatttaagaaaatttatattgtgcgtacgacacaactagaaatgaaaaatcatcaggaacattattagtatatttaagtgctaatataatcgacagacagttataactgacacgtcaccgatagactgaatcggtttcctgattctatgtatataaagttttatttattgtccgagtattacaatcta

SEQ ID NO: 17137 - DNA, 676 bp, Diabrotica virgifera
  misc_feature (2)..(24): n is a, c, g, or t
  misc_feature (37)..(72): n is a, c, g, or t
  misc_feature (78)..(151): n is a, c, g, or t
  misc_feature (184)..(205): n is a, c, g, or t
  misc_feature (227)..(239): n is a, c, g, or t
  misc_feature (241)..(277): n is a, c, g, or t
  misc_feature (293)..(316): n is a, c, g, or t
  misc_feature (318)..(427): n is a, c, g, or t
  misc_feature (429)..(469): n is a, c, g, or t
  misc_feature (473)..(568): n is a, c, g, or t
  misc_feature (575)..(613): n is a, c, g, or t
  misc_feature (666)..(666): n is a, c, g, or t
  misc_feature (671)..(671): n is a, c, g, or t
cnnnnnnnnnnnnnnnnnnnnnnncataaatttttcnnnnnnnnnnnnnnnnnnnnnnnnnnnnnnnnnnnncgatcnnnnnnnnnnnnnnnnnnnnnnnnnnnnnnnnnnnnnnnnnnnnnnnnnnnnnnnnnnnnnnnnnnnnnnnnnncctcacccgtttattaaaaacacggtcttttcnnnnnnnnnnnnnnnnnnnnnncgcccaccgattaatttgaacnnnnnnnnnnnnncnnnnnnnnnnnnnnnnnnnnnnnnnnnnnnnnnnnnncgaaagctcggaatcnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnngtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnnnggcgacctcgatggtggataaagtttataatggtggagcagctatattataangtctngtcga

SEQ ID NO: 17138 - DNA, 391 bp, Diabrotica virgifera
tctcttcgcgtccgaaaatatcggtcaaaatctagatatcatcaattccgccatggtcaccatagcaaaccaagttttgaaaccagaaaaagacccaataaagaaaaaggattggatgaccgataaaatattagacctgattcaacaaagaagaaattggaaaaacaaagacgagattcggtatagagagatatatcgacaaataagatacgaggttaagcgaacaaaagaggactggatgggacaaagatgtcgtgaaatggaagaactacaaagaaaacatgacgagtttaatatacataaaaagcttaaagaaattacatacactcagagaaaaagaactcctcactttatgagaaactccaaaggtaaaataattctcgacttggat

SEQ ID NO: 17139 - DNA, 406 bp, Diabrotica virgifera
  misc_feature (217)..(241): n is a, c, g, or t
  misc_feature (321)..(321): n is a, c, g, or t
  misc_feature (376)..(376): n is a, c, g, or t
  misc_feature (378)..(396): n is a, c, g, or t
gtaggaacgggtttaaactttgatttggtcactttctgactttcataataataatttttaaccgacactaaatcttgagggtgataattttcgcgtttttcggattttggatcgcattgaactcgacaacaataggttttgaagaaaagttacgggagaccttttttgctccgaatgacctaaatgatctgataaaaatggtgtccgaaattaatgnnnnnnnnnnnnnnnnnnnnnnnnnacggtttttcgaccacggtacctccaggtaccttgtggatttgttgtagggacttatttttcagtgagtttgtgcagggngatcgagtcggaataatttacctaaacgaggcgacgatacaacctggactataantnnnnnnnnnnnnnnnnnnnggacacctac

SEQ ID NO: 17140 - DNA, 928 bp, Diabrotica virgifera
  misc_feature (403)..(426): n is a, c, g, or t
  misc_feature (439)..(462): n is a, c, g, or t
  misc_feature (833)..(856): n is a, c, g, or t
  misc_feature (862)..(862): n is a, c, g, or t
  misc_feature (905)..(905): n is a, c, g, or t
gctaaaagtattgagtcttgtaataataaactgttttcggtaaaatttaagttcttttattgcagtttaagaaattttagcccctattggatattgtataagaaaagtattcagtaatgacaatggagaaaatcacagaactgaagaaagacattgctgagctcgaatcgctagaaaaacaagccacgagacaaaaaaataaagacatactgagtatagaaatcagaaaattggtatcggaagttgtacttttggaagaaaaactgaaaactcaaagcaatcctgtaacctctccaatcgccagtctctctaccggaacagtaaataagagatatcaagttaaaataaataattatgcatgggatcagtccgataagtatgtcaaattctatattactttaannnnnnnnnnnnnnnnnnnnnnnnaaaatgtcagttnnnnnnnnnnnnnnnnnnnnnnnngtttaacagtgacggatctggataataaggaccatagttggcaaattaaaaatctgttgaaaaatattgatccagtgaagagcacatggaaagttaaaactgatatggtattgataaatgcagcaaaaacatcgtcagataactggtcacatgttacagaatggggagaaaaaggctagtgacagtaaggcacctaaaatgggacactggacaaattggatccatctgaaggactaatggtcattgatgaaaaatatgtacgattctggagatgatgaaatgaagcgaactattgccaaagcttggacagaaagccaggggaaaaaccaggccgccagttttatgtaacacttagttgtaggatactggcnnnnnnnnnnnnnnnnnnnnnnnnccatanaaatgggtgacattcctaggtttcaatggatttgtttgtagantggtctttctggtataaaatctt

SEQ ID NO: 17141 - DNA, 353 bp, Diabrotica virgifera
  misc_feature (253)..(253): n is a, c, g, or t
  misc_feature (303)..(303): n is a, c, g, or t
  misc_feature (339)..(340): n is a, c, g, or t
gtaatcggtgtttgtgagcgtttctaaaaataacttatttatattagtgcgcactgcgcagtaggtttatatcgttcgaaaatggcgtacaataaagttgtgtgtcggctgtgcttatcggaaaaggaactaaactgtgtttttgaaaataattctgaaaaaaaggatttacaagatgtgatatttactactactggagttaagattttggagaaagatgtcatctctaggaaaatatgtgccaattgcagtnaagtggttgttaaaatgaacgaattcagagagagatctattaggactgancagtatcttaaggaaaaatgtatcgagcatttgaanngcgacgaaatgaa

SEQ ID NO: 17142 - DNA, 845 bp, Diabrotica virgifera
atgagaggcgaaaattctggaaggaaaggaaatttcgatacctgttacaaagcaagtgtttagttcgtgaataagttaaatatatttatcatttaccggtaaaatggaacagggtaacaacttctacaaaaataaagattttgaaaatgctattgtacattacaacaaggctatcgaacatgatcctaccgacattactttttacaacaatttagctgctgtttattttgaacaaaaggagtacgaacaatgcataaaagaatgccaaagagctatagatcttggtagagaaaacagagctgattttaaacttattgccaagtcgttcatgagaattggtaacgcctataaaaaattaaaagactataaaacagcgaagacatattacgaaaagtctatgtctgaacacagaactcctgaaatcaagacgttgttgtcagatgtagaacgtattattaaagatgaggaaaggaaatcgtacatcaatccagaactagctgaaaaggaaaaagaaatgggcaatgatatgttcaaaaagggcgactacgctaccgcagtgaagcattacactgaagctattaagcgtaatccagacgatgcaaaactatacagtaaccgtgctgcatgttatacgaaattagctgccttcgatttaggcttgaaagactgtgataagtgtgtagaactagacccgaagtttattaaaggttggataagaaaaggtcacattctccagggtatgcagcaacagagcaaagccatttctgccttccagaaagctctcgacttagatccgaataaccaagaagcgttacagggatacagggcatgtactattgaaaacg

SEQ ID NO: 17143 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17144 - DNA, 881 bp, Diabrotica virgifera
  misc_feature (2)..(58): n is a, c, g, or t
  misc_feature (113)..(136): n is a, c, g, or t
  misc_feature (143)..(174): n is a, c, g, or t
  misc_feature (186)..(224): n is a, c, g, or t
  misc_feature (229)..(259): n is a, c, g, or t
  misc_feature (284)..(319): n is a, c, g, or t
  misc_feature (330)..(389): n is a, c, g, or t
  misc_feature (391)..(467): n is a, c, g, or t
  misc_feature (470)..(643): n is a, c, g, or t
  misc_feature (645)..(690): n is a, c, g, or t
  misc_feature (692)..(774): n is a, c, g, or t
  misc_feature (776)..(834): n is a, c, g, or t
  misc_feature (845)..(845): n is a, c, g, or t
  misc_feature (857)..(857): n is a, c, g, or t
annnnnnnnnnnnnnnnnnnnnnnnnnnnnnnnnnnnnnnnnnnnnnnnnnnnnnnnnatcttacacgatagttaattaagtattcggtggagagaataattttctcttttcnnnnnnnnnnnnnnnnnnnnnnnnacctcgnnnnnnnnnnnnnnnnnnnnnnnnnnnnnnnntcatttatctcnnnnnnnnnnnnnnnnnnnnnnnnnnnnnnnnnnnnnnnttcgnnnnnnnnnnnnnnnnnnnnnnnnnnnnnnntaacggaaacgttattcgtttttcnnnnnnnnnnnnnnnnnnnnnnnnnnnnnnnnnnnncatttcattcnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnngtaaaagcttnaattttttttanagacgagagaccctatagagttta

SEQ ID NO: 17145 - DNA, 226 bp, Diabrotica virgifera
  misc_feature (2)..(15): n is a, c, g, or t
  misc_feature (17)..(35): n is a, c, g, or t
  misc_feature (37)..(68): n is a, c, g, or t
  misc_feature (70)..(83): n is a, c, g, or t
gnnnnnnnnnnnnnngnnnnnnnnnnnnnnnnnnngnnnnnnnnnnnnnnnnnnnnnnnnnnnnnnnngnnnnnnnnnnnnnnctttttttcagctgtttatataaaacatggctttttgccatgaacataattaatactatgcccgctgatggagtcgaagggacacgcgaagttttccccgcagagactgcatatacagaataatgcctgacctaaattagtga

SEQ ID NO: 17146 - DNA, 802 bp, Diabrotica virgifera
  misc_feature (2)..(17): n is a, c, g, or t
  misc_feature (20)..(41): n is a, c, g, or t
  misc_feature (43)..(66): n is a, c, g, or t
  misc_feature (78)..(107): n is a, c, g, or t
  misc_feature (118)..(156): n is a, c, g, or t
  misc_feature (332)..(353): n is a, c, g, or t
  misc_feature (355)..(397): n is a, c, g, or t
  misc_feature (431)..(595): n is a, c, g, or t
  misc_feature (601)..(729): n is a, c, g, or t
  misc_feature (731)..(777): n is a, c, g, or t
gnnnnnnnnnnnnnnnncgnnnnnnnnnnnnnnnnnnnnnncnnnnnnnnnnnnnnnnnnnnnnnngtacctcggtgnnnnnnnnnnnnnnnnnnnnnnnnnnnnnntatttaattcnnnnnnnnnnnnnnnnnnnnnnnnnnnnnnnnnnnnnnnatcggtaaaataaataattttcaataatttttcttcggaacggaaacggtattcgtttttcaatatatctaattttttcagaaaataaattaaatttcatcttcatctcacaatatatttcatcaattaaatcatttttcatcattcatctcatattaaatatttttcagggatcnnnnnnnnnnnnnnnnnnnnnncnnnnnnnnnnnnnnnnnnnnnnnnnnnnnnnnnnnnnnnnnnncattttaaaatacgcattatttatcttttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnncaagctttaattttttaaagacgag

SEQ ID NO: 17147 - DNA, 726 bp, Diabrotica virgifera
gcaagtggcaactgcattaactaacgatcttttctgctttgtcgatgcctggcagaatataaaccacacgaacaggacagttgataggggtgtcgtgagacgaggaagtaaacatctgaagaacggacgtatccgaaaacagacataaaaaggaggaaccgaagcggcagacgtcgcaggaaatgagaacccaaaaactgcgtgaaaagtaatattacggcggaaggcaggcggagaggacgtagacgagggagaatagcagtccagtgaagaagaggaaaacacgtagctataaatagatagtgaaaagtggtgatgaagaaatggatgctcgacatgaagaggatgtaaaggatgagggtgaagaataacaagaggaacatgtcgcataataaagagagagccgccaaaccccgggaactatacttcccaggactatctctgagcatcgtctccagttactttgtggacattttattttcattttctgttagtacctcgacatagcgactgacacgccagcatgtcccacgtagcctacgtagatatgactaccttcatatgacactccatccatcgtacacgtccttcatcattctatccgcagaatacctcgtgaagtttgccgaccgagctagagatcttcagtgaccgagagagactgtacgtgacccacgatgcctgactatttctagctcatgaggcatccccttcgatttgtaaaaa

SEQ ID NO: 17148 - DNA, 772 bp, Diabrotica virgifera
  misc_feature (367)..(391): n is a, c, g, or t
  misc_feature (412)..(437): n is a, c, g, or t
  misc_feature (448)..(484): n is a, c, g, or t
  misc_feature (558)..(558): n is a, c, g, or t
  misc_feature (581)..(581): n is a, c, g, or t
  misc_feature (589)..(590): n is a, c, g, or t
  misc_feature (597)..(597): n is a, c, g, or t
  misc_feature (611)..(611): n is a, c, g, or t
  misc_feature (619)..(619): n is a, c, g, or t
  misc_feature (621)..(622): n is a, c, g, or t
  misc_feature (627)..(627): n is a, c, g, or t
  misc_feature (631)..(631): n is a, c, g, or t
  misc_feature (633)..(634): n is a, c, g, or t
  misc_feature (649)..(650): n is a, c, g, or t
  misc_feature (656)..(656): n is a, c, g, or t
  misc_feature (673)..(673): n is a, c, g, or t
  misc_feature (681)..(681): n is a, c, g, or t
gtgcaaggtatgatgacgggaaaaggtggttgcgaaattttcttgtcgtgaaaagcgtcgcgccgaattttccgagtcgaatcgaatcaaagaaaagttttttagggccaagtataaaagcagaaaaagaattatcacaatgataaaagtcgacgaaaatgatcccgtaggggaggttcaattaagtttcccacatagagaagttcaaattcaaagagggaaagatccaaaggatttttacacgttagaggaagaaattggaagaggaaaatttggtacagtatacagatgcaaagaaaaatcgaccggattgtgtctagcagcaaaattcatcggttgtcctaaaaaagaaggtaaacaagctgcnnnnnnnnnnnnnnnnnnnnnnnnnccagtgatcgaacccgaaccnnnnnnnnnnnnnnnnnnnnnnnnnntagaggttgannnnnnnnnnnnnnnnnnnnnnnnnnnnnnnnnnnnntaaatggccagaaatgtataagatctgttatatactgaaaatgaatgtacatcagatttctcataagaaaatanaacaagttataccaattatcatncatagaannttgtaanttgtttatttttgntcccacanannttcantatntnnatatattattattannataagntgtactgtaatattgtncagagaanatttaatggtgttttatttgtatgtaaggtttaaagtataaataaaccatttgaatattaacaacaaaaggattaaagtaacatcaagaac

SEQ ID NO: 17149 - DNA, 710 bp, Diabrotica virgifera
  misc_feature (57)..(78): n is a, c, g, or t
ctctagagtctgataggtgattgtcattaaagcattacatcgcccgcctttatgggnnnnnnnnnnnnnnnnnnnnnnacagagagatgtttttccatatgcccaacatatatttttggtgatgatcaatttatggtgacaaagaaggcccataaatatgagaagagaagagtagcaaagtgtcttgattacacatgatgtgaagtctttgtctttgtatttgtgctcatgacaactaaaagttgatgagttttctccaaacttggatacgatttagaataaaattaagatcaatcttgaagatttgcccaagcttgaagttttagaaaatgaacctttatctaagatggtaacagatacagctggaattaatgatgaggtgaatagacaaacgaaagtatagttgactcttttgaaccttataataaggggcttcttgaattatcttttcatgttttggcaaaagacaacagttgggaaggtgactaagacaagccaatacaatatgttagatttctaacattttcaatgtgtatactaataatgttgtggtgatatactatcgcagtaaacagtgactaaatggcataacaataccacaggttcattatgtgtgtcttaggtcctatgttagaatgttgcgagatctatcaatcatctgtggtaagctcaatcctccatgacgcagcggtacttatagttgactcttg

SEQ ID NO: 17150 - DNA, 450 bp, Diabrotica virgifera
  misc_feature (19)..(19): n is a, c, g, or t
  misc_feature (26)..(26): n is a, c, g, or t
ccgccctttaaacgcgagnaaagagnagagagagaaggagaggccccttcaggagcgcaacaagccaggagagaaacaaaacgaatagtaccgctggagtataatctcgaagactcacattttgaaactggaaactcggaagtctctgccacatacactccgcaaggcgcacaccctacgaaaagacgttcacgacacgataacccatagaccacgcaagagtgatgagacgtccgcatccattgctgttaaacatcgccacgctagggtccactaggtcgagagagatatcttcacacctcaaaaatacaaagatattttaccttctacacataacatgaagagaccccaagcctaaagcgcagataaacgatcgacatctatctctgatgagatctacccatcccttatgattgatagagccacactacccgatgaatgtatagttcc

SEQ ID NO: 17151 - DNA, 482 bp, Diabrotica virgifera
  misc_feature (3)..(3): n is a, c, g, or t
agnctagtgagcagtgatcaaccacaaaattcaacatgtgtgacgacgatgttgcggctcttgtcgatgtcacctggatccggaatgtgttctactgttttcaccatataagacatgatacatggaagtgtctgtgacatagaacacccaaagaaacacatcaactaaacagttatacacatcaccttaacctatcccctatagaagtgcaaactcagtctacgatcaattagacttgaacttcacgtaagtaatgacacatgagatagtatgacttaatatgacacattaacaagctcaaaaaagtatacagagtccaacttgctagatgagttcacacaatcctacatcagtaggagaagaattacacgtctttcaatgaacagaagctactaacaacgatcgattagctaaatttacactacaaagatgcaacaatgcgacccatacaaagacattagcaatcccacggagaacaacaa

SEQ ID NO: 17152 - DNA, 129 bp, Diabrotica virgifera
  misc_feature (8)..(120): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacggt

SEQ ID NO: 17153 - DNA, 702 bp, Diabrotica virgifera
  misc_feature (7)..(661): n is a, c, g, or t
  misc_feature (663)..(680): n is a, c, g, or t
  misc_feature (693)..(693): n is a, c, g, or t
  misc_feature (698)..(698): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnngttaaaagcttanatttntttt

SEQ ID NO: 17154 - DNA, 764 bp, Diabrotica virgifera
  misc_feature (752)..(752): n is a, c, g, or t
caaacattcgtaaataaaaaaacactgtcctaaacataaatgtgtttcatttttaaagtgttgtacaaggttcacacaatctatgcaaaattctaaacttgtcagtctttattgtcagaatcaaatgcaaatttttgtgtacaaaaaaaaactataaaatttgatacattaaccttaagcacccacggattttggctgtctgctaagcttcacttgagtagaaacaaataaaacatcaaaactaatcaaattaatcaccaaataactttttgcccaaatccatcagtctgtgatttctgcacaccctaagagcctctgccttcttcaaaacatctaccacgtcttcatttgcatcaactaaattgcacaagaaatcttcatacgctgatttaacatttgctggaagagtaccaattttgacctttttcagaagttgcacaattccttccgcccaaccactttcaatagcaaactctgaaatccaaggaattacagaaattactccagatagggtttgcatgcccaaaaaccacaactccattatctccatccagtgttctttgtatgccatggacaccaccaatgctgtaggatcatttgattcatcaacattataagcatcccacaaaaatctaattgatgcttgaatatatctacaaattgaaaaatcattcttttttactttgtttgagagttgcttgagtaagagtaatcctagcacagatagatttcccatgtagactaagttctcnagtatatctttc

SEQ ID NO: 17155 - DNA, 772 bp, Diabrotica virgifera
  misc_feature (3)..(45): n is a, c, g, or t
  misc_feature (56)..(616): n is a, c, g, or t
  misc_feature (618)..(667): n is a, c, g, or t
  misc_feature (681)..(701): n is a, c, g, or t
  misc_feature (704)..(725): n is a, c, g, or t
  misc_feature (728)..(741): n is a, c, g, or t
cgnnnnnnnnnnnnnnnnnnnnnnnnnnnnnnnnnnnnnnnnnnnggtacctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnngagggttggatgannnnnnnnnnnnnnnnnnnnnttnnnnnnnnnnnnnnnnnnnnnngtnnnnnnnnnnnnnnttttaaagacgagaagacctatagagtttat

SEQ ID NO: 17156 - DNA, 430 bp, Diabrotica virgifera
  misc_feature (2)..(52): n is a, c, g, or t
  misc_feature (54)..(71): n is a, c, g, or t
  misc_feature (119)..(119): n is a, c, g, or t
  misc_feature (121)..(148): n is a, c, g, or t
  misc_feature (261)..(287): n is a, c, g, or t
  misc_feature (300)..(405): n is a, c, g, or t
cnnnnnnnnnnnnnnnnnnnnnnnnnnnnnnnnnnnnnnnnnnnnnnnnnnncnnnnnnnnnnnnnnnnnntttttggatataagaaataattaccttagggataacagcgtaattttnannnnnnnnnnnnnnnnnnnnnnnnnnnngcggacctcgatgttggatttaagttataattggtgtagcagtatataattaagtctggtcgactttaaattttacttgatctgagtttaaacggtgtaagccagggtggttnnnnnnnnnnnnnnnnnnnnnnnnnnngaacgaaaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggggggggcccgggttttaggt

SEQ ID NO: 17157 - DNA, 1148 bp, Diabrotica virgifera
  misc_feature (577)..(597): n is a, c, g, or t
  misc_feature (762)..(762): n is a, c, g, or t
  misc_feature (997)..(1025): n is a, c, g, or t
  misc_feature (1063)..(1133): n is a, c, g, or t
cctcccagcgtccgaaaagatacaatgctttaaactaggtaccctaaaacggacagctaatgtagctatagaagcagaaaatggaataagtatttcgaagaaatacctatatcaaacatggagagagaagaaagagaaacaataatgaacacggaacaaaattatgaagaagaatgtacctaagagaagtgaaagataaaacatgcaaactaaaaaatcggaaacacaccctgtatatggagtaaataatacccgaaaaatgtaatagaattatagtgacaattccaaaacaaggagaccacagaatatgtaaaactaccgaacaattaatttactgaatgtaacatataaagtagatcacttttgtattataaaagtttattccaaacctgtattaatccgtttcctaagtacggtcaagaaccgttcttagctggcattaattattaacaaaaataacatgtttatagagacaataaatctaaaaaccttgctttatattatatagcacttttgttggtgagattacggcgtcgtttgaaaataataaatagatatctataatagggaacttgcnnnnnnnnnnnnnnnnnnnnnaaatgttataaatcacaacagaacataatttaaaacatgtatcaaagataaaaaaagttttgtttggctttcgtttggcccctaaagacgattaaaaattcaaattataccagccagctcaaaacgcgtcgtgacgtcatccgtttatatgtttacattcttccnacaaagtaaacagaattttaaagtagacgttataaacgtcagtagaaaatacagttatgtgacgttacaagtgtttttgatcgtttgaactattcatagaaaacgtgaacttttacaaaatggtttatttttctttagtaaaccttcttttcctttccttccataaactaatttcaaacctcccaaggccaaaattgggaatttatttatttaacaaggacataccgataaaaannnnnnnnnnnnnnnnnnnnnnnnnnnnnccttttatttccccgcgaccgaagggaatacccccaannnnnnnnnnnnnnnnnnnnnnnnnnnnnnnnnnnnnnnnnnnnnnnnnnnnnnnnnnnnnnnnnnnnnnnaaaaacggggaaccc

SEQ ID NO: 17158 - DNA, 901 bp, Diabrotica virgifera
  misc_feature (662)..(678): n is a, c, g, or t
  misc_feature (768)..(768): n is a, c, g, or t
  misc_feature (803)..(803): n is a, c, g, or t
  misc_feature (850)..(851): n is a, c, g, or t
  misc_feature (895)..(895): n is a, c, g, or t
attattggttatgttgttatcttttttaacatatgtttttaactttttaatgtaataattttaataatcgtatatcgtatcattgctgaaaatgttttatataattggcttaggtctaggagatcccaaagatataacagtcaaggggctagaaatagttaaaaaatgtgacagagtgtatttagaagcctatacatcaatattgacttgtggtaaggaagaattggaaaagttctatggaagacccttaattgtggccgacagagacttagttgaattgggagctgatgacatattggcaggtgctgaagaaaaagatgttgctttactagttgtgggggatccctttggtgctacgacccatactgattttattcttcgggcaaaggaaaaaggaatcaaatttcaagtagttcataatgcatctatactaaatgccgtaggttgttgtgggctacaactctacagttttggtgaaacagtttcgattcctttttggacggatcaatggcaacctgatagtttctttgataaaatcgttaacaatgttaagaatagactacatacactttgtttacttgatattaaggtaaaagaaccaactttagagagtttaacgatgaaaaagaaagtatatatgccacccaaattcatgatggttnnnnnnnnnnnnnnnnnacttctgcagataatagataagaggaaagagcagggtgaagatcctggtataagtgaaaaaaatgtatgtgtaggactagctagagttgngtcagaatcacagaaaattgtaacttgtagcttanagatatgtcaactgtagatttaggtggacctttacattccttaattnngtgtagggctattatacatcctgggtgaatggaatatctagtancatttg

SEQ ID NO: 17159 - DNA, 795 bp, Diabrotica virgifera
  misc_feature (6)..(28): n is a, c, g, or t
  misc_feature (219)..(270): n is a, c, g, or t
  misc_feature (272)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(781): n is a, c, g, or t
  misc_feature (783)..(783): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnngnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngntctagatcgcga

SEQ ID NO: 17160 - DNA, 814 bp, Diabrotica virgifera
  misc_feature (2)..(44): n is a, c, g, or t
  misc_feature (55)..(733): n is a, c, g, or t
  misc_feature (737)..(810): n is a, c, g, or t
cnnnnnnnnnnnnnnnnnnnnnnnnnnnnnnnnnnnnnnnnnnnggtacctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcnnnnnnnnnnnnnnnnnnnnnnnnnnnnnnnnnnnnnnnnnnnnnnnnnnnnnnnnnnnnnnnnnnnnnnnnnnttat

SEQ ID NO: 17161 - DNA, 75 bp, Diabrotica virgifera
ccccttacgcgcccgggcgaacaacatgtattacaagtaacatctttaccattagcacgagggatgtagtagttc

SEQ ID NO: 17162 - DNA, 316 bp, Diabrotica virgifera
  misc_feature (174)..(190): n is a, c, g, or t
  misc_feature (192)..(207): n is a, c, g, or t
taacagcgtaattttattggagagatctatcgatataaagattgcgtcctcaatgttatattatcagtattaattgttgttagagcatgtgttgtatattctgatcgtcttagcattcagtatttgtataaagactaggacgaagaattttcatatgttacaggatggtatgannnnnnnnnnnnnnnnngnnnnnnnnnnnnnnnntacaattttaattatattataaaggaacatgatgtgagactagtacaggatgatgatattagcaacaaggagttgtatatataggaaaaatgaatagcttcattaaagg

SEQ ID NO: 17163 - DNA, 764 bp, Diabrotica virgifera
  misc_feature (31)..(74): n is a, c, g, or t
  misc_feature (82)..(194): n is a, c, g, or t
  misc_feature (203)..(753): n is a, c, g, or t
  misc_feature (758)..(758): n is a, c, g, or t
atcttaatcggatagttaattcagtattcgnnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaanaagctt

SEQ ID NO: 17164 - DNA, 168 bp, Diabrotica virgifera
acaacaacagcgcacagagagaaaaagcaagccgcaaagattgctgagatacagatgattacaatgctccccaggactcttcttttctgtaacacgcgtatcatgtgggacatccgaagagaattcattttatgccctcaataggaacaacagagaaagatttaccag

SEQ ID NO: 17165 - DNA, 110 bp, Diabrotica virgifera
  misc_feature (2)..(108): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnga

SEQ ID NO: 17166 - DNA, 839 bp, Diabrotica virgifera
  misc_feature (11)..(57): n is a, c, g, or t
  misc_feature (106)..(128): n is a, c, g, or t
  misc_feature (139)..(165): n is a, c, g, or t
  misc_feature (183)..(217): n is a, c, g, or t
  misc_feature (224)..(253): n is a, c, g, or t
  misc_feature (425)..(453): n is a, c, g, or t
  misc_feature (527)..(546): n is a, c, g, or t
  misc_feature (595)..(647): n is a, c, g, or t
  misc_feature (672)..(691): n is a, c, g, or t
  misc_feature (806)..(833): n is a, c, g, or t
gtttctcttcnnnnnnnnnnnnnnnnnnnnnnnnnnnnnnnnnnnnnnnnnnnnnnnatttacacggatagttaattaagtattcgtgagagaatattttcttttnnnnnnnnnnnnnnnnnnnnnnngtacctcgtgnnnnnnnnnnnnnnnnnnnnnnnnnnncatcatctttctctctcnnnnnnnnnnnnnnnnnnnnnnnnnnnnnnnnnnnctcttcnnnnnnnnnnnnnnnnnnnnnnnnnnnnnntaacgaaacggtactcgtttttcaatatcatctaatttctctcagaaataaattaaatttctttcctcacaatatatttctaattcaatctctttctctctctcatcatattcaatatcttttcgggatcgagctctcaaaataaaattttatctcaaatttcattttctcnnnnnnnnnnnnnnnnnnnnnnnnnnnnncttttaaaatacggtatctaacttaccctcatctatctaactattttctcattttctcatcaaattttttctcnnnnnnnnnnnnnnnnnnnnctttaaatttcgtaatggatgataatattcagattaaaaaatcgtatcnnnnnnnnnnnnnnnnnnnnnnnnnnnnnnnnnnnnnnnnnnnnnnnnnnnnncggttttaaaaacacggcttttcgnnnnnnnnnnnnnnnnnnnncgcccacggataatttggaaggccgcggtatttcgaccggggctaggtagcatatcattaagttttttaatggatggcgggatggaagggttggaggaaaaaaaaacggtcttcnnnnnnnnnnnnnnnnnnnnnnnnnnnnagtaaa

SEQ ID NO: 17167 - DNA, 858 bp, Diabrotica virgifera
  misc_feature (692)..(692): n is a, c, g, or t
  misc_feature (723)..(723): n is a, c, g, or t
  misc_feature (804)..(804): n is a, c, g, or t
gaaactaccccagacggtcgtggtttccccgctctctgcaaaatcacgacgatacgaaaactaccggtgtgagtgcattttccgaatatgttcgctatttttaaaagaatcttcctacaacgctcttccttctttttattaatatatatcacaggaatatgtttatccctcgcaaaggattttaaaacaattatagagatccccaatcaaggaaaacttcgcggggttgagctgtccaaattaagaatacaaaagatcatagcttactatggtattccatacgctcaagctccggtgaataatctgaggtttgcaccacctgtaactgatccgttgccagcttgggatggggttaaaaatgacacggaatatgctccttcctgtttacaaaccgaagaggactataaggaatcagaaaaaccgttcctgcagttgatttctaaattgaactttactttagctgaagactgcttgtacttgaacgtttttataccttatggagacgagcctaaacaaggatttgctacagtaatctggtttcatccaggaaatttcacaacaggcactccagccatgtggaatcctcacacccttgtttatcgccagagagtaattatcgtaacagttagctttagactaaatataatgggcttctttaccactatggatggcgaggcatctggaaattttgngctgcttgaccaacaggccgcgatgatgtgngtgaagaagatattaagctgtttggtgggaatccgataacatttgtatcatgggtttacgtacaggagctatgagcgttgnactgcatttgattaatccccagtcagagggctatttaataaaggcattgccatg

SEQ ID NO: 17168 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(117): n is a, c, g, or t
  misc_feature (139)..(139): n is a, c, g, or t
  misc_feature (176)..(176): n is a, c, g, or t
  misc_feature (180)..(180): n is a, c, g, or t
  misc_feature (204)..(231): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttannattttacatgatctgagtttanaccggtgtgagcccaggttggtttctatctttaattnattnatatattttagtacgaaaggaccnnnnnnnnnnnnnnnnnnnnnnnnnnnngataatatt

SEQ ID NO: 17169 - DNA, 898 bp, Diabrotica virgifera
  misc_feature (517)..(534): n is a, c, g, or t
  misc_feature (649)..(649): n is a, c, g, or t
  misc_feature (670)..(670): n is a, c, g, or t
  misc_feature (698)..(698): n is a, c, g, or t
  misc_feature (735)..(735): n is a, c, g, or t
  misc_feature (773)..(773): n is a, c, g, or t
  misc_feature (815)..(815): n is a, c, g, or t
  misc_feature (828)..(828): n is a, c, g, or t
cgatagtctcatctacaacttgttttcaacactactctgcttgttattacctccttttctaagaagattttctatattatatttctggatcgtcccagtaaccttatttgctgattgaaatgaataagtagtttgggcactctgtcattgttaaaacattctaaattctaagcctattcgctttcacgaattgtattatggatgtgtatggtgcaagaggtctttcacacattctttactgtgaaaatccactctcttttcattaaaaccactaataagcaactaaaaagcacttttctgaatattaccctttaccatatcgttaacagattttcatgattttagagcttgagagtccatgtttttgattttataataggtccaataacggtactacttctactacaaagtttatttttgtccccgcattagatagcccaactattccaatttgtagtattgcaaatcttttaacatttctctgtgtcttcttaattgtttttatcagtctttcttnnnnnnnnnnnnnnnnnncatctctttcttttcgtaatatcaggttttgttccaaagtcttcgtacaaacaaaatcaacatcatcactaaatgataggagctgaatggttctgtttaaactgatatttcttgngttatgtgaaatttttcttgnaactgcttctacacagttttataaacgngatccgcaatatttactttagccccagatcgaagtgnatttcatttagaaagttttatgtacaagaaatgataanaaattacatccagtgtgctctttttccgtcatagtcctttgnttcttcgtatatngtacgtcgtacctttctttcgcgtcatcccaatatctgtgtatctttctgacttaatcgatttgaatgga

SEQ ID NO: 17170 - DNA, 797 bp, Diabrotica virgifera
  misc_feature (8)..(23): n is a, c, g, or t
  misc_feature (25)..(67): n is a, c, g, or t
  misc_feature (77)..(187): n is a, c, g, or t
  misc_feature (196)..(679): n is a, c, g, or t
  misc_feature (689)..(690): n is a, c, g, or t
  misc_feature (706)..(749): n is a, c, g, or t
  misc_feature (759)..(759): n is a, c, g, or t
atttaacnnnnnnnnnnnnnnnncnnnnnnnnnnnnnnnnnnnnnnnnnnnnnnnnnnnnnnnnnnngtacctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggatggnnagggtggatgaaaaannnnnnnnnnnnnnnnnnnnnnnnnnnnnnnnnnnnnnnnnnnngctttaattnttttaaagacgagagaccctatagagtttataaattat

SEQ ID NO: 17171 - DNA, 698 bp, Diabrotica virgifera
  misc_feature (387)..(556): n is a, c, g, or t
  misc_feature (616)..(618): n is a, c, g, or t
  misc_feature (633)..(633): n is a, c, g, or t
  misc_feature (670)..(670): n is a, c, g, or t
gtaaagggtttttacccatatatttttactttggtggttagcatgtagattctaagattgcactgatgatgatcggtcaaccgatcgaaaactagttctgtctttgatgtagccctgtatagggattttaacaaatataccttttataaagggtatatcatttgaatattaattttaattagcctgtgattaatattatatttaatagttatttatgatataaatgttaaaagtataattttaaggcacgcatgtgaaagtttgcagaatgagcgaagcgaattctgcaattcacatgagtaccttaaaattgtactttttaacacgtgtactttgtacgcacgtaagaagttatacttctattatatgatttcaacgaaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctttgctttgacagctttacagatttctcatacatactgacaaatttaatagaccannngtgagtataaatagnttaaaatttattttcatataatattaaaatctcttgncaacactgtcctttcatagagtctgtac

SEQ ID NO: 17172 - DNA, 854 bp, Diabrotica virgifera
  misc_feature (739)..(739): n is a, c, g, or t
  misc_feature (762)..(762): n is a, c, g, or t
gcttgttgatcgaggggaacgctctgaagataggtcagacggcagacctcctgtggatggtgctaggctagaggcgctgaatgacctgatcgctaacctatcgagtgggtctgataaatctaacgagagtcctaacaatgttgcaccagcatggcagtaccaacgtgaagaatcaattcagtcttggcgatcacagacaggcaccgagctggactcgagtccttctcacaattcttctccgagacctcaaaccccagcgtttcctgtgcacgccaggactccgtacataaatgcttctactccaactgtacaattcgacataccttccgaacgattacctccaaaaagtcctacaacccagagaaaggaccgaccgacttctccctccgacttgaccaacggttcatcagaatacactcacacaataactaaccgcagcatttcggcaacgccaacatcaggtttcagagataccaccgatatctatcagcatagtccaaaaagtccaagctacaatgggctcttcgtcccccaccgtttactacggaacatccagaagaagctccatcaactcgaacaacgaatcgccacatgaggtttcagcagctaatgtaaaatttgttagagatacttccaagttttggtataagccttctattaccagagaacaggctatcattatgctccgtgagcaacaaccaggaacttttgtagtaagagactcgaactccttcccagnagcttttggattggcttacgagnttgcacagtgccatcgaacgtgcaaaacagagtggctccagtgacgatttaatcgccactttcttatttgacccacagcagaggagtcgact

SEQ ID NO: 17173 - DNA, 727 bp, Diabrotica virgifera
  misc_feature (2)..(44): n is a, c, g, or t
  misc_feature (52)..(160): n is a, c, g, or t
  misc_feature (173)..(226): n is a, c, g, or t
  misc_feature (228)..(350): n is a, c, g, or t
  misc_feature (352)..(369): n is a, c, g, or t
  misc_feature (371)..(405): n is a, c, g, or t
  misc_feature (418)..(701): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnncnnnnnnnnnnnnnnnnnnnnnnnnnnnnnnnnnnnataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttaattcactaagaattttattt

SEQ ID NO: 17174 - DNA, 897 bp, Diabrotica virgifera
  misc_feature (184)..(206): n is a, c, g, or t
  misc_feature (747)..(747): n is a, c, g, or t
  misc_feature (813)..(813): n is a, c, g, or t
  misc_feature (820)..(820): n is a, c, g, or t
ggagaaacaattttggagtgttacagttgtggagttcgtaacgtttttgttttgggtttcataccagctaaggcagattctgtagttgttctactgtgcaggcaaccttgtgctgcgcaaaactcgcttaaggatatgaattgggatcaagaacaatggaaacctttgattgctgaccgttgcnnnnnnnnnnnnnnnnnnnnnnnaccttcggaacaagaacaattgcgtgctagacaaatttccgcacaacagatcaataaattagaagaattatggaaggaaaatgtcgatgccactttccaagatctagaaaaacccggtgtagatgaggagccacaacaggtacttctccgttatgaagacggttaccaataccaaaacatctttggtccattagtaaagctagaagccgactacgataagcgcctcaaggaatcccaaactcaagaaaacatcgaagttcgttgggacgtaggcttgaataagaaaactatcgcctatttcaccctcgccaaaaccgatggagatatgaagttgatgcacggagatgaattgagattgagatacgttggagaaatgcacaagacatgggcgggagtcggacatgtcattaaagtacccgataattacggcgaagatataggaattgagttgaaaaacggttctggggctcctgtggattgcggaagtaactttgtagttgatttcatttggaagagtaccagttttgatagaatgcagttnggccttcgtaagttcgccgtcgatgatgcttcagtttccgcttacatataccacccgactgtaggncacgagntggaagaagttttatttagatgtcatctccctaaacacttttcggcccccacttacccgatttgaacccgatctcag

SEQ ID NO: 17175 - DNA, 779 bp, Diabrotica virgifera
  misc_feature (719)..(719): n is a, c, g, or t
  misc_feature (749)..(749): n is a, c, g, or t
  misc_feature (764)..(764): n is a, c, g, or t
gaagcacttcgtgctgggtgatttgggattctccgctttctgggcattcctctatttcgttggattttggtacctcgctagccagtggggaaaatccgaaccacctccaaacggtgttggtgtaaacaacgttcaggctgccatagctttttcatttttttccatatttgcatgggctggttctgcatttttcgcgtatcaacgtttccgtcagggtgctggagcagcttttgctaccaattacgagaacgaagcgggaatgcccgcgtcgtatccctcttaccctggaggacccgaaacggatactccctatcaagaaccacctttctcggctgggcctaaccaaagaggtcaaacagatttccaagctccaacttactaagaaagagtcggcggacattttatttttccaaagagtcgacgactaccttagtggagaaaaccaggtttcgatgattttacctataaacggttacagtcattattgtacttaggaatattcaaacaaacaagtattattacacctcaaatattatggtttcttgtacaaaataattgacgatcgtgtaaaattgacttaggagttagcaattgaagggactgttgtactaaatttctggttccaaaaagtaattcaatgaagtgaaaaaatagtatgtcagagtgtaacattttacattcattcaagcgtgtacaaaatttatcagtctttcaacaanaagtagttgtcttcagtaattcgatattanacattaacgagaaancatataaaacaattg

SEQ ID NO: 17176 - DNA, 496 bp, Diabrotica virgifera
  misc_feature (210)..(227): n is a, c, g, or t
gaagaaatttagatatttttacttctgagtgatgcaaaaaaaccactaaaaaactcgacagcgttacttcgagaaactcataagctaatgaaatctttttgatttttttgtttcgcacgatttaatgacgaattctgatgccatacatatcatacgacctatttagatgggaaataccagtgaaaattttgaagttattaaccgatttcnnnnnnnnnnnnnnnnnncgagtagtaaaatatgcaaatttcgggacaagatttaaaagatttattatttatagatatgaccaaaatttcgtatttatatttacatatccgaccccttgtatagatttactctgaatgtatcattcatgttaatcttactctcaaattacttttttccagtaaaatgttggataaaagagcgacattacattgatgactacgcaaggctaattattatatacggcgaacaaatgaattatcacgttggaacatcaaaattcttcatt

SEQ ID NO: 17177 - DNA, 747 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (632)..(681): n is a, c, g, or t
  misc_feature (686)..(745): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnaa

SEQ ID NO: 17178 - DNA, 698 bp, Diabrotica virgifera
  misc_feature (13)..(33): n is a, c, g, or t
  misc_feature (43)..(90): n is a, c, g, or t
  misc_feature (120)..(149): n is a, c, g, or t
  misc_feature (151)..(337): n is a, c, g, or t
  misc_feature (345)..(501): n is a, c, g, or t
  misc_feature (524)..(582): n is a, c, g, or t
  misc_feature (592)..(610): n is a, c, g, or t
  misc_feature (650)..(688): n is a, c, g, or t
ctattagcaaagnnnnnnnnnnnnnnnnnnnnnataatgaggnnnnnnnnnnnnnnnnnnnnnnnnnnnnnnnnnnnnnnnnnnnnnnnnccctgtggatcagctattgattaattaagnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatattagtattatcaaattgcnnnnnnnnnnnnnnnnnnnnnnnnnnnnnnnnnnnnnnnnnnnnnnnnnnnnnnnnnnnctatgactgnnnnnnnnnnnnnnnnnnnatatataggctcgcctgcccactgatcaatttgaatgatnnnnnnnnnnnnnnnnnnnnnnnnnnnnnnnnnnnnnnnattttttatt

SEQ ID NO: 17179 - DNA, 842 bp, Diabrotica virgifera
  misc_feature (528)..(528): n is a, c, g, or t
  misc_feature (543)..(543): n is a, c, g, or t
gggaaaccttcgaagacgacgaagaaagtgaagagaaaccaaagaaagactgggtgaaatttgaggatgagccaaagaatagtaaaaacctcaaattagagctgtcctttgctgagactgcaaagagggaacctactagtagtttaactggattaccaaagccactgttttcagatttaccggtaaataataataatacttactcttacgatattatggagaatgatttgcgttcagctgagcctgtagtatttatgccaacgaccatcgagaaaccaagaaggcttgctgataagctagaagttttaaagcaactgacgttttataaatcgcttttgacagtgttgactacgaaattttctatgttcatattttatactttatttccattgtatgtttaccaagaagtggaacgtttaactttaagagaaatgtcagtgatggttggactgctttcgattagtggtttactgttcactggagtctcccattggatcaatatcgacaaaaagagacgaccgatatgtnttctgggtgttatgnttgggttggagcctttggatatttcatgcttgcagattcgaattccaagcaagtcttaatattcggagcgataggggtaatcctcagcatagctacattacagtatgtcggaatgcctattttaggtttgacattaagaggagaaacaagtaaagaattctctatcattagtacattaagcggctgtgcattattgttatttttagtatttgatatgacgtttagaacgtgcttcaaattaatggcattacttcatttctttcacagcgctgtctggttcgccaattacatatataaaa

SEQ ID NO: 17180 - DNA, 235 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(191): n is a, c, g, or t
  misc_feature (205)..(231): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaacggtgtgaggccagtttggttnnnnnnnnnnnnnnnnnnnnnnnnnnnnngaccaaaagacccnnnnnnnnnnnnnnnnnnnnnnnnnnnagat

SEQ ID NO: 17181 - DNA, 726 bp, Diabrotica virgifera
  misc_feature (2)..(657): n is a, c, g, or t
  misc_feature (668)..(668): n is a, c, g, or t
  misc_feature (675)..(725): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaatggangggttgnnnnnnnnnnnnnnnnnnnnnnnnnnnnnnnnnnnnnnnnnnnnnnnnnnng

SEQ ID NO: 17182 - DNA, 691 bp, Diabrotica virgifera
  misc_feature (8)..(661): n is a, c, g, or t
  misc_feature (673)..(674): n is a, c, g, or t
  misc_feature (685)..(685): n is a, c, g, or t
  misc_feature (687)..(687): n is a, c, g, or t
  misc_feature (689)..(689): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataagaattnntatttttaagntnanaa

SEQ ID NO: 17183 - DNA, 56 bp, Diabrotica virgifera
  misc_feature (7)..(7): n is a, c, g, or t
  misc_feature (15)..(15): n is a, c, g, or t
  misc_feature (29)..(29): n is a, c, g, or t
agaattntatttttnaagtaaaagcttanatttttttaaagacgagagaccctata

SEQ ID NO: 17184 - DNA, 739 bp, Diabrotica virgifera
  misc_feature (172)..(190): n is a, c, g, or t
  misc_feature (276)..(297): n is a, c, g, or t
ttaagtctgtgcctaaaccaataagccactgcaacgtcttcctcacttgagctcataattttaactgaaatgaattgtcgactctcgtttagacgtacggattcgaacttttttttgaatcgataaaaatgtcgaaatgctcatcgcactcgtatttttggactaaacttgnnnnnnnnnnnnnnnnnnngacttgaatattgaatatatttattacaaaattagcaaatttactagaagcagcaaaatatatggaaacgaaaaattgcagatccnnnnnnnnnnnnnnnnnnnnnncttaaataatttgcatgtatgtgaaacttaatatacttgcgtctgttatactacaccatccaataataccacttctaacagcgtatttaatatattttactcagctcagcacgtctacaataatattataacaaaatcgcatatgcagagtaagttaaaaataagaaaacgcctaacactaaagataaatcattcacaattcacacacacgtcttaataataatgacccatttttaagatgaaaacaaaataattcgtttacaaatatcttagaactcttctgtgaagaagactctttttttttgacgaagattgtccaagaaggtacccgggcaccccttcattttctggagataaaaatttttttgagaactccttcaaccaccggtccatatttttatttatgaaaagggagaaaaaacgggattgggaaattttggga

SEQ ID NO: 17185 - DNA, 771 bp, Diabrotica virgifera
  misc_feature (2)..(59): n is a, c, g, or t
  misc_feature (108)..(130): n is a, c, g, or t
  misc_feature (138)..(165): n is a, c, g, or t
  misc_feature (179)..(216): n is a, c, g, or t
  misc_feature (219)..(251): n is a, c, g, or t
  misc_feature (260)..(718): n is a, c, g, or t
  misc_feature (727)..(727): n is a, c, g, or t
  misc_feature (762)..(763): n is a, c, g, or t
annnnnnnnnnnnnnnnnnnnnnnnnnnnnnnnnnnnnnnnnnnnnnnnnnnnnnnnnnatttaatcggatagttaattaagtattcgtgagagaatattttcttttnnnnnnnnnnnnnnnnnnnnnnngtacctcnnnnnnnnnnnnnnnnnnnnnnnnnnnncatatatttcttcnnnnnnnnnnnnnnnnnnnnnnnnnnnnnnnnnnnnnntcnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcattnagtttttttattgggaagctggatggagggggtgnnatgaaaaa

SEQ ID NO: 17186 - DNA, 883 bp, Diabrotica virgifera
  misc_feature (787)..(788): n is a, c, g, or t
  misc_feature (802)..(802): n is a, c, g, or t
attggtttcagtcggcacagcgcacggacttgcgcttttggattacatcaaaaacaaacctattctggtcaaatgtactcttaatcctaatgatctcacaggagcgggcgacaccccaatatcccgacgaaagtccttcaaaaagtccttaagagagtcgttcagacgtttaaggaaaggtcggtcccagcgtcggaacactaacaaagacgacaaaaaatcagctacttccccgccaactaagagaaccttacctgccgctactgatgagaatgtaaatcctttggaggccaaaccagttgaacgacaaatcgaggcgagaccagccgatgattccatgggatctttcgtaaggtgtttgtacttcgctagaacatttttagtcagtgtgcaaaacacaaaccccactctttgggcagctacaaataatggaactgtctacgccttcaccataacagttccgtcgtcttcgaaacgagacacagatgacgtctcgtgcatgttagcgaaagaaattcagttaaaacacagggctccagtgataggcatagccgtattggatggatctagtaaacctcttcccgaacctctagaagtagaaaaaggagtggcaccactgccggatacgactcaggcacatcgagttgttatcgcatccgaagaacaattcaaaatcttcactcttcccagtctgaagcctttctgtaatacaaattgacggcacatgaaggggcgcgagtgaggagaatggctttcgccaacttcagctgccaagtggacgaagtannacattccgaagtgnacttactctgcttaaacaatatgggcgattgtctagtactaagcattccagatctcaagaggcagctaaacgcagcagcta

SEQ ID NO: 17187 - DNA, 830 bp, Diabrotica virgifera
  misc_feature (13)..(685): n is a, c, g, or t
  misc_feature (691)..(775): n is a, c, g, or t
  misc_feature (806)..(807): n is a, c, g, or t
taatgaaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatnnnnnnnnnnnnnnnnnnnnnnnnnnnnnnnnnnnnnnnnnnnnnnnnnnnnnnnnnnnnnnnnnnnnnnnnnnnnnnnnnnnnnaccttttaggatacagcgtaattttattggnnagagtcaaatcgataataaagat

SEQ ID NO: 17188 - DNA, 806 bp, Diabrotica virgifera
ggttatgttacattgtttataaataaatttgaagtgggtataattatcttatatttgtttattactttttaacattgtcggacttcattagttttgttcttaaaaaaatctcacgagaatatggactatcaaggagacagggacgatagtcccgaaccatcgccttcaaaaagtcgtagaaaaggctcctatgagtttggaacaggagacagttccgaatcgtgccaaaaaatggtagacaactctgagaacgtacttaaagttttgaagagactctatttcgaaaaagaaatgtgcgatgtctattttgtcgtgggccataaggagtatggtgctcacagaatcattttatgtgcctccagtgatgtttttcacgtaatgcttatgcgtccagagtggtcagaatgccacgaaagtagaatcgaacttcaagaaatgtctgtatgtgaaccagtcttcccaatgtttttagagtatttttatacaggaaaaattatgattacacatactaatgtcatgcctattctggctttggcagataaatacatggtaaagagcttatcacgaatatgcatttcttatatgtgtaaacatgtccctcatgcagtataccacaaccagttgttctcttggtggcagtatgcaacagcttgtgcgcataatgtagtgtttgaaacgtgccaaaattacatcaagaggaactttgagattgttgccaacactccagacttttgtaactttgatatcaatatgttctctcacattctggaacaaaatgatatagtcgctcataatgaaattgtttt

SEQ ID NO: 17189 - DNA, 671 bp, Diabrotica virgifera
accgtctgttttatatttatttggcggaagcttgtgcttttgtatgacattgaaaattccatgacagtattctgttgatatagattaagtatattggttgtactagaagcagtatctacgggaatggtttggcaataatttagcgttagtaccaaactgcacaagtacccttttcggtaaaaatacgtggtaaaagacttttccaacgattttattccctcctaaaagtaatgaaagtgttccttgttggttttagactgtgttggtcaatgttcttcttcttaaaatgctgtcttcttccgaaggttggcaatcatcatgattatctgaactctatttactactgccctaaaaagctggttcttattcttcttcttttcgtatagatatgactctgtctgtttttttaatgtgcattcataaagtcttactattggggaaccgtctctcgccgtccttactactctatttgttatcatttggcttatgtggacattctattccttttgtttcttacccatttatcactgttctccactttgcatctcagtcgtatatctgtacttctagctctgtcccatagtgtcttaccatctatttgtcgaagggttctcatctccgatgtttcgagctatctttttgccacctctgtgtgagggcgtattgctgac

SEQ ID NO: 17190 - DNA, 769 bp, Diabrotica virgifera
  misc_feature (7)..(617): n is a, c, g, or t
  misc_feature (623)..(664): n is a, c, g, or t
  misc_feature (667)..(684): n is a, c, g, or t
  misc_feature (695)..(767): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgnnnnnnnnnnnnnnnnnnnnnnnnnnnnnnnnnnnnnnnnnnatnnnnnnnnnnnnnnnnnncaaaagcctcnnnnnnnnnnnnnnnnnnnnnnnnnnnnnnnnnnnnnnnnnnnnnnnnnnnnnnnnnnnnnnnnnnnnnnnnntt

SEQ ID NO: 17191 - DNA, 704 bp, Diabrotica virgifera
  misc_feature (2)..(58): n is a, c, g, or t
  misc_feature (84)..(132): n is a, c, g, or t
  misc_feature (146)..(177): n is a, c, g, or t
  misc_feature (180)..(210): n is a, c, g, or t
  misc_feature (297)..(314): n is a, c, g, or t
cnnnnnnnnnnnnnnnnnnnnnnnnnnnnnnnnnnnnnnnnnnnnnnnnnnnnnnnnnccaatgatagttaacttagtattgannnnnnnnnnnnnnnnnnnnnnnnnnnnnnnnnnnnnnnnnnnnnnnnncgtggatccgtgcnnnnnnnnnnnnnnnnnnnnnnnnnnnnnnnnccnnnnnnnnnnnnnnnnnnnnnnnnnnnnnnnctattgtaacataaacattataaatagtttttttgtaatgcgatgtgattcgtttttatatctatctaactacttaagaaacaaagnnnnnnnnnnnnnnnnnncaataattataattacatcaccctatcttatcaatattaaatatatgtaggtataagcttaaatatcctaatttattctccttgaatcttctaatactcatcagagccacatcttcccatcgtggcacaggtgatgacctagttttatatgttagtatatctattttttatacactgtctaaaagtacactccctcaatctattgcagatcgtattgagccaaatatatacaagtacaaaatgtaccatgtcctcttagaaatacagttgaaatctgaagacctgtaccagactttccaacggattgttgaaaacgtgcaccgtcatgattgccacctaccacgcctgattcccgcccaatgaagtgaagtgacagctgacccccacaac

SEQ ID NO: 17192 - DNA, 646 bp, Diabrotica virgifera
  misc_feature (490)..(490): n is a, c, g, or t
  misc_feature (529)..(529): n is a, c, g, or t
  misc_feature (553)..(553): n is a, c, g, or t
  misc_feature (606)..(606): n is a, c, g, or t
aaataaatcaacgataaatagcctccaaatcttaatatttaattttgtaatatatgtctcacaagagatattttacaatgttgttttgaatataaagtttacaaaatctctttatttataggtataaaatttaatacctctagcacataataggaaacaacaaacattctgtccctctgggtaaatagttttattgggatggtcaatttcactttggttatgaaattctaaagggtactacgtgtctttgaaattgccaaaataatctttgagaaaaccttacaaagagaaccgaagtttattactgcttaatttgtgataaaaccggaagtataattattatactacctattatgtgttactatatctttttatatcagaatatttttttaatacgtgccaacacaaggctagtttgtaataaatcaatgtattttttcttttctcatgaattattttacattcttgtgacgaaaaaataggatcttanatttatcgggatagttacgtagatttttgtttatattanattctgaagatctgtctttattanatttatgcatcccatctacgtttttttctacgtcttttaaacattggtttccnaacacagccaacacattaacacatcttcattggtactcat

SEQ ID NO: 17193 - DNA, 832 bp, Diabrotica virgifera
  misc_feature (278)..(297): n is a, c, g, or t
  misc_feature (524)..(558): n is a, c, g, or t
  misc_feature (713)..(713): n is a, c, g, or t
  misc_feature (765)..(765): n is a, c, g, or t
  misc_feature (779)..(779): n is a, c, g, or t
cttggtgcgaggagtaggttgtttgggatgggccggaacgttagggcaatttaaatgctagaaatctattatttacatcttgtgttacctaaaaaacttctattatttagtatatagatcctactttgacaggagttgacagttgacagcttgttggacagttgacagcttgacgtgagctgtcaatctgtctttctatctattaaaatacatatatcttccaaatgagatgctatatgatttcagcttctgaatttaagttgccctaataattgccnnnnnnnnnnnnnnnnnnnngtctattttaatggtaaaactaccattgtgtcctgttaccgtactatataatttgactgggtctttcgcgggtgttttactgttgtgataccgtttcctttacactccaaacatcacctgttccaagcttgcatcaatgttaaatctaaaaatgtatgccataacctaaaaagacccgtctatgtgtattgtattgtttgtttataaactgtacgtcgtacagtctnnnnnnnnnnnnnnnnnnnnnnnnnnnnnnnnnnngaaatataacatgttattgatatgtaatttttacgtgttttaaaggaatttaaagtttattttttcaaaggaccaattctaagtcagttttgtttatatgtatatttttgttggaattgttactaaaagagttttatattttctgcaaagtttanataagccaatcgttaggtctagctttttgaaacattttcggaagaaatttanaattggatttaggncagtcagttccagatgtgggttcacgttaaatactctgtaatatagataggac

SEQ ID NO: 17194 - DNA, 443 bp, Diabrotica virgifera
  misc_feature (105)..(127): n is a, c, g, or t
  misc_feature (329)..(329): n is a, c, g, or t
  misc_feature (333)..(353): n is a, c, g, or t
  misc_feature (406)..(406): n is a, c, g, or t
taaattttagacgtcaaaatgacagtgatgacagataatttttgcaagatggccggctttgatttttaatcgatagttattaatattgaataattactaaatcgnnnnnnnnnnnnnnnnnnnnnnntacaaccgtgttaaaaatgcaatttttagcactccataggagcgttaaaaatgctactttaaagcactagtgctttaaaatttttaaggcactgcagttaaaagtgaattgtcaaattgtgaaacgtcaaaatatttatatttcatttattaacattaatattattagtacaacttgcccaattggaaaaaggtggtttaanaggnnnnnnnnnnnnnnnnnnnnnctgtattattgcatttttaacacgtttgtagaaaaaacagtttatgtaatggntatatatttttgctaagaattttagacattcccctca

SEQ ID NO: 17195 - DNA, 597 bp, Diabrotica virgifera
atttattttaaaataagatgatatttgtactcagaaggaacaggaattcattatgcgttagaagaactataacagggtgagaatattatatgtttacataagatgaatccattatttgatccctgagtatctgatataattaattaacatgtatacctttataatgttcgaattttaaaaaaatctatgaatcgccttttaattgtgaaatagatatttgatacatgttccttctattgaaatgttatgcgaatgatatatatatctatttttacattagatcagatcttatgatctactaacctcatctctatagatgactatttgtatcttgttaatattaactattattagatatgtactcttaaatacccttgtactaactatagaatttgaaatactactaatgatgattgattttcatatactaaaagaccatattattaatactcatctcttatcacttttatgtttgatgactgatctactaatatatgatatttacattatatcaaatttacttacgatgcacatatcaccattatgcaactgaatatctaagacttatacatctgctgaatattcctgatcatctac

SEQ ID NO: 17196 - DNA, 864 bp, Diabrotica virgifera
  misc_feature (698)..(698): n is a, c, g, or t
  misc_feature (761)..(761): n is a, c, g, or t
  misc_feature (764)..(764): n is a, c, g, or t
  misc_feature (772)..(773): n is a, c, g, or t
  misc_feature (822)..(822): n is a, c, g, or t
  misc_feature (845)..(845): n is a, c, g, or t
ctccaagtactaaagttacaaagtgatggtaggtcatttgtaaacataaacaatactaatttgacatttacactaataaaatgtagcattacatttttgcttaatacaatactccaaaaaataagcataactaataaaaatgggaatacaggaaaaccaacataggtatattttatatcctgaagaaattgaagatgatgaggcagtccctatccaagtagatcatccaacagatttaggagaaaaccaaaggacttggagccaaaatgaaacattggctctcattaatattttctctttgcacaaagacaaatttaaacactttaaaatgaaaaaagaccgctggaaactgatatccaaagaacttgctaaaattggaatagataagttaccgataaaatgtgaaatcaaatggagaaatctcctaagatcatatcggtcttacaaagccacggatagagcccaaggaaaatttgaattttataacgaaatcgatgatatagtgtcaaacgatccacagtttaggaatatgttcgacaatttccaaacgccggaaaaaggtttatcaaaacagttagaatctaggcacgcgttacagcatgacataaacgcctcggaactatcatcaaaaaagagaaaatgtgcaacttgtaaaagtgagaaacagaagcgacatgaagatcgaatggcattattanaaaagaaactgggaattgaagagcggaaagtaacggcttttgaggattatgtacgatttttanaangtaatggnntcaatgtagtagcaatctcaaatgtttaaagtgtaattatgtgtcattnatttataagagtaatgtagattnataaaaaatctgaattttt

SEQ ID NO: 17197 - DNA, 668 bp, Diabrotica virgifera
  misc_feature (2)..(613): n is a, c, g, or t
  misc_feature (622)..(648): n is a, c, g, or t
  misc_feature (651)..(651): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgagggnnnnnnnnnnnnnnnnnnnnnnnnnnnttncataagaattttatttt

SEQ ID NO: 17198 - DNA, 116 bp, Diabrotica virgifera
  misc_feature (2)..(56): n is a, c, g, or t
  misc_feature (66)..(85): n is a, c, g, or t
  misc_feature (92)..(92): n is a, c, g, or t
cnnnnnnnnnnnnnnnnnnnnnnnnnnnnnnnnnnnnnnnnnnnnnnnnnnnnnnngctcaattcnnnnnnnnnnnnnnnnnnnntatagangttataaattatcaataagttttt

SEQ ID NO: 17199 - DNA, 259 bp, Diabrotica virgifera
  misc_feature (7)..(30): n is a, c, g, or t
  misc_feature (40)..(40): n is a, c, g, or t
  misc_feature (67)..(67): n is a, c, g, or t
  misc_feature (81)..(99): n is a, c, g, or t
  misc_feature (102)..(103): n is a, c, g, or t
  misc_feature (119)..(120): n is a, c, g, or t
  misc_feature (140)..(140): n is a, c, g, or t
  misc_feature (142)..(142): n is a, c, g, or t
  misc_feature (147)..(147): n is a, c, g, or t
  misc_feature (154)..(155): n is a, c, g, or t
  misc_feature (164)..(164): n is a, c, g, or t
  misc_feature (175)..(175): n is a, c, g, or t
  misc_feature (179)..(180): n is a, c, g, or t
  misc_feature (183)..(183): n is a, c, g, or t
  misc_feature (190)..(191): n is a, c, g, or t
  misc_feature (203)..(204): n is a, c, g, or t
  misc_feature (206)..(232): n is a, c, g, or t
taacagnnnnnnnnnnnnnnnnnnnnnnnntcgataatanagattggcgacctcgatggtggattanagtttataattggnnnnnnnnnnnnnnnnnnnaanngtctgtcgacttttannattttacatgatctgagttnanaccgntgtgagnncaggttggnttctatctttnattnnatnatatatnntagtacgaaggnnannnnnnnnnnnnnnnnnnnnnnnnnnnagataatatttcccccattaacaggga

SEQ ID NO: 17200 - DNA, 809 bp, Diabrotica virgifera
  misc_feature (669)..(689): n is a, c, g, or t
agactgaaatgacatcagagaaatttaggactcaaaattttatcgctatcatagatcacctcattacctctttaagtcagaggctttctgcatataaatgcattctttccaattttggatttttacatatttagatatattttggtcatgcatatatgtacaatattttgcccatgttatgtggcacccagagagatataatatacgtcatttaataatacaaggcaaggtagacggaagaagaggggcaggtcaaagaagaacgtcatgggcttaaaaacctgagagaatggtttaacagatcctctacatcccttttccgagctgccgtgaacaaaattactatagccaatttgatagccaatggctcgataatcaagcacggaacatgaagaagaaatcatttagcttcagagctatcaaagcttcggtactgacatatgtagcaatgatttagatgaaattctaggtgtagaactaatacaatttgtagaatttttcaaagaggatatctgctcattaaatataagcaaagaactttaaatggtaccgattggctagaagaaaagaatggtgaatggatgcgtttccaaatgttgaggtgatgcttcgtttatatttctgataccaactaactgtagtagggagagtttatagggctttctcggnnnnnnnnnnnnnnnnnnnnnggagcttgggacgggcgacaaataaacccgtgtatattaatattatacacggattatacaacatacatgacgggagctcgaaacaaataactgtgaatgaaaagccctactctcaaatct

SEQ ID NO: 17201 - DNA, 76 bp, Diabrotica virgifera
  misc_feature (2)..(28): n is a, c, g, or t
  misc_feature (32)..(75): n is a, c, g, or t
gnnnnnnnnnnnnnnnnnnnnnnnnnnnttcnnnnnnnnnnnnnnnnnnnnnnnnnnnnnnnnnnnnnnnnnnnnc

SEQ ID NO: 17202 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17203 - DNA, 922 bp, Diabrotica virgifera
  misc_feature (506)..(526): n is a, c, g, or t
  misc_feature (542)..(556): n is a, c, g, or t
  misc_feature (740)..(740): n is a, c, g, or t
  misc_feature (779)..(779): n is a, c, g, or t
  misc_feature (789)..(789): n is a, c, g, or t
  misc_feature (798)..(798): n is a, c, g, or t
  misc_feature (800)..(800): n is a, c, g, or t
  misc_feature (802)..(803): n is a, c, g, or t
  misc_feature (807)..(808): n is a, c, g, or t
  misc_feature (844)..(845): n is a, c, g, or t
  misc_feature (874)..(874): n is a, c, g, or t
  misc_feature (903)..(903): n is a, c, g, or t
gaggtcagttagtgaagtattcatacaaaataacaataggcacacaaagagttaatagtcctgttaaattgttaagagtgcctattagggttcttcctctttgtgaaactttgttaaatgaggctgtggctctttgtaatgatactacagaggaattaacacctgccaatccatttttggaaatcagaaaaaaagaaagtccactagaaattgcacttcaaagtctacagaacattacggccagaagaaatccaaattcctacatgatcaccaacacatggggcagaggagctagattctgtctcttcaagccaaactataagctaggagaggacataataggaacttttgactttactgtagctacagttagttgtatacaagtttccgtgtcattacagtgtgaggaaaaaacgattattgaaggtgctgctgaggataattcaaagcagacgaggattattacgtttggaaactttcatgaagtttgcctaggatatgattannnnnnnnnnnnnnnnnnnnnacctttgtatgtaacnnnnnnnnnnnnnnngaaactagtgagtttaacttggagattacattttgagttcgtgactagcaccaacaagggtctatccccaccaagtctagaggacactgactggagggcaccttcagaggtaactgtggaaactatgggtctggagtttgcccataaaactatactcaactacacctacacatgggtgctcagnggtgtcttttaggaataatgttcataaattagttattanggtgaataantaattagtntnannaatnngtacaaatatgctatatttatcatcattcatgatanncttaactcacatatggtattatgatctanatcttacttgtacatatggtattatgaantaaaggtattgttttactt

SEQ ID NO: 17204 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17205 - DNA, 676 bp, Diabrotica virgifera
  misc_feature (20)..(59): n is a, c, g, or t
  misc_feature (78)..(110): n is a, c, g, or t
  misc_feature (113)..(181): n is a, c, g, or t
  misc_feature (193)..(299): n is a, c, g, or t
  misc_feature (301)..(350): n is a, c, g, or t
  misc_feature (354)..(461): n is a, c, g, or t
  misc_feature (479)..(523): n is a, c, g, or t
  misc_feature (525)..(544): n is a, c, g, or t
  misc_feature (627)..(644): n is a, c, g, or t
gatagtaaattagaatgggnnnnnnnnnnnnnnnnnnnnnnnnnnnnnnnnnnnnnnnnggaacctggggaatcaggnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnngaaaggtaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnngatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaggataatattannnnnnnnnnnnnnnnnnnnnnnnnnnnnnnnnnnnnnnnnnnnngnnnnnnnnnnnnnnnnnnnnccacctgttaattaaaaacatggcctttttgaattaaatataaagcctcgccggcccactgataaattggaagggccgcggannnnnnnnnnnnnnnnnnaagcataaccatttggttttttaatggaaagc

SEQ ID NO: 17206 - DNA, 115 bp, Diabrotica virgifera
  misc_feature (2)..(112): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 17207 - DNA, 802 bp, Diabrotica virgifera
  misc_feature (230)..(248): n is a, c, g, or t
  misc_feature (570)..(589): n is a, c, g, or t
  misc_feature (675)..(676): n is a, c, g, or t
  misc_feature (718)..(718): n is a, c, g, or t
  misc_feature (748)..(748): n is a, c, g, or t
catgtactcgacgatatggccaatgcgatgaataagttagtgatattggacgaacaatggccgaatatactacacaactttgttcaaaataccttactggattactcacagttagatttatatatgaagcaaaaaatgcaagaattgagtaagtgatacacactgccatgtatttcggggaaactagttagctgatgaattttgtaatttagaacatagtcttacgatcnnnnnnnnnnnnnnnnnnngttaaaaatattcaacatagtacatcattttattacattgctaaaaactaaaatttgattctgctaaaaatacttaataatactcaatactaatcaaattttgactggtatcactcataggactgttttgtctttttttcgagcagagatctgtatgtttccttgaagtgaacactgatatcttttttaaaatctaagattttcagaagataataggttagtacactttgctatgttgctagtttcgattagttttaagatgttttcattcatgatggtctggtaagaccgaaaacgttctggaattgttaatcctttggtnnnnnnnnnnnnnnnnnnnngtatataccatttatatatttacatcatctacattattattattattacattacgtattatattaccaatactcgtatttgtgtgnngaaataaagtcagaattgacaacaatgacgtgtatgtcgttngtgaatttacgtttttacttgctctcttgntgcaacaaagtcagattgacagttgtgcgtgatacattagtatgcaatgataaa

SEQ ID NO: 17208 - DNA, 1122 bp, Diabrotica virgifera
  misc_feature (923)..(946): n is a, c, g, or t
  misc_feature (948)..(962): n is a, c, g, or t
  misc_feature (984)..(1006): n is a, c, g, or t
  misc_feature (1063)..(1108): n is a, c, g, or t
gtaaaaaattatatagacgaattgaacaacctatttattccttaaaatatagttataattataatacctgtaataatgtatccaaatccagcatatggagcttacaatccaggaggttatggtggtcaacctcaaggaggaaattatggccaacctcaaggaagaagttatgatcagcaccaaggaggaggttttgctcaacaacaaggtttcggccaacctcaagggggttttggtcagccccagggaggcggtttcgctgcaccaggtggctatggtcaacccaatcaaataaaccctgatgtccagtcatggtttcaagctgtcgataaggatcgttcagggcaaatcagttgggaagaacttcaagctgcattaatcaatggacaaggtgaaaatttctcccccacagcttgcaaattgatgatatccatgtttgatattgatcacagtggaactattggggtaaacgagtttcagttgctttataactacattaaccagtggctagcagtttttaaaaactatgatagagatggttcaggtagtattgatgagacagaacttacacaagcctttcaacaaatgggctttagattctctccagagtttgtcaaatttttgttagttaaaagtgatcttaaaacccatagcaggatgtctgttgatcagtttattgtagtatgtattcagattcaacaattcacagaagcctttaaaaagaaagatcgtgaactgaagggagttataacacctaggttttgaagagtttttgggtattgccttgagttgttctgtataattaccatatgtatctcagaaagaagcaaaaatcagttaaaatttagtaaaattatttctgatttatatacatttaattttagagttgtagaaatatttctatattttattctatacaattnnnnnnnnnnnnnnnnnnnnnnnncnnnnnnnnnnnnnnnggatttttgggggaagaaaccnnnnnnnnnnnnnnnnnnnnnnncataggcaaacccctttaatttgggggaataaaaattttctcgggataccccggggnnnnnnnnnnnnnnnnnnnnnnnnnnnnnnnnnnnnnnnnnnnnnnaagggggggaataa

SEQ ID NO: 17209 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (117)..(117): n is a, c, g, or t
  misc_feature (163)..(194): n is a, c, g, or t
  misc_feature (201)..(233): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaanattttacatgatctgagtttaaaccggtgtgagcccaggttggttnnnnnnnnnnnnnnnnnnnnnnnnnnnnnnnngaaaggnnnnnnnnnnnnnnnnnnnnnnnnnnnnnnnnntaataat

SEQ ID NO: 17210 - DNA, 822 bp, Diabrotica virgifera
  misc_feature (730)..(730): n is a, c, g, or t
aaaaatattacaaaaatgtttaatatatccgaagaaaatcttccagagtgcctacaagacgaaaacagattgaatgtgctttttgcaccaattagaaacagaagtgtaaatccaaaagattgggataataaaatatcttcatggaagaccataattaaagcatactgtgattcaactgatgtttatacttttacactctcttctttgaatgcagtttttgttagaaatggcagaccaccttcttgcctaccagaggtgttatctgagatggaaagaattggtgatattcagcccttagaagtgtttttaaagaagaatgatcattcatggacaggttgggccacagatctcttagtaaagcgtccattcatttggtcgtttaataaagtaaaatcatctatgtttacacaagataagtcccagcaatccatggttattctagaagtaattaagtcaaaatgtgatcaattgttaaaatctgtacctgacaattttaagaacaaattagttagcttaaaggacatattagaaattttgaacaaatcgcctaaatatcttgatgatgttaaactcattcttcattacatgtctaataataatttagtagacattacgcatttaacaagtaaaaatgaaaacgagttagaaacgactttaatcaaattcaccgatggttcaaaaaacaatcgtattagtgaactcgatattggaatctatactttagaacaanatgaaaaaatagtccttaaaggtatagaggaaatggaagatacccattgaaaatgcaccccagaagccgagatgcacttagctaaaaatcat

SEQ ID NO: 17211 - DNA, 593 bp, Diabrotica virgifera
  misc_feature (18)..(50): n is a, c, g, or t
  misc_feature (52)..(65): n is a, c, g, or t
  misc_feature (71)..(113): n is a, c, g, or t
  misc_feature (125)..(142): n is a, c, g, or t
  misc_feature (149)..(163): n is a, c, g, or t
  misc_feature (165)..(198): n is a, c, g, or t
  misc_feature (393)..(409): n is a, c, g, or t
  misc_feature (411)..(424): n is a, c, g, or t
gtccttcctcgggtccgnnnnnnnnnnnnnnnnnnnnnnnnnnnnnnnnncnnnnnnnnnnnnnnttactnnnnnnnnnnnnnnnnnnnnnnnnnnnnnnnnnnnnnnnnnnngaaaatataagnnnnnnnnnnnnnnnnnnagtaagnnnnnnnnnnnnnnngnnnnnnnnnnnnnnnnnnnnnnnnnnnnnnnnnnatgaagaaaggaatgcgggaacgtttttttcaccggcttattaaaaacatgactttttgtaataaatatgaagactcgcctgcccactgaataatatgaatggacgcgatatagtgaccgagatatggtagtataatcattaagtattattattgttagtagaatatgaaggattgaatggaaaagaaaatgacnnnnnnnnnnnnnnnnngnnnnnnnnnnnnnngttaataagtttatgatcctatatttgtgattatgagactatagagccttatggataattgcgaagttttattggagagatcaaaacgaaaataaagattgcgacctcgaggttggattaaagaatataattagcgtagcagatatattattaagactgatcgactttt

SEQ ID NO: 17212 - DNA, 51 bp, Diabrotica virgifera
  misc_feature (17)..(39): n is a, c, g, or t
  misc_feature (42)..(42): n is a, c, g, or t
gatggaaagggtggatnnnnnnnnnnnnnnnnnnnnnnnttnataaagatt

SEQ ID NO: 17213 - DNA, 52 bp, Diabrotica virgifera
  misc_feature (19)..(36): n is a, c, g, or t
ccttaagggaaaaacaggnnnnnnnnnnnnnnnnnnaaaggttccaaactcc

SEQ ID NO: 17214 - DNA, 795 bp, Diabrotica virgifera
  misc_feature (719)..(719): n is a, c, g, or t
  misc_feature (737)..(737): n is a, c, g, or t
  misc_feature (748)..(748): n is a, c, g, or t
aaacgagcaatggcacaccttaatctgtttgttttttgtgcacttgtaaattttgctaataatggggtaacttcagctgttactggattgactgatgatgacttaataataacattatctacaggaagtaaagtccgaggacacgtccttcagagttttgaaggtaataatttccatgctttcgaaagtattccatatgcagaaccaccgattggaaagaacagatttcagccgcctgtaataaaaacaccatgggaaggaatattaaatgcaactgctaatgaaaaaatgtgcccacaattgctttcccataatgatcctgtcgtaataggagaggaggattgtctgattctaaatgtatatacaccattgaaaagtgatcttcagacgcccctacctgtgtttttctggatttatggaggaggttttgatagtggacattccgctttgtatgatccaagattgttgattgattttgatattgtaattgtaacaattaactatagggtgggatctttaggcttcctaacaaccattgatgataatattcctggaaacgtgggtcttaaggaccaacttcttgcccttcagtgggtacacgacaacattattgcctttgggggcgatcccaaacaagttactgtgggtggtgaaagtgctggaagtatgtctgcaggatttcatttgcttagcaaggcagccaaaggattatacagtgnaatcatccaacaaagtgnctcgccattgncagggcccttctatccatcaaatgatagagaaattgcatttgaattt

SEQ ID NO: 17215 - DNA, 611 bp, Diabrotica virgifera
  misc_feature (264)..(285): n is a, c, g, or t
gttgcatcaatcagctgattcttgtagttaaaaatacaaatgaacggttttagtacgggtgaagaggattcacgaggccctacagatcaaatctgttgtttgattgataatagtgaacggtgtataaaaccagctggaaacgcatcctacagtaaaaaaattgaaaaaactgccatccaaaggaggttgaattttggcatagatagcaacgcaaggcacaattatatctgtgaccatcacaagatgatcattcaatgtgcaagnnnnnnnnnnnnnnnnnnnnnntcggaagatgactcaaatgaaacagacacagatcttccagaagtagatctataccaattacaagtaaacaccctgagaaggtacaaaaaacattataaggtgccaatgaggcaaggactgaacaaagcccagcttgcagatacgttaatgaagcactttaagacgattcctgtgaaggaaaaagaagtggtaactttcttcatatacactgtaaagacaaacgccaacaagctggatcagaagaatggtatcaataatgacactacttaatgctcgtgcaattaaaatatgaagtaattttaagtcataatcatatttaagtgttg

SEQ ID NO: 17216 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (111)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacnnnnnnnnnnnnnnnnnnnnnnagtttaaaccggtgtgagccaggttggttnnnnnnnnnnnnnnnnnnnnnnnnnnnnnnnnaaaagaac

SEQ ID NO: 17217 - DNA, 864 bp, Diabrotica virgifera
  misc_feature (4)..(558): n is a, c, g, or t
  misc_feature (560)..(706): n is a, c, g, or t
  misc_feature (726)..(787): n is a, c, g, or t
  misc_feature (793)..(810): n is a, c, g, or t
  misc_feature (814)..(852): n is a, c, g, or t
ctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaaagaaccctatagagnnnnnnnnnnnnnnnnnnnnnnnnnnnnnnnnnnnnnnnnnnnnnnnnnnnnnnnnnnnnnngggggnnnnnnnnnnnnnnnnnnaacnnnnnnnnnnnnnnnnnnnnnnnnnnnnnnnnnnnnnnnccacaatttttt

SEQ ID NO: 17218 - DNA, 642 bp, Diabrotica virgifera
aaccttctctaccttctacttcatcgatcctgccctatcttgacgttgtcatcattgctaccgcccccgtcctcctattagccttctaactttgcactagctttacaccctcccataacatatcttacatcattattgatcacatctttacatgtccatgctttccatagaactcctctgattgacctactaactctttgatcttcatcaaaatgttgaatacaccgactatttgtttgttatcaatttcttccattgtttcctacttctattccaactatatgcatgcaaccgtacaaatgagctaacataccacaacaacccttctttgaataacacgaataagatccctatgatctctgtgtgtatattttggaccgtcaatcaaaatatgacttatgatgcgagcatcaagaccattgccattcatgctgcttatacggatccaccgactccctcgaactacctctcctcatcctcaaaaatcaatgtgttcctctccgtgtacaagaattggtacactgtgacacaaaaaatggtgttcgggacgctggaatattgacttatgattttaaatattatcaaatgcatgaacgctcttccaaatctcaacatgcatacaccggatagagatgaactctg

SEQ ID NO: 17219 - DNA, 199 bp, Diabrotica virgifera; identical to SEQ ID NO: 16329
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (195)..(195): n is a, c, g, or t

SEQ ID NO: 17220 - DNA, 866 bp, Diabrotica virgifera
  misc_feature (8)..(654): n is a, c, g, or t
  misc_feature (661)..(698): n is a, c, g, or t
  misc_feature (718)..(731): n is a, c, g, or t
  misc_feature (734)..(756): n is a, c, g, or t
  misc_feature (764)..(785): n is a, c, g, or t
  misc_feature (788)..(788): n is a, c, g, or t
  misc_feature (797)..(797): n is a, c, g, or t
  misc_feature (809)..(809): n is a, c, g, or t
  misc_feature (826)..(846): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagnttaaaccgntgtgagccaggntggtttctatctttaannnnnnnnnnnnnnnnnnnnngaaaggaccaatatataaaa

SEQ ID NO: 17221 - DNA, 796 bp, Diabrotica virgifera
  misc_feature (2)..(742): n is a, c, g, or t
  misc_feature (752)..(790): n is a, c, g, or t
  misc_feature (795)..(795): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcnnnnnnnnnnnnnnnnnnnnnnnnnnnnnnnnnnnnnnnataana

SEQ ID NO: 17222 - DNA, 894 bp, Diabrotica virgifera
  misc_feature (433)..(500): n is a, c, g, or t
gtccgtggtttttcgttaatttttaaaatggatcggatggtttaataaaacttcaaaagcggataaatgttatcaatgctccacttccgggaaatgtccatcttagtcccagatcgcgaactcgtcttagttcgaaacgtatttcgccggcgtcgttcagaaaatcatcacgatcgagtaactccggaatgtccacacaatcagtacaagtagtattaaaatctacaaataattaacgttgaaaggttcgggcaatcattacccgttcttataacagaagctttaacattcgctcataggaacactatcgtttctcgctcggatatcagaacggggttatgcacgggtcgttcggggaagaaggctatagatatggcagtatcgtcagaatacttcagctcccggaactccacaaagaaaacacggtattgtnnnnnnnnnnnnnnnnnnnnnnnnnnnnnnnnnnnnnnnnnnnnnnnnnnnnnnnnnnnnnnnnnnnntttttaatcaattctgggatcaaataaatccttcgtggtattggctggtatcccctggaaggtgttctcagatactgggcctggcaattggtcaggaaggaataaccggtgaacaaactggtagatcttcagggtcaagaaggtgatagcttaacaaatggtgaaggactaaggttggtggtctggccacaaccacaggtactggttgtactagttcaaccccaaattattaaggggaagacatttggttgcactggtaagccactggaaaaccccaagtgggttgggtaaggaggcattaagtagaaaggatgtcttcacttaatctttgggacctaatttccagtggaataatcaaatggaaacgcgttttgggttcgtggtattggagtat

SEQ ID NO: 17223 - DNA, 748 bp, Diabrotica virgifera
  misc_feature (556)..(577): n is a, c, g, or t
catattacaagatagaccatcaccattaataccatctacatcttatttgcagtgagcatgcattaataaatttacatattatatcagtataacgtcgacatcaataattttatcttattttttactaattactttacatctaaatcttcgtgaaggacatgtaattgaaattatttgaactattttacctacaattaactgaagttttattgctatcccatcctttcgaatagtcacattctagatcaaagtagttatccatttattacaatgaaaaatattgaacatcggtgaaacacgagcctatgtttattcaaattgcaaaaaatgaaaccgtagattcatatataatgccaactattgaaaccaaagatattgattttcgattattagatgtctaccacttaattgttgttcccttagtttttagtattctgaaataaatcactgtcaaactggcactacagctttctactatcatactcatgacaagctgacaaatcacgcgacacatgcaacttcttagccaaatacactgtctgcactgacactatcnnnnnnnnnnnnnnnnnnnnnntctacatattagtagcgaaaaacgtagaattatatatatcgattattattaaaattctgcgagatattaatgtacatggagactttttatctatgttatattacacagattaaaagtattcaaaattatgtattaactatgtattaacattttgtgttagacgctctccac

SEQ ID NO: 17224 - DNA, 936 bp, Diabrotica virgifera
  misc_feature (2)..(2): n is a, c, g, or t
  misc_feature (14)..(840): n is a, c, g, or t
  misc_feature (899)..(899): n is a, c, g, or t
  misc_feature (917)..(917): n is a, c, g, or t
cnggacgcgtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaatttttattggagagtcaaatcgataataaagattgcgacctcgatgtnggattaaagtttatattnggtgtagcagctatattat

SEQ ID NO: 17225 - DNA, 905 bp, Diabrotica virgifera
  misc_feature (20)..(38): n is a, c, g, or t
  misc_feature (117)..(134): n is a, c, g, or t
  misc_feature (153)..(184): n is a, c, g, or t
  misc_feature (195)..(266): n is a, c, g, or t
  misc_feature (278)..(668): n is a, c, g, or t
  misc_feature (672)..(691): n is a, c, g, or t
  misc_feature (701)..(713): n is a, c, g, or t
  misc_feature (715)..(893): n is a, c, g, or t
  misc_feature (904)..(904): n is a, c, g, or t
tttatatcttttatcttatnnnnnnnnnnnnnnnnnnnctctctctccgtaaatgtaaagaaaaattctctatctctaacgatagttaattcgtatcgtgagagaatatctttcttnnnnnnnnnnnnnnnnnncatctctcttcgtacctcnnnnnnnnnnnnnnnnnnnnnnnnnnnnnnnntcatttattcnnnnnnnnnnnnnnnnnnnnnnnnnnnnnnnnnnnnnnnnnnnnnnnnnnnnnnnnnnnnnnnnnnnnnnnntaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggnnnnnnnnnnnnnnnnnnnnggcccactgnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattaatang

SEQ ID NO: 17226 - DNA, 856 bp, Diabrotica virgifera
  misc_feature (2)..(855): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17227 - DNA, 261 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(255): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngataggnnnnnnnnnnnnnnnnnnnnnnnnnnnnnnnnnnnnnnnnnnnnnnnnnnnnnnnngtcggc

SEQ ID NO: 17228 - DNA, 342 bp, Diabrotica virgifera
  misc_feature (3)..(36): n is a, c, g, or t
gtnnnnnnnnnnnnnnnnnnnnnnnnnnnnnnnnnnttaaacaatatctttttgtaatgcaactgctatatcatgttctatcgtgtaattgatttgatgacaccaatgaaggccagaactctaaagacctctgtctgtaacgtagatatcaatagtatgttgtgcttgcagataagaagcatattgctccgcatgagttcgatgtacttacaatgggatgtcggtattacagggtgacccaaactactaaaggacatatattagacgctgctagaaaccattaccttgaatatttctgacggttttagttgctgtagcagacacacacccggataagtagac

SEQ ID NO: 17229 - DNA, 930 bp, Diabrotica virgifera
  misc_feature (162)..(181): n is a, c, g, or t
  misc_feature (552)..(576): n is a, c, g, or t
  misc_feature (825)..(825): n is a, c, g, or t
tactaatccatatattttaggaacgtttcgttttgtgttcacaaaacatcatcagcccattatctgtaagaacagctgcctttagaaggaaattaatttaactaataatagactgcttattgcaaataagcaacctatgagaagtcatcaagatagattgtnnnnnnnnnnnnnnnnnnnntacatcgtgaagtatttattctagatggtaaaggcaacagatccagaaaaaaaatgatcctccaattaaagatcacattaaagtgagaatggtaacatgtgaaaagcacaaaaagtttttttttagtcaatattagatctgacataatatttaaaagtgaaaggcaacggtttacagaaagtgtaacaataattgcacctagaccataacggtggataaaatgtatcgaaagtgtaggtgaacaatggcatacaaaaaattttgtggaaaacaaaaattcttttaaaagaagaaatgtgtcagtagtacatctggtggcaaagctatagcgccctaattccggacttcattggatgtataataaactaccnnnnnnnnnnnnnnnnnnnnnnnnngaacttcacagtgttcatttaaccgtaacaacggtttatatgtaaataataacaatgtcacgtttagtgtattattgcttcatcgaatgactaacaatggatatcaatgaatcgtcccgtcttctcgtcgctttttatatacaatactaaatcacaacatgcatggttactagcggtcaatgccgatcataatgtaccctaatgtaaactatattatattttctttcgtagcagttctgttcaatgctnaaggttaacgtaccatggtatatcatccctttttttgggaaaggggctatatcgttagatataagtccctcactatattatcagcctaactggacagaaatccta

SEQ ID NO: 17230 - DNA, 871 bp, Diabrotica virgifera
  misc_feature (7)..(60): n is a, c, g, or t
  misc_feature (62)..(77): n is a, c, g, or t
  misc_feature (81)..(123): n is a, c, g, or t
  misc_feature (131)..(243): n is a, c, g, or t
  misc_feature (253)..(661): n is a, c, g, or t
  misc_feature (663)..(849): n is a, c, g, or t
  misc_feature (857)..(870): n is a, c, g, or t
atttatnnnnnnnnnnnnnnnnnnnnnnnnnnnnnnnnnnnnnnnnnnnnnnnnnnnnnncnnnnnnnnnnnnnnnnctcnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatannnnnnnnnnnnnng

SEQ ID NO: 17231 - DNA, 954 bp, Diabrotica virgifera
  misc_feature (133)..(147): n is a, c, g, or t
ctcctttacgcgtccggactgtccgaagacttgcatcggtcgggctggcggagcctttgacaaacggatggcagagcacaggggggctttcgacagtagaaggacagacacttctgcatgcgcacttcgcctnnnnnnnnnnnnnnnttatttcagtgaagagtttaaaattctgcatgttcggggtaaaggccttaagctgtcttttttggaatctatggaggttaatggattgaagggtacggatataattctgaatgaccaactcgagacaaacagctccccactcctcaacctcttcagttaaagacttaaaaaggcaaacacattgtaaactacaccacttgaaattccggtgtcagacaccggaggaacaagacgtgccagcagcggagcggaaaacagcgacaacagccaacgaagtaggagtggcttgactgtgaacttttcagttcagtcttgaatgcaagcaagacagcagtggagcgcttctcactctctgaggcgagaaggagaggcaaaggccgattgactggatgtggtgaaacttagggaatttgattttattgaattctctgagacgccgcagctagacatcggttagcggaaaaagcaataacgggctcgacgtgagcccgttacgggatgtctactgtgcctccgtaagggtatcgacactgcaaggtgtagttctttggaatctacatcgggcagccccggcccctaggtcagtagaacgagaacatcaagagaatcccgtacctagttctgtctgggtacgagaactaccgcgatagatgcagggaaaccaaccctgaagccgagctggcgtcgggccaggcggcgaagaaaaacggttcgtccaaattaggacttcctccctcagacgattgatcgagctaggtctcgatcaccccccccccctatggccactcccgccaacacatgaggatc

SEQ ID NO: 17232 - DNA, 669 bp, Diabrotica virgifera
  misc_feature (572)..(572): n is a, c, g, or t
  misc_feature (600)..(600): n is a, c, g, or t
  misc_feature (633)..(633): n is a, c, g, or t
gctcgatgagcattcgaaagttttcgtatcatgaagtactaaagtgtcgaattctagtggttgtgtggaaaaatatgtgtatgttgctaaactaaggagttaaaattatattttaagatgaatgaacggccatccaacatacccttttctattattcgagaactaagatgcagaaattgccaaaatataatcagttgtgctcctgtgcacgtattaccggatgaaaatgtattatgtggaaggtgtaaacaatatgcaaaagaaatatatcggaattacccattcgaagcgttagcgtcgatgttcttctatccttgtcgaaactgggacggtcgttgtccaaggattcttagatggaatgaatgcatggtacacgaagatggatgttcatacgaaagtggctgcagtcggttctggaagcaccctaaagcttttttaaaaggaaagagagacatgccttatggagatattagactagtagccattccagaaaaacttctcgacttcataaaatgcatccaatgcgaaagttatctgtcttgtgagccagtctacatccgatctgatggtanaacatctgccatcgatgtatccactccnaacgtgtcccaccagattgcatcagaaatttgngatacgagatattgtccagcatcataatatttcctt

SEQ ID NO: 17233 - DNA, 116 bp, Diabrotica virgifera
  misc_feature (94)..(94): n is a, c, g, or t
  misc_feature (102)..(102): n is a, c, g, or t
ggttttgggttgtgtatttatgtgtggagctccattggctacgatggctgcaaactcttctacattccctgaaatattcacactagacatgggncaaagacngttaagctatcatc

SEQ ID NO: 17234 - DNA, 80 bp, Diabrotica virgifera
  misc_feature (2)..(79): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17235 - DNA, 889 bp, Diabrotica virgifera
  misc_feature (627)..(660): n is a, c, g, or t
  misc_feature (771)..(788): n is a, c, g, or t
aacagatgcttggtatcttggtaaaagttacagataatagtgatttatatcctcgcctttaaggttcaagataatgttctttacaaacatcgttttttctaaatttaaattttctgattctactccagaatggaaaatttttgttcctcgctccacataagaaggaaataattttgcatatgtatcatgatgatcctacagctcgctcatttaggtgtctttaaaaccctttctaggatttcagaactttattactggcctaaaatgagaccttttgttgtgaactatgttcataaataatatcgtgatattaattttccttttcaatttttatttgctgatttacttagtccgtatcctacatctaaaagtgtaaatcgctttcttttagttgttgttgactgatttacaaagtttatgtttgtacatcctttggctaatgctaccgggataataaccatagaaatggctgttatcccggtaaaatggctgttatcccggtagacgtatcttataaagttattttattgaaatctattttttcactattgcggagattaatggactcaacattaaagcttgaacatcataccggctattactaatataaagataaatatagaaatnnnnnnnnnnnnnnnnnnnnnnnnnnnnnnnnnnagtcatctcgaaaataaacaaataagtttccattcgacaggacaatagccagattcatgtagtttactgatattattatataggttgaaacatattatttgtcacattagnnnnnnnnnnnnnnnnnncccgcagtaataaaaaaagaaggcaacagttagtagttataacaattatgaattttgccatactgggtttctgtgagtaaaaaaagaagactagtataaaa

SEQ ID NO: 17236 - DNA, 496 bp, Diabrotica virgifera
  misc_feature (42)..(74): n is a, c, g, or t
gccttcttgattttaatgtgaaagataacttatgaattgatnnnnnnnnnnnnnnnnnnnnnnnnnnnnnnnnngccagcatctcaccatagtctcacgacggtgaaggaagaaagaagcagattaggtgtaactagtggtgtctcgtggacatagcttcgttctgggaaagagagcggatctaatgcacattcgcttgttccgggagttgttgtagatgattgtgttagaaatggattaaattgtgtgtattgatgatataaatcgaagggcactatcttacaggactgggatgaaatgaagataaaattcttacttagattattcgaactgctaagggtcacgtaagagagagtgtggagagtggtgatgatacacatgaaactcatatgatacgaatgcttgtagaaactcttatacacaagaacgtgaggcgtaccaagaagcctagcgcgacgactgaacaagtgtctactgagtgcaatgatgcgcaacg

SEQ ID NO: 17237 - DNA, 891 bp, Diabrotica virgifera
  misc_feature (362)..(380): n is a, c, g, or t
  misc_feature (524)..(547): n is a, c, g, or t
  misc_feature (777)..(777): n is a, c, g, or t
  misc_feature (874)..(874): n is a, c, g, or t
  misc_feature (883)..(883): n is a, c, g, or t
gcagacactacgtcgtctttcctctctctcggtagtcggcatcatcccgtttcggatccgtacttctcacacaacaccgctccgtttcgacagttcgcgctttcatccgaaattcgtaaagtcggctcacctcaccatcaagtgacatttttcattcaacctcggcaccacaaataagaaaattttcgtggtgttcgcattttatcggaagtttaaattacctcacttctttcatcgagtacatcgattctttcggtttcttagtgtctcgatatcgtaaagttagagtaaaatcgtgtggcaggctcgtttatcttcaccccaccatctcgaactaactttcgtacagatactcggctagnnnnnnnnnnnnnnnnnnntttacattagggtgtagaaaacgttatttttttcagggatctatagtttctttattatttcgtaaagcgatgttgattttaaagttagaggatggtataaaactcgccattttcataatggtaactacctatagatctattggnnnnnnnnnnnnnnnnnnnnnnnnaactaaaaataggattactaaaaattttaagatagatattataataaccttctatgtaaaagtatttttgtggatttcaaaatggaaaatggcatcgttcagcgagcaccttacttcgctctgtttccatacgttcgttttgtatatatactttcatcatttttgcccactgcgagggttcgtcgtttcacataatacaaacaaacaaacatctgaaccaaggccctggncctgaagaaaggtctgcttttgtagagttttgtttttcatgcgtcacgctctggtctaaagggacggtggaccacggtattgttatctgactgtaantagttttangtgaatca

SEQ ID NO: 17238 - DNA, 469 bp, Diabrotica virgifera
  misc_feature (114)..(181): n is a, c, g, or t
  misc_feature (225)..(244): n is a, c, g, or t
tcctataggagaagctggaacgcctgcgggacccggcccgaaattcccggcccgccccatcgcgccgcgaaagatatttttatatgaataatattacctcttttgaaggatgtnnnnnnnnnnnnnnnnnnnnnnnnnnnnnnnnnnnnnnnnnnnnnnnnnnnnnnnnnnnnnnnnnnnnacgagatgttattaagtatttttatctattattgtaacaattgnnnnnnnnnnnnnnnnnnnnatgtaaatttcaattatagaagttatagaattgatgatattatttatttcaacaaattgaagatctatgaatagatgtatactataaagattgtgtttgtttaaacattttttacacctgttatattatatacatgaacattatgtattaaatataaaagtcgcgcctgcaccgcagattgatttgaatgtccgtgcatattaataacccttgtaaaataaaaag

SEQ ID NO: 17239 - DNA, 955 bp, Diabrotica virgifera
  misc_feature (873)..(874): n is a, c, g, or t
  misc_feature (905)..(905): n is a, c, g, or t
tggcgctttatcgacgaaaagggttccttcttcactttcaagctatgtccacgtagtctgctgtgatcgtctaaaataaacaagtgttgcaaatctccatatccatactttaaaattcggaaggtgataattaagtcaccacggagtcgacgagcttcaaaagttgataacccggctaaagaaagtctttgttggtaatctggccttcttcgtttgaaacatagtctggtggccttcttttgaatattttcgagaagagttctatcgcgcactaattctgggcaccaaaccgttccacagtactccagtaggggtcggacataagttttatacaaacgaatagaacccgaaaatgatatttttgtaaaagtcttactaagtaggtataacttactattcgcttttttagtaacgtttgaaatatgctccgaccaactcaaattttcagtaattgttacaccaaggtcactatatgattccacagtatccagtaaatgcccgtctatcgagtaagacaaacgagggttattttttcccaaatgtaaaaccacacacttatctctatttagaggtaacatccaatccgaacaccacttgaagatcgaatctaagtcactttggtaagtcttgcccattcaagagtgggtcagcaaatatttttgtatcgtcagcgtagaaagctttcctagatttgatatgagattcaagatcactagcatacaacaccaaatagaagtggacccaaaacagaatccttgtggaacacacttaaaaaccgttttttttagatgacagcgacttgccaactctaacacaaaactcccgatttgttagaaatcattaatcaactcagaaagtgtccgcgaatgccannatgttctagttatacatcaattttctctttntactcgatcaatgcttttgcaagtctaatatatatatccacaggtcgttt

SEQ ID NO: 17240 - DNA, 580 bp, Diabrotica virgifera
cttcttctcttctacctttacttgtatggacctgatctcgggcagagaacgtggagcgttttattgctgatgggattacacataagtttctattcacattaggtatatacattacaaaactaatatcaagctgttgaatataatgaaataaatataagaaataccgctgcacgactcgaaaaatattatgatttagaatcggtttgacttggagtaactactgtccactgacaacacaagactacaatacttagttgcattctaaaccatactaagtaaggctaggtctaacattaaagctacctggacagtgcccactccagctttgcttgaaagccttacatagattattgagaataatcatcggagattatatgatatgtggcatatgtttgatcgtggaattatttattagcatgttgtcgatctactcagagcgctcaaatattagtttagtcattctaccgtatctagggagtgtgttatccatagaattatcacaaacagtttctcctggtgtcactaccatgatactacagaaagtcttgatgatacaaataatttcctgttatctgagcct

SEQ ID NO: 17241 - DNA, 235 bp, Diabrotica virgifera
tttatagctccaccacagaccatgatatacagatgtacaaccagaattgcaaacaataagacataataactaaggctagtagttattatgaattacagatgtaataagtatgcgatcatcaaatacttcgtctaacaaatggcctataaacagcgagaactacaaagattgtatctatataagatcaaagtacaagaagtctaggttttaataaaacttaccatcagatataata

SEQ ID NO: 17242 - DNA, 596 bp, Diabrotica virgifera
gtctttaagaaagtaaaatttcaaagtaatctattaaaaatgttcagaaacacagctctccgtgctcactcgattttaagaacagcccttgttgcccccaagccaaatgtatctactatgagattgatgtcaagccacagtaccgaaactgatgaacaatttgatagccgttacgaaaacttcttcaacagaaaagatatcgatggatgggaaatcagaagaggtatcaacgatttatggggtcatgacttggttccagaaccaaaaattcttattgctgcattgaaagcctgtcgcagagtaaatgattttgctttggcagtaagaattctagaagccaccaaggacaaatgtggaagtaaagttaatgaaatttacccatatattattcaagaactgagacctactttgacagaattaggtctcaataccccagaggaacttggctatgacaagcctgagttgcacctacaatctgtattccacatgtaattaattaaatgtatagttaagtcgtttcaagtatcataatgtagtttctataactaaatacataatttgaaataaaatattcaggttctgatgaactttaatat

SEQ ID NO: 17243 - DNA, 585 bp, Diabrotica virgifera
ccctttcacgcgcccgcgaacgcgaacagagcaggacggaccctttttgtttgcagaataatctcctttactttcctatatcacttgtagatttaacaggaaaaagcggcaacatgttccggaccgcacataccacgatgatattctatttgaaagctgtctttgccaatcaaaatatctcaaacgacaatgaagctctgatgcctctacaatgaaaattaccaaagtgacctcaacaaaaacgacttctatctaaaagaatatgaagttccatgcagagatcactgtaaagacctaaaccctgaatatgagaagtctgcccagagactatgaattacagtggaaataacatcaaacatgataaagaagatgcctcatacgaatggagtatcgatgaactcatcaacaataaagaacactccactctgtaattactaccaaatcgcaccccaattccatactcattgcgaagacaagactacgattttggaaacagtctgtggttacacgacgtagcttccagactaagactaggaatccgatgaataacctattgaattcatcgagggacacacaagagattgt

SEQ ID NO: 17244 - DNA, 770 bp, Diabrotica virgifera
cctttcgcgtccgagagaagcgtcttgatctgttataacagaatgcgaaaaaggtataaagaatgacagggatgactgaagtggacaaaaccgtgatcccagagacgaacacctgaacaaaagcagaactcgaacatcggacggcagacgtccgatggaagacatgcctgagctgcaatatgcaagaactgcaagtgccgcttcggctacattgcctggagctgcagttgcaagattgcccatgcatatgcactccaaggacaaacagaccagaggataaacaaaagaacggcagatcatgctctgattcgtccttaaacactgtacaagagagtgaacagcatcaacaattagtgaacgcaccaagaatattctttttgacgtaaactagccaaatgtttacgaatcccctgtacgcgacacctacatctcatatggagcagctgaaattgaagatctggcacgagagcgtgagtggctgctggtgaaaaatgtcagagagagcactcctggtgaatgtactgctgctggcactagaaccacatctgaggcaccaataattgatgaatcagaagatgcatagcctgacaaatctgcagtagagataagagaagcataaccggacatgtcctcacggaaagtgtgagaacgatctaaagcattataggcgctcaagaataagcaacatgacatatggaacgctataaagtagattacgatgtaaccttgaatgtttttttgtcataaatattgctccggttgatcattct

SEQ ID NO: 17245 - DNA, 945 bp, Diabrotica virgifera
  misc_feature (48)..(66): n is a, c, g, or t
  misc_feature (335)..(359): n is a, c, g, or t
  misc_feature (507)..(524): n is a, c, g, or t
  misc_feature (536)..(580): n is a, c, g, or t
  misc_feature (675)..(692): n is a, c, g, or t
  misc_feature (704)..(748): n is a, c, g, or t
  misc_feature (914)..(914): n is a, c, g, or t
  misc_feature (919)..(919): n is a, c, g, or t
aaattattattttaatacataaaagcaactgtaattaaatggaaatgnnnnnnnnnnnnnnnnnnngcgaggaaacgtgtaaaatagaaatagaagataatcacttggatgagttgaaatgtgaaattcaagaggaatccaatgggcaaagtacttaccacacctatgattctttggatttgaagaaatgtcccataacgactgaaactgaaacagaacaacatcatggaaataaacttaaggggatggggtatctccaaggtgaaagcaaaatgaaagttatggagaaaatggaagattcatcttatgaaggagatgacatgggtcgacccagnnnnnnnnnnnnnnnnnnnnnnnnnatgaaaggtgtgacgggaaaaagactatataaatgtgaaatttgttataagcgatttagtgaagctaatactttgaaaaaacattcgagagtacacaccgggcaaaaaccttataagtgtgagatttgttttcagatgttttctcaannnnnnnnnnnnnnnnnncatttaaaaacnnnnnnnnnnnnnnnnnnnnnnnnnnnnnnnnnnnnnnnnnnnnnattcagtcaagcgggtaatttcaagaaacattcaagagtacacaccgggcaaaaaccttacaagtgtgagatttgttttcagatgttttctcaannnnnnnnnnnnnnnnnncatttaaaaacnnnnnnnnnnnnnnnnnnnnnnnnnnnnnnnnnnnnnnnnnnnnnatttagtcaagcaggtactttgaagaaacactcaagagtacacaccggggaaaaaccttacaagtgcaacatttgctttaagcaatttagtcaagtaggtaatttgacaggacatttgagagtgcacactgaggaaaaacccatacagtgtgaaattttgtctaangcaanttagtcagcgagtaattgaaaacaca

SEQ ID NO: 17246 - DNA, 914 bp, Diabrotica virgifera
  misc_feature (768)..(784): n is a, c, g, or t
  misc_feature (869)..(869): n is a, c, g, or t
gtagcattgttcattaacgtacacttgtatgtcggtgccatgaattacttacttcattgtgtgtttatttgtagtttaaattaaaagcagctgaatatggcatttgcacttactattttaatatcggttttaattattttgggaataataaagatctataatatattaaaagcaaagtcatgttctagtaaagtttttctagttggaaaagttgcaatagtaactggtgccaatacaggaattggatatgaaaccgctcttaacttcgctacaagaggagctaaagtcattttagcatgtagggacctagaaaaagccgaagaagctaaagatcgcattatatgtcaaaccgaaaataagaatgttgttgtcaagtcacttaatctaacttcattggaatctgttagagagtttgcaaaagatattaatgaaaatgaagaaagattggatattctagttaacaacgccggtagtggtggtctcaatcataaatatactgaggatggtttacagttattaatgcagataaactattttgcgccagttttacttacaattttgttaacagggttactaaaaaaatcagcccccagccgagtaataaacgtatcatctatgatggcaaaaaaaactaatttaacaccagcaaatataaatgacccaccaccaggtccatatattagttacgggaacagtaaacttgcaaatatattattcacaatcaaactggcggaaattttaaaaaattcaaatgttaccgtttattcnnnnnnnnnnnnnnnnntacagactgatatatttagacgaataacaggaatcagtaaacttattcttatgccagtgtatcgcatgtttttttaagacagcgnaacaaggagctcaaactactcttcatactgctttagaacaaggtt

SEQ ID NO: 17247 - DNA, 698 bp, Diabrotica virgifera
  misc_feature (14)..(499): n is a, c, g, or t
  misc_feature (506)..(543): n is a, c, g, or t
  misc_feature (563)..(576): n is a, c, g, or t
  misc_feature (579)..(601): n is a, c, g, or t
  misc_feature (609)..(631): n is a, c, g, or t
  misc_feature (661)..(692): n is a, c, g, or t
cacttcgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 17248 - DNA, 958 bp, Diabrotica virgifera
  misc_feature (44)..(73): n is a, c, g, or t
  misc_feature (79)..(115): n is a, c, g, or t
  misc_feature (117)..(179): n is a, c, g, or t
  misc_feature (187)..(268): n is a, c, g, or t
  misc_feature (270)..(288): n is a, c, g, or t
  misc_feature (290)..(444): n is a, c, g, or t
  misc_feature (448)..(473): n is a, c, g, or t
  misc_feature (475)..(524): n is a, c, g, or t
  misc_feature (538)..(615): n is a, c, g, or t
  misc_feature (625)..(681): n is a, c, g, or t
  misc_feature (688)..(724): n is a, c, g, or t
  misc_feature (730)..(777): n is a, c, g, or t
  misc_feature (791)..(823): n is a, c, g, or t
  misc_feature (839)..(907): n is a, c, g, or t
  misc_feature (909)..(952): n is a, c, g, or t
ctgcggaccccggcccggaatccccggctccccctacgcgcccnnnnnnnnnnnnnnnnnnnnnnnnnnnnnncgattnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnncattatcnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatnnnnnnnnnnnnnnnnnnnnnnnnnncnnnnnnnnnnnnnnnnnnnnnnnnnnnnnnnnnnnnnnnnnnnnnnnnnncttttactagaacnnnnnnnnnnnnnnnnnnnnnnnnnnnnnnnnnnnnnnnnnnnnnnnnnnnnnnnnnnnnnnnnnnnnnnnnnnnnnnatttaatatnnnnnnnnnnnnnnnnnnnnnnnnnnnnnnnnnnnnnnnnnnnnnnnnnnnnnnnnngtatatnnnnnnnnnnnnnnnnnnnnnnnnnnnnnnnnnnnnnatatannnnnnnnnnnnnnnnnnnnnnnnnnnnnnnnnnnnnnnnnnnnnnnnaaatgaagagttgnnnnnnnnnnnnnnnnnnnnnnnnnnnnnnnnntagaattttatcttcnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnggggtg

SEQ ID NO: 17249 - DNA, 945 bp, Diabrotica virgifera
  misc_feature (823)..(841): n is a, c, g, or t
cgagaaaccaactcgtaacacccagttcttcatgtaggaccttttggatcgaggtttttgaaatgccctaagatgtctctatttcccggtatgttacacggcggtcatccttaattagctgacgaatcatataaatgttctgttgtgactgcggttttgggtggacctggtctggattcgtcgctgagactggtgcgaccacgttgaaattccacatatcagcgggaaatagttaaatggtgtgatgcttcatttccaaacacagaaaccattttcaatcattcacttttcgaccgacatgctaatatcaaaaatccctgtatatacacgactagtatcacagtgatactctggatttatatcaacaaaagattgaggttacatttgtcttagagggtggcgccctctaaccggctatatgcaaaactaaaaacacctcgtacacgtggcacagaagtgaagaatttgaaaaacaacaaatcttaatcataatgttagcacgagaacaagcgtaaagtgtctaatagcatatagctttgaacaataattagattttaattttctaacgataagaagagagtttgtgcaacattctgcatataatattgaaagataacaaattacgatacaccctttattttgtattgtggaatcagaccaatcaccttatgtctttattttaaatcaagtttgttggtaaaactttttattgctgaaagaatgtaaattgtgttgcttgtaatctggcaaaatcttcgcttttgcatatcttctttatcgtttccttgatttattgaaattgtatgaaattctgacttgttgnnnnnnnnnnnnnnnnnnncttcctctaatctaaatttacatttgagtatattatttttatgaagctcaatgttttccccttgttattatgtaaatttctattaaaaatacctttttatatat

SEQ ID NO: 17250 - DNA, 953 bp, Diabrotica virgifera
  misc_feature (238)..(282): n is a, c, g, or t
  misc_feature (860)..(860): n is a, c, g, or t
  misc_feature (895)..(895): n is a, c, g, or t
  misc_feature (927)..(928): n is a, c, g, or t
aattcctaattttctaatagtgagtttaatacggtctgttacagtttttccaatgcattcagttaagcatgtttgcaagccatatcttggcaacaatttactcaacatcttgagacatctctcctcaacagaatgttcaaagaaatactatcgatattgtaattgctggtggaggaatgattgggaccactcttgcatgtgctttaggtaaaaactcaagattttcgggaagaaaaannnnnnnnnnnnnnnnnnnnnnnnnnnnnnnnnnnnnnnnnnnnnaaaaatatagtaatagagttgtatctctgacaccaggaacaaagaatctattaaacaatattggcacatggaaacatattgaagaagccaggtttgctacagtaaagagactacaggttatggatgctttgtctgatgcttcaataacatttggagaaataaagtcttctgacgatgtgtcctacattgtagaaaacaacttaatactgcattctgcaaagaaagaaataaaaaacaccaacgttgagatcctgtacgaatccaaagtaaaaaattacgagctaccaggtgttgatgattctcaagttaatattttccttgaaaacggtaaccagtacacatggtgatttattgattgggctgtgatggtgtaaattctaaagttagacaaacaatggggagtacactatttaaattggaattacaatagcacaggtgtcgtagctacgcttaagttctgtgaggaattcgacaattccatcgcatggcaacgttggttgcctacaggacctctagctctactcccgctcaacagttcccaaagctctatcgtgtggtccactacacctgaagacgcncagcgattattaaaattaactaacgaacagttggntgatgcagtaaacgaatctttttgggaagttnnttaacgcagtagcaccattgatcaa

SEQ ID NO: 17251 - DNA, 963 bp, Diabrotica virgifera
  misc_feature (7)..(31): n is a, c, g, or t
  misc_feature (38)..(55): n is a, c, g, or t
  misc_feature (104)..(122): n is a, c, g, or t
  misc_feature (188)..(223): n is a, c, g, or t
  misc_feature (305)..(390): n is a, c, g, or t
  misc_feature (392)..(411): n is a, c, g, or t
  misc_feature (413)..(458): n is a, c, g, or t
  misc_feature (460)..(472): n is a, c, g, or t
  misc_feature (530)..(699): n is a, c, g, or t
  misc_feature (708)..(720): n is a, c, g, or t
  misc_feature (722)..(952): n is a, c, g, or t
atttatnnnnnnnnnnnnnnnnnnnnnnnnncgtaaannnnnnnnnnnnnnnnnnctctaacgatagttaattagtatccgtgagagaatcatctttatctttnnnnnnnnnnnnnnnnnnncttttcgtacctcggtcgtatcagggattatctaattaataattcatcatcatcttcatctcatcnnnnnnnnnnnnnnnnnnnnnnnnnnnnnnnnnnnnctctcgtaaaataaatcatctttcaaataatttttttcgtaatcgaaacgttattcgtttttaaatatcatctaattttttnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnncnnnnnnnnnnnnnnnnnnnnnnnnnnnnnnnnnnnnnnnnnnnnnncnnnnnnnnnnnnngttattatttatcttttcatcatattattatttttcatctttttcataaattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggggtgat

SEQ ID NO: 17252 - DNA, 885 bp, Diabrotica virgifera
  misc_feature (145)..(166): n is a, c, g, or t
  misc_feature (220)..(240): n is a, c, g, or t
cggacgcgtggggtgcatgtatattaagtttgattaaatttttatagaggcagtttaaatgctgttaaaacttagtgcctacattcaaaaaagatatgatcaagatcaccctgtttcctgcaatgtttgcaattatcgtcttcannnnnnnnnnnnnnnnnnnnnngagttacctatattgctttttgagttatatttcaggtattaagagtaactaggnnnnnnnnnnnnnnnnnnnnngatgaagtctaagacgaagacgaaatttaggatgaagtctctgacaatattagaatagctcgctttggaaagaaaaataaaaatgggcaccatccatttaaagtgttcttatcttcaactgaaaatgttcagacagcagacatgcagttcttaaacagaaacacattgaccatgctaaaaccatctttatcagcattgatcagacccctaataaagggaaggtacttgaatctgtatatcaaatttgagcttttgtctcctcaggaagcaggggacagaacctgtcgatacggtattataatatcccaaaggtaattcaaaaaacctctaagccacaatgacttgggcaagctctccattttttattgaaaatggtagaggacttcggactaaattaacaactctgactctaaatgtttctaacagctactttgatgtgatcatatttactgaaacatggttaacacctgatacaagcgatgctgaaattggtttatttaattacgatatctacagcatctagcgatgctaaaattggtttatttaattacgatatctacacacaagacctgacacaagaatccattaatttcgacagtggaggtggtgttttaatagctgttaaagaagtttatcccatcagat

SEQ ID NO: 17253 - DNA, 531 bp, Diabrotica virgifera
gattaattagaaagaataccgttacagattatgatctatttttttgagttgatacattgtggtcaaaaagtttttttgttttcattcgtcatgttgagactttccctttcatttctgagatgcaacagaagtgccaagtgagaagataattgtgaacaattgactatgaaaaatataacatatggacatcatatactctgagaatgatcaaggaagagtcaccttgatagaccaacataccatgtataacgatgcatttatcattacttaggtacttgctaagatgacatttatgaaggctataactataaatacacctgtctggaccgttgacatcaataatgtactctgcatcgcttaaacagaatatgactcatgatagtgcaggggcttctggagatgtagtattccagagagacccaaattattaaagcaaattattgaccttttgatactatatattgtagttatttctcccggttttatgcgagtacaccctctaacgtttcaatagtcgtggtcactctcaca

SEQ ID NO: 17254 - DNA, 627 bp, Diabrotica virgifera
  misc_feature (19)..(19): n is a, c, g, or t
  misc_feature (22)..(23): n is a, c, g, or t
  misc_feature (55)..(55): n is a, c, g, or t
  misc_feature (71)..(71): n is a, c, g, or t
  misc_feature (77)..(77): n is a, c, g, or t
  misc_feature (253)..(287): n is a, c, g, or t
  misc_feature (419)..(419): n is a, c, g, or t
cccctttacgggggggganganngagaaaaagagagggaaaaacattttaagagnagagagggaaagatanagaggnatgagaaggatggagtggaagagagagaggaattgatagaaaaagaaataagagaaaatttaagaaggatgaagaaaagaaaggaatgtgggattgataatattaaagttgaaatattagaaggtatatatgaggaagtagtatttattgtagtggttttatagaatgaatgtgtnnnnnnnnnnnnnnnnnnnnnnnnnnnnnnnnnnnttgatgttataataataaggaaaggtgaagataaagatgataaagaggtaaaatattagagatatatttgtttatttaagagtatgggaaaattgttagaaaaagtgatgtgtggaagaataaattatgtanggagaataaagggattataagttgagtagtatggatataggagagggaaatttatggaagatgttattaagaaggtatatgaaattgtggagagtagtgaaggaaaatatgttatgagagtgtttatagaaatttatggagacttggataatatatggtgggttgagttttttgaaagagttcggaggatgaggaggaagggatattt

SEQ ID NO: 17255 - DNA, 832 bp, Diabrotica virgifera
  misc_feature (12)..(81): n is a, c, g, or t
  misc_feature (86)..(128): n is a, c, g, or t
  misc_feature (136)..(255): n is a, c, g, or t
  misc_feature (257)..(529): n is a, c, g, or t
  misc_feature (531)..(571): n is a, c, g, or t
  misc_feature (573)..(656): n is a, c, g, or t
  misc_feature (658)..(691): n is a, c, g, or t
  misc_feature (693)..(791): n is a, c, g, or t
  misc_feature (793)..(831): n is a, c, g, or t
ctcttttcctcnnnnnnnnnnnnnnnnnnnnnnnnnnnnnnnnnnnnnnnnnnnnnnnnnnnnnnnnnnnnnnnnnnnnnnaacgnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnng

SEQ ID NO: 17256 - DNA, 890 bp, Diabrotica virgifera
  misc_feature (694)..(694): n is a, c, g, or t
cggacgcgtggggtttttaacaactttcgtgggtaatatggggggtccacgggcctctgggaagttaattgaatcctcaggaaagccaataccaccggagacactcgaaaataaagttctagcaatggtttccatttggttgcatcaggcaattaagggattccagggatcataaaggagctcctggttccaaatggctcatttattgggggatataccacagagtttggcaagttattgtactttaaaattaaacctatatttgtttttgatggaggagttccagctcttaaacgtcaaactatcgctaaaagaaatcagtacaaatcaaaaaatggcttccgaagcagacagacttcaaaaacaactcctgagtacacttttgaaacataccgcaataagtaaaggtttatcagaaaaaacgaaagcatcattaccagttataaaaaagtctagtggaaaatatgacaatctgtatgctcccccaacagaagaatttgaatcagtggtgtcctcatcagatgacgacttagacgaaaaggtccgaaactacgactacagactccagtcctatcaaacaatggggatctacataccattgataccaccagtcattatttttagtctttaccggtagaagtaaaacatgatatattaacagatttaaaagaaactatgaaaacaaactcatggngtaagcttcatcagctttcctaacaaagtgatgactttttcatcttaccaaatgaaacggtggctaaagagaaaagaagttcaatctggattagatgaagtttccaaagaaatgggggggaaggtctttatctttagccgaactagaatctctcctcaaagatcagggaattaagactacaaatggatctaatata

SEQ ID NO: 17257 - DNA, 901 bp, Diabrotica virgifera
  misc_feature (3)..(81): n is a, c, g, or t
  misc_feature (83)..(125): n is a, c, g, or t
  misc_feature (133)..(171): n is a, c, g, or t
  misc_feature (173)..(244): n is a, c, g, or t
  misc_feature (257)..(446): n is a, c, g, or t
  misc_feature (448)..(621): n is a, c, g, or t
  misc_feature (623)..(666): n is a, c, g, or t
  misc_feature (676)..(707): n is a, c, g, or t
  misc_feature (709)..(851): n is a, c, g, or t
  misc_feature (889)..(889): n is a, c, g, or t
  misc_feature (892)..(892): n is a, c, g, or t
cannnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnncgcccactgnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagtttataaattattaatagttttttagtatanatntatttatat

SEQ ID NO: 17258 - DNA, 955 bp, Diabrotica virgifera
  misc_feature (642)..(729): n is a, c, g, or t
  misc_feature (842)..(842): n is a, c, g, or t
  misc_feature (909)..(936): n is a, c, g, or t
agatggtgctcctctaggtatgtaccgtttttattattacctatgacgtatataataatgtatatattcgtactcgcaaaaatcgtactcccattgccgataacgtagatacagtggcacaatcaacatggaagttaagaatatcttctcgagctttgaagatgctgcattaaatgtcggtctaaaaataaatgaagacaaaacaaaatacatggtcgtcgcaaaacaagaacgacggcgaataaggcaaaattagaattacataaactataataacttcgaagtggttaaagaatttaaatatctagaagcaacaatctccaatgaccacaaaatatatcgagaagttgaaatgcgaataatggcaggaaagatatttttctttgcaatgcaatatctaatgaagtcaaaacttctctcgccagatgcaaaaattcagatataatcagatcagcaatcgcatggaagagaaatatgaaagctaacaaaaagagaagtaaataaattgctggtatggtaacgtaaaatcctttggataatatcttggagtgagacaatagaaaatagtggcgcagggccgacaaacatagaaggcaataatagtaaacgcggcaacgagtcacgaagagttgtgacgctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgatgatgaggatgatgatgatctagtacgaagcatcgaacaaataagaggtgacgacaaggtttacatacattttagaataaaaccattttgtctaatttcataaataanattcttaatatcttcttctttctcataatccttattgcctttcagggcaacatgtcggataaatctnnnnnnnnnnnnnnnnnnnnnnnnnnnnctgttgcagcgagcctttc

SEQ ID NO: 17259 - DNA, 950 bp, Diabrotica virgifera
  misc_feature (407)..(430): n is a, c, g, or t
  misc_feature (724)..(741): n is a, c, g, or t
  misc_feature (833)..(833): n is a, c, g, or t
  misc_feature (900)..(900): n is a, c, g, or t
  misc_feature (904)..(905): n is a, c, g, or t
  misc_feature (911)..(911): n is a, c, g, or t
  misc_feature (915)..(917): n is a, c, g, or t
agaagaacttagttgttaaggaaatctaaaattatttaaaccgttttaaaggggataattgtaaatatgtattaatgtatatcttcaacagaaaaagttgagaactgcatcaaaaacttttggttaaaactttaattcgtgaatttagtttcttttctttggttgtcttatttaaatccttccattcatttctattgcatccaatattgctaaattatttaaaactgctaatccggtgtccaaaagccaacctttctatatctaaataaacataaataatgggtcaaacatgaatttcaaaatgaactttttatggtgaaagattctgtttccagatcagaagtcgttttcgaaatgttgaattttactccctattggaaaggatttccgatctgaaatacgaaacnnnnnnnnnnnnnnnnnnnnnnnnaaagatgattcctctaacaagttaggtatgtaacttgtttttattatatgtacttaatcgctcatattattaaaaaaatcccaattttatgtagatatatatctgagaatttattatattaatctgtacatatagtttaaacctactgtgtctagatatttcacagtattggtttagaagtatcgaacagcgtcactaaaatttgcattagttgtatttacattatgttgtttcttgaatccatccctttcttttaattcgctcacctgatttttgtttgtaagcttgactacnnnnnnnnnnnnnnnnnngttcttattttttgttcaacacaatctagaatgtttctaacttttcctgacctttttcattctcctttgtcattgtcctttctctctttctncacataatttcttacttatttctttttaatttccacttgcatcatttgtcgttaattctttttattntcanntaatanaatnnncagtaataacattgaaaataaatcctttgtttc

SEQ ID NO: 17260 - DNA, 278 bp, Diabrotica virgifera
agtggaccagtagagtggtagagagatgatctacacgtgattacttacgtattgttgtgaattgcgttatatttatatattgaaacaaaacatcataccattatcaacatgaaatccattatgtgaatcgtgtgtatcgagctgctatctaagggttacggattgatctgctgtaatgtaccccacgagaactcgtatatctcaaaagattgtagtgacatgaacatcgtgtgtgggtttttgatgaggggtcgagttgcagaggtgcttatagcttc

SEQ ID NO: 17261 - DNA, 784 bp, Diabrotica virgifera
  misc_feature (2)..(46): n is a, c, g, or t
  misc_feature (54)..(780): n is a, c, g, or t
cnnnnnnnnnnnnnnnnnnnnnnnnnnnnnnnnnnnnnnnnnnnnntaccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatta

SEQ ID NO: 17262 - DNA, 84 bp, Diabrotica virgifera
  misc_feature (37)..(37): n is a, c, g, or t
ataattaccttagggataacagcgtaattttattggnagagttcaaatcgataataaagattgcgacctccgatgtggattaaa

SEQ ID NO: 17263 - DNA, 541 bp, Diabrotica virgifera
  misc_feature (35)..(52): n is a, c, g, or t
aatatccttacctataaaataaccaattaataacnnnnnnnnnnnnnnnnnngatgataagtataaaatttgacatcatatattttagaatgaattaagaatagtgacataaaaagaccgatgatatggtgaatgaagatgctcttaatatgaatgtgaaaattgatatgatgacagaaataatggttaaaaatttcaagacatcagtcatgaatgttgatataaatagtgtactctgcttgtatgaatcatggatgtaaaattgatattgagttggattctggagatggggtattccagagtgtcccaatttatgaaggtaaagatcttgctcgtgtgatacttatataggagttatttggcagagtattgagtgattacatcatgaaaattttgaatgaacgtggctattctttcaccagcacagtagaaagagaaattgttagagatattaaagaaaatatctgttatgtaaggtttggaattcgaagaagaaatgttaacagtggctagtgccagttacgttgaaaatagttaggaa

SEQ ID NO: 17264 - DNA, 913 bp, Diabrotica virgifera
  misc_feature (27)..(61): n is a, c, g, or t
  misc_feature (69)..(97): n is a, c, g, or t
  misc_feature (113)..(129): n is a, c, g, or t
  misc_feature (131)..(477): n is a, c, g, or t
  misc_feature (479)..(523): n is a, c, g, or t
  misc_feature (531)..(585): n is a, c, g, or t
  misc_feature (587)..(634): n is a, c, g, or t
  misc_feature (648)..(862): n is a, c, g, or t
  misc_feature (865)..(865): n is a, c, g, or t
  misc_feature (899)..(899): n is a, c, g, or t
  misc_feature (901)..(902): n is a, c, g, or t
attaataattatatcatttattcatcnnnnnnnnnnnnnnnnnnnnnnnnnnnnnnnnnnnctcatccnnnnnnnnnnnnnnnnnnnnnnnnnnnnnggtaacggaaacggtnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnngccactgnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnctttattaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntanattaccttagggataacagcgtaattttattggnanngagtcaatcga

SEQ ID NO: 17265 - DNA, 132 bp, Diabrotica virgifera
  misc_feature (13)..(35): n is a, c, g, or t
  misc_feature (43)..(65): n is a, c, g, or t
  misc_feature (95)..(126): n is a, c, g, or t
gtttataattggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 17266 - DNA, 784 bp, Diabrotica virgifera
caatctctcgcgggtatatcacacagataatacacttattacgagaaatagaatccccctaggaaatagcgtggtgaagtatccaactgcttgttcgttacactttgagtggaactaccagcttatctgagagaaagtgagagtggcggattgtcttgcgtgaatcgattcaggtggacatttcttctcgtaaccgaaaacttctgcaaaaactggaactcaactcgactgatgcctatttcgctgcgcagcagactgtgcattgaacactgtgcaggtgaatttctcacccaaaattggaataactgttaattgaactcagatatcatcgaaccaccttaactacataagactacatggaagcagtaacactggcatcacaataggctccgacgaaacaactctgtttctttgtttagcatacggatctgcgatttacatatttctaaagaaacagcgaataccgatttacaagatttgcgaaagtgacgtactttactatatttatcagccttttagcgataaatacttgcattacgtcgcctatcatggacgcaacgatacatataaagggtatcgtatatggaagctacaccaactcgagatgatgttatgcctcatcaaccactagtaattattatatgtcaacagacatacgagcttctctgctagctttagatgacttcatctcttctgcaaacaatgtacggaacctcctgtgaccccaaactatagctcgaattattaccagtgaaaccaagcatgactacaagagcattatact

SEQ ID NO: 17267 - DNA, 69 bp, Diabrotica virgifera; identical to SEQ ID NO: 16440
  misc_feature (2)..(63): n is a, c, g, or t

SEQ ID NO: 17268 - DNA, 478 bp, Diabrotica virgifera
  misc_feature (2)..(102): n is a, c, g, or t
  misc_feature (105)..(154): n is a, c, g, or t
  misc_feature (157)..(249): n is a, c, g, or t
  misc_feature (253)..(312): n is a, c, g, or t
  misc_feature (314)..(335): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncannnnnnnnnnnnnnnnnnnnnnnnnnnnnnnnnnnnnnnnnnnnnnnnnntgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatnnnnnnnnnnnnnnnnnnnnnnnnnnnnnnnnnnnnnnnnnnnnnnnnnnnnnnnnnnnncnnnnnnnnnnnnnnnnnnnnnntagtgaaaaagattttatatttatatttgataattacatttacaatttataatatgtattgattcttaaaatacgtttataaattatattattagttatattgtaattaatatataatactaatatattaaaggatatttata

SEQ ID NO: 17269 - DNA, 802 bp, Diabrotica virgifera
  misc_feature (5)..(49): n is a, c, g, or t
  misc_feature (76)..(93): n is a, c, g, or t
  misc_feature (108)..(123): n is a, c, g, or t
  misc_feature (125)..(141): n is a, c, g, or t
  misc_feature (153)..(186): n is a, c, g, or t
  misc_feature (194)..(207): n is a, c, g, or t
  misc_feature (209)..(221): n is a, c, g, or t
  misc_feature (268)..(288): n is a, c, g, or t
  misc_feature (297)..(377): n is a, c, g, or t
  misc_feature (379)..(392): n is a, c, g, or t
  misc_feature (394)..(423): n is a, c, g, or t
  misc_feature (425)..(437): n is a, c, g, or t
  misc_feature (493)..(555): n is a, c, g, or t
  misc_feature (557)..(632): n is a, c, g, or t
  misc_feature (644)..(667): n is a, c, g, or t
  misc_feature (676)..(801): n is a, c, g, or t
tctcnnnnnnnnnnnnnnnnnnnnnnnnnnnnnnnnnnnnnnnnnnnnncgtgagagaatatctctctcattttcnnnnnnnnnnnnnnnnnncttttccgtacctcnnnnnnnnnnnnnnnncnnnnnnnnnnnnnnnnncttatctattcnnnnnnnnnnnnnnnnnnnnnnnnnnnnnnnnnnctaaccgnnnnnnnnnnnnnncnnnnnnnnnnnnncgtaatggaaaggtatctcgttttctcaatatatctaatttttctcnnnnnnnnnnnnnnnnnnnnncttatctcnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnncnnnnnnnnnnnnnggttaccactccacccccacacatcaccactcccaccccccacaaatttctcatcnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnncggtctttttcnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 17270 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (195)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngnaaggac

SEQ ID NO: 17271 - DNA, 365 bp, Diabrotica virgifera
  misc_feature (316)..(343): n is a, c, g, or t
aaacaatttagaaacaaagttagaaaaatgaaattcgcagttgcatttttagttttggcctttgttgcctgcgcttacgcccaagaagaaaagccagcattaacaccagaacaagttattgatatcatccaggagaacgagcccaacttagcgtgcattaatttggcatgtagactttcctgtaggagccaaggattcaaagctggatactgcaatgctgaggcaaactgtatttgtacaccgcctgtagtagttgcttgagcatgtgtatcaaattttaggatattccaattgtttttatctctaggcctggtgnnnnnnnnnnnnnnnnnnnnnnnnnnnngtacctctttttaatatgaatt

SEQ ID NO: 17272 - DNA, 399 bp, Diabrotica virgifera
  misc_feature (22)..(44): n is a, c, g, or t
ttagtggtatctgtccttatgnnnnnnnnnnnnnnnnnnnnnnncacttttaatggtgtaggatatatttagtttgattgttcctgatatccttaataaccgacgtgttaaggagacgggtgatccctattcggtaagtatcgataatctttctacaaatgatgtcgttagtttatgccacgatattgtaattagtccctcaatgatttttttcacattgtatcctcagtggtggatggctgtggaaataaactgttagattataaaacatgtcttaccaagaatcctaatagacacatttcacaggaggctataggtaataattatgaatgaatcatactattctttttgttgtgttactcctgtttgcaacttcatgtatggtatgtttacattagc

SEQ ID NO: 17273 - DNA, 86 bp, Diabrotica virgifera
  misc_feature (7)..(7): n is a, c, g, or t
  misc_feature (9)..(9): n is a, c, g, or t
  misc_feature (18)..(18): n is a, c, g, or t
  misc_feature (20)..(43): n is a, c, g, or t
  misc_feature (74)..(75): n is a, c, g, or t
taataantntttgatccnannnnnnnnnnnnnnnnnnnnnnnnaccttaggggatacagcgtaattttattggnnagagtcaatcg

SEQ ID NO: 17274 - DNA, 977 bp, Diabrotica virgifera
  misc_feature (875)..(875): n is a, c, g, or t
  misc_feature (915)..(915): n is a, c, g, or t
ctcctcgcgtccgtgggtactgtgggtaggtaaaaataccgaaatccaacatgaatacttgtgatattattcaactgttaaataagcaatatgaagagccttcctttgtggtcaattcccttaacatcgattcaactaacgtcgggcgaggatttacaaaggaccccaaagataaaaaaatacttaactacatagtacagacccattctttgtctgtttcacaaattgttgacgataaattggtaccagtagaatctattggcgctttcgttaatactaatacatatctagttcattgggcctttaccatggtctatgaacaaatggaattgatattagagaatgtgttcttttattggaagggatccaaagcgcccaaagggctttctccattgcctccagatgttgataacgagactgctattgtcaatagaatcgtccaatggagtgaacctccagtatttttccatttgttggaagaaaaacgtatggtcgtcttcgaagacaattttgatccttcaagtccacatttatttattgtacttggtgaactttccgaggagttgcatttatatgaagtatcatttatgaagaaaaacttaagaagtaggggagtgtttgttatagcagtaccacaaaagaagactatatatatttggaaaggttcacagattacaaatgagctagatgcagtagtcaaaggagcatgtttgtttaatacagtcagaaattatgtagattcctggaaaaattttgaaatattagagatgaaagaaactgaagaggatattttgtttgaaggagatactagtgaatattggcacgttaaggaagtgtgtaattattcaccaaaattgtctttctaaatacataantgggggattcgcagctacagaagtgggatatcctttacgnagtaaagattgtgtggcagcttttccatttttacagtctcatctatctatatctgacgatct

SEQ ID NO: 17275 - DNA, 820 bp, Diabrotica virgifera
  misc_feature (22)..(40): n is a, c, g, or t
  misc_feature (146)..(179): n is a, c, g, or t
  misc_feature (193)..(399): n is a, c, g, or t
  misc_feature (401)..(565): n is a, c, g, or t
  misc_feature (567)..(581): n is a, c, g, or t
  misc_feature (596)..(617): n is a, c, g, or t
  misc_feature (619)..(676): n is a, c, g, or t
  misc_feature (678)..(719): n is a, c, g, or t
  misc_feature (721)..(737): n is a, c, g, or t
cccccgccccctctccgcgccnnnnnnnnnnnnnnnnnnncacactacaatcttttttacgtaaaagtaaacgaaaaattcttatcttaactgactagcttcaattacgcacttgtagagacgaatatctttatcttttataaacnnnnnnnnnnnnnnnnnnnnnnnnnnnnnnnnnncattattaattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncattaaaaaattgcnnnnnnnnnnnnnnnnnnnnnncnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnncnnnnnnnnnnnnnnnnncgctaaggtagcctaatcattagtctttttattgaaagctgcaatgaaggcctggaccgaaaaaaacctgtctttatttaatt

SEQ ID NO: 17276 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (161)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggtagttnnnnnnnnnnnnnnnnnnnnnnnnnnnnnnnngaaagga

SEQ ID NO: 17277 - DNA, 520 bp, Diabrotica virgifera
  misc_feature (281)..(300): n is a, c, g, or t
  misc_feature (302)..(315): n is a, c, g, or t
ctcctcgcgtccgtaaaatacttcacatcgctcggttcgcgccttttgtttgagttttccaaagtttttgagtgttcttatatataatcggagtgtagatgagaccctatatagatcccacctaactattatgtaaattgaacgtttaggtattgaaaacaatggaaaaaataatcatttttagaatcaatatagtatctgaatatatttagtttgttatgacctgatatccttaaaaacagacgtagtatagaaacatgtaaccaatgtatacaatatcnnnnnnnnnnnnnnnnnnnngnnnnnnnnnnnnnngcatagatatagaaatattccctaacagaaactattcaaaatgtatcctcagtgtttaatgagtgtggaaaaaaacaagacataattaaaaatgtatatcaaagaatcataataggaactattctatgtattctatggactactagattataaatcaaacattatcataaatagattatatataaagactagataaaaacttcat

SEQ ID NO: 17278 - DNA, 928 bp, Diabrotica virgifera
  misc_feature (650)..(667): n is a, c, g, or t
  misc_feature (745)..(745): n is a, c, g, or t
  misc_feature (797)..(797): n is a, c, g, or t
  misc_feature (824)..(824): n is a, c, g, or t
cggacgcgtgggagtgttattaagaagtatcgctcgaacaaggaaaaatcgacgacagaccacgtatttggtaaggtgatcgcaggactttttaacactcccgatcacttatttcgtatttgctcgtctttttctataaataacaaacgtttgttatagtagaagacagcaaatacaaaataagtgattgatgtggtcatttatcgcgtattctttcatttttctgaccggatcgtacctttaccttcacagagtgttcttcgtacctacataaaagaaataatttgtgttatacttttctactttaaatacttttttaattatgcaaatggaagaatggtgcgtgttccactccatattgggtaattttttcatgtgaattcacaagaaaatctaaggtccattctggtccaaagtgcctcacgctggacgatttgttttaggatgaccttaatcttgtctaggctccttttttctttatctccatattatcccttttatagattaccatattaaatgagttaaccccgataaagactgttcttgcctttctatccatcttcattatcatcacttttttatttagtatattacgcatattccacattatcattcaaatatttgtcttttcaaatacattgttcatatcnnnnnnnnnnnnnnnnnngattttctagcgaaattaatagttttgtcgtcaaaagttatgtatagtccatttcatgaatgtatgactgtcaacganatattttagtgtgcaacatatgaaaataagaatatttcttacaaatcccatntctttttattgggataattaaagcaantttatttttgtacttctaatgttgcacagtaatattcgttggtctgatgatccaaaacagtcgatattcatggaatagactgtagtagctccaatacgggaaat

SEQ ID NO: 17279 - DNA, 856 bp, Diabrotica virgifera
  misc_feature (21)..(21): n is a, c, g, or t
  misc_feature (746)..(792): n is a, c, g, or t
  misc_feature (795)..(795): n is a, c, g, or t
aatacctaaaaggcacccttngaagaagaacagaaggtactgaatatataaaagagaaagacttcctgattgccaatggcaactccataacgtaagaaatcaaacaaagaataattttatctatatccaagatggatgaaagcctcttgcttatatttgaacaaataatcctgagaggtatcttcggcggtgtctgtgaaaacggtatttggaaaaggatgtacaactatgagatataccacaaatacaaatatatatcaaatggtaaagacgtgaaatctcttataaaaataggaagactaagataagccgaacatctagcaagattgcggcagaacaacccttttagaggaatccttttgttatagccagcgggaaatagatcgagggttaggacaaaacttagataaaaggctgaaaaaatgaaataacacacagataaaccgcattaatgactatggaatttactttatggaaaaaagactatatatagagactaattgtacacttcatgtacaacttggtgtcgtatctataataacgaatagactcttgtattccatgtcatctaacaagactcatgtaattgtatatcgtaatgatagtgaatgagcttcaacttgagctgcgtttatatcattatgaaacagcttagttttagtctcttgatgactggtcgttgggatagtaatcctgttctgtagaagaggaaccacaggttcggacatttagatgacacattcgannnnnnnnnnnnnnnnnnnnnnnnnnnnnnnnnnnnnnnnnnnnnnnctntagagccatattctttcttcttaaacgcagatcaatatgtactggtgcatcatcatcatca

SEQ ID NO: 17280 - DNA, 108 bp, Diabrotica virgifera
  misc_feature (5)..(107): n is a, c, g, or t
aagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17281 - DNA, 1001 bp, Diabrotica virgifera
  misc_feature (804)..(804): n is a, c, g, or t
  misc_feature (812)..(813): n is a, c, g, or t
  misc_feature (901)..(901): n is a, c, g, or t
  misc_feature (907)..(907): n is a, c, g, or t
  misc_feature (935)..(935): n is a, c, g, or t
cccacgcgtccgtgcaaaagaaacgaacagtttgtacgatgcaacacgaacacagagaatacagtctccagagtctacctctagacaaaatgaagtgtgtcatcaaaagctacgatctgagttccaacagcgtcacagccatccagcccttcggtttggaaatttcggccagcacccttatatgtgtggtagctagatatattcaaccatagatagaatttagacaccatagaacttaaaaagatggttttgttattaagttttggagaaatatttagtcgataaatgttttatagaaaacagtatagaattataataagttgcagtttagatagcgtgtacgttgccttgttgttaaacagcttctttgctctaacgacttggtgttattcacagtagtcaatttttgtgcaaacaacgtaggcgattagaaaatattttagaatttgtcgaatattgttggctacagcattacagtttttggtacatagacaatttgtcaattattcttaaaaaaatgattctataaaagaacattgtggtaccagtgtagccaataatacgaccagaacagtatagaatggcaaattaaaaatttgataaatattacgaatcaaaaatagtctgatgaaagctacaagacagtatataaataaacaactttgacaaaagcaatacaggtaaaatttgccattccattttgtattttatataaaagtactaaggttctttatcctatatatttactgaaaattaaaaaatagcgtaccactcctcgctatatgattgtgtctcttgcaatanatatatgnnggaaaccgaagtattattgtatacatatcatatcgtagactttactggaatactaagggtagtgataaacatccaccattacctattntgtccnttttcactctataaacacgtcaaaattngacactctactatttataaaaaggatatcttgtctttctagtgactatgcatttatatcaacttct

SEQ ID NO: 17282 - DNA, 518 bp, Diabrotica virgifera
ctagtctaaattaaacgtaaaagagaaaagacataataagaacacacgatgtcaaaggctaccttagttgcatttttcaccataatttcagctagcttctgcttgggctgcacaaatccagaagttagttcaaaatcattcaccactttagatgccacaattgtaacaaatatcgcctatatttctgaattttcaattaaatgtggatcaggaaaactaggaaacttgtatgctgccttgaatggacacattagccccgtttctctagttggaaatgacaaattccaagtaagttggactgaagacataaaaaccgccaaatcaggtgaccgtctgatcaaattatatgacgaagaaggttacgctgcctataagaaggctaatcgtgccaacgaggatgtatcatccgtaccttcctttgcagatgttgtcgatacaaactcagctgctgactatggacaatgggcgtcgatctaagtatttggaaccatcctatgtttaactagctgtcctaagat

SEQ ID NO: 17283 - DNA, 253 bp, Diabrotica virgifera
  misc_feature (7)..(31): n is a, c, g, or t
  misc_feature (34)..(77): n is a, c, g, or t
  misc_feature (88)..(123): n is a, c, g, or t
  misc_feature (131)..(243): n is a, c, g, or t
atttatnnnnnnnnnnnnnnnnnnnnnnnnntcnnnnnnnnnnnnnnnnnnnnnnnnnnnnnnnnnnnnnnnnnnnncgtgagagaannnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcggt

SEQ ID NO: 17284 - DNA, 935 bp, Diabrotica virgifera
  misc_feature (92)..(115): n is a, c, g, or t
  misc_feature (128)..(145): n is a, c, g, or t
  misc_feature (179)..(201): n is a, c, g, or t
  misc_feature (427)..(447): n is a, c, g, or t
  misc_feature (526)..(545): n is a, c, g, or t
  misc_feature (610)..(658): n is a, c, g, or t
  misc_feature (798)..(818): n is a, c, g, or t
  misc_feature (871)..(871): n is a, c, g, or t
  misc_feature (885)..(886): n is a, c, g, or t
  misc_feature (903)..(903): n is a, c, g, or t
gttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatatacagattatcctgatgtatttatattatgaaatattgtatcttctattggatcactaatttctttaattggggtattnnnnnnnnnnnnnnnnnnnnnagaagctttttcttttcaacgaaaagattaagacctttaagaataacttcttncattgaatgactanncattaaccctccagctngacacagatattctgaattttgccatatatca

SEQ ID NO: 17285 - DNA, 944 bp, Diabrotica virgifera
  misc_feature (110)..(127): n is a, c, g, or t
  misc_feature (170)..(187): n is a, c, g, or t
  misc_feature (714)..(714): n is a, c, g, or t
  misc_feature (769)..(769): n is a, c, g, or t
  misc_feature (835)..(835): n is a, c, g, or t
  misc_feature (844)..(844): n is a, c, g, or t
  misc_feature (891)..(891): n is a, c, g, or t
tgtagccatattacaagagaattcctgaattcattttaaatcaagtagtatatcatgacataatcattgcagaagtggattatacaacgaaacaaattaatattcactgnnnnnnnnnnnnnnnnnnagaaatagaaaacaagaattaagttataatcttacgttaaagnnnnnnnnnnnnnnnnnnctgaagtgtcaacaccgcaactgtcaaataagtgtaaccaatttatgcaaaaagtcaccttcgttcgatcgcagttaaagtgtgatccggacaactgtgcttcataaaaacgtttcattttataatccatacaaattaaatgaaacaagttatggtatatttctttaagtttacattaatagaaatcttctaatattatttctacgcttatgtaataaaatatgtcgagtggctgtaattccagtgtactaaacgaatctaaaaaggaacaaacctacgacttaattattttgtgttggtatcatgtgacgtcacttgctatgacgcggatgacatgcaacggaatttataatgtacaaaccataccatttatgaaaaattaaggatttttagttagcaaatatcatgaataattataggtctatgagtagttttattaaatgataactgcaaagaaaatggtgcaaaatttctattgatattttttagataaacaataagttgtactaacacatacatatatctanataaagttgttacaaatgtaaatcttcaaataataatccattctgtctcatcganaattttgagtggtattacccattccaagccccaccaagcagtctggcccagactggcttgagcccnaaattgaancatctgtttgtcgaataagatgattgaagcttttattaacttattgncttgctttgatgagaaagtaccatcagcaatctgaaatatatatacatatata

SEQ ID NO: 17286 - DNA, 897 bp, Diabrotica virgifera
  misc_feature (8)..(8): n is a, c, g, or t
  misc_feature (637)..(660): n is a, c, g, or t
  misc_feature (845)..(845): n is a, c, g, or t
  misc_feature (856)..(856): n is a, c, g, or t
  misc_feature (872)..(872): n is a, c, g, or t
aaattttntgagtttttagggtataccaagggggggcggtcgccgatcttgcccaggacggcaaaatccctagggccggacctgcttcgactataaataagaatgaagttttgtgtagtaacgttctctttttagtgtcaagccatagtcgtggggtttctgggtgctctggtggcagttgtaatgggtggcatcaagagcaacgatgtcgaattagaccacgtatatcttttatgtgccagtagtctagtaacagtttcgatagctagttttttattgggacttattacagctggagtgatagtactgtccagatattgtcacatcaatccagacaatgtagctacgcctatagcagctagtttgggagacattacatcgctagcattattgtcatgggtggcaaccatgttatatgaatcaataggaacacaagattggttggccccatcgataatagcagcatatttactggcgatacctttgtgggtatggattgctaaaaggaactaccaaacccgagatgttctgtattatggttggacgccagtaatagcagccatggtgataagttccattggaggtttaattctggactttatggtttctagatttgagggtattgcagtattccaannnnnnnnnnnnnnnnnnnnnnnnaatctagtagcagtacaagcgagcagaatttcaacagctcttcataaacaagcagaacttggtatacactcatcagaaaataacacagacaaggagatggttattttcatatctccattaacttgcttttgtggaaaagacatgcattccagaaacacgagggtcttatggcatggtaataccgngtcattaattntcatctacctcatagnatacataaagaatggcgacacttct

SEQ ID NO: 17287 - DNA, 128 bp, Diabrotica virgifera
  misc_feature (5)..(40): n is a, c, g, or t
  misc_feature (48)..(50): n is a, c, g, or t
  misc_feature (52)..(124): n is a, c, g, or t
aagcnnnnnnnnnnnnnnnnnnnnnnnnnnnnnnnnnnnngtttatannnannnnnnnnnnnnnnnnnnnnnnnnnnnnnnnnnnnnnnnnnnnnnnnnnnnnnnnnnnnnnnnnnnnnnnnnntttt

SEQ ID NO: 17288 - DNA, 813 bp, Diabrotica virgifera
atttagttgtcagattgacgaggagataatcatacactcgattaaccatagcgattatactttatatttcatagcacttgcatgagacacagtgtaattacttatttaatgcagttaaaagggcatccagagttatgtttatgaatacatttaatttgacccaaaggacctttaggagccaatccactaggactgactttgaacttcttatctaccacccctatttattatattgacctccctacccattgctttatatgtatgcaaacatgacagttatcaatcgctacctgttagcgagttattagctactcagaactactagtgatacggaacctatgaatatacgtatgccgcaaaagcagaatatgttgcatacattgacctaaatacagaatcagaagctaatgcttagctgtaatatgcacttagcatctataaaatcgctgtgccgtgtgcatttaagagttccatcattacatactgcgaaagaggtgatgccttatcgagatatgctcgccattagaaagtgaattattagcctgttttgcccatgatctccatgccaaatcatacccacgcgtctctgctagacaataagatatggacattgtaactatcagggagaatgacagacgtagaatatagctatgttagaacacgagagaagtatcatgctagtaatatatagaatggaagtcgtgacagaatccaatctctgacagagatgcaagtgttgctttcgactgccgaagatcagtggtacgaggaagatagcgactatacataaagaacacattatgatactctctg

SEQ ID NO: 17289 - DNA, 934 bp, Diabrotica virgifera
  misc_feature (509)..(538): n is a, c, g, or t
  misc_feature (758)..(772): n is a, c, g, or t
  misc_feature (793)..(793): n is a, c, g, or t
  misc_feature (850)..(850): n is a, c, g, or t
  misc_feature (854)..(854): n is a, c, g, or t
  misc_feature (857)..(857): n is a, c, g, or t
  misc_feature (868)..(868): n is a, c, g, or t
attaaataattataaaaccaagtcttcaaagaatattataaagccaattatgtaactatttaaaaattaattcaaagttttgtttccgacgaaataaacttttaatgagacctatttctggttacgccttcttggtttctattatttgcaaatcataagaatgttggatgaaagaagacaaagggagatctaagattgcacctgtctatccaacttggcaaaattccaacgaaaagtaggtctcgatactcgaattttgtcatgaaacgaaaacaacaggtgtattatatttcaatttgttcagagagtgccttaaacaatcttactagtttcattcttattagaaatcattagagattgtataaatggaaatctctgaacaaaacaaaataaacacagccgatcagtatcgaatcacgactaacaaataggtacggatgccgtagcggcatctgcttacaacaattcaaagttttgtatccaaagaaataaacttttaatgagaatcnnnnnnnnnnnnnnnnnnnnnnnnnnnnnntctttaaagtatttgaaatgttattcgcttgtgtttgataaatagtaaaaattagatttgttctcttaaattaacatatttgtaagatagaacaacttacttagcaaaacattaaaaatactggggacagaacatgttagaccagcgtttcccaaccggtgggtcgcgacccactagtgagtcgcgagcggatttcaggtgggtcgcggcgtggctcttnnnnnnnnnnnnnnncgtaaatatataacatcatgngtgagggatgggtcgcgaatatgaaaaaacatcagaaggtgggtcgccacacataanaggntgngaaccactgtngtagacgatacgcatacgagttccactacatatatccgtctatagcaatctatttactgcacctac

SEQ ID NO: 17290 - DNA, 531 bp, Diabrotica virgifera
  misc_feature (4)..(328): n is a, c, g, or t
  misc_feature (330)..(360): n is a, c, g, or t
  misc_feature (369)..(389): n is a, c, g, or t
ctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnatatttagnnnnnnnnnnnnnnnnnnnnncaggattctatggaacatatttttcacgtaatattaacaacatttcttgatgttttactcctgttttcaacttcatgatggtatgtttacatgaatgacatgtatgatatgattctcaactgtctgaacattaattaattat

SEQ ID NO: 17291 - DNA, 674 bp, Diabrotica virgifera
  misc_feature (2)..(668): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggg

SEQ ID NO: 17292 - DNA, 634 bp, Diabrotica virgifera
  misc_feature (2)..(181): n is a, c, g, or t
  misc_feature (185)..(205): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcannnnnnnnnnnnnnnnnnnnnatccctgtcaatcaatcgctctgataacacaatttttgactacctttgtccaattcaacagtgcattttatgatagatatgcactaactgaaataatttattatacatttcaaatatttcatgatactggtaacccacttatattagttccacatctgatgtaataagaactgtctcgaccccgtaaactctattgtccatagacctatactaaaatgcaacaatccttcgaattatacattatgtataagtgacaccaacacttccttcgctattgctcgatatgtctatgactcgcaaaattcagctacctaccataccatttactattaatgatgtccctgtattacgtagtattaatgcatcatatgctgtctcatcggctatatattatacaataacggcaaagaagaaggcgcctgacttctt

SEQ ID NO: 17293 - DNA, 870 bp, Diabrotica virgifera
  misc_feature (2)..(16): n is a, c, g, or t
  misc_feature (18)..(60): n is a, c, g, or t
  misc_feature (68)..(180): n is a, c, g, or t
  misc_feature (189)..(598): n is a, c, g, or t
  misc_feature (607)..(766): n is a, c, g, or t
  misc_feature (768)..(798): n is a, c, g, or t
  misc_feature (803)..(825): n is a, c, g, or t
  misc_feature (836)..(836): n is a, c, g, or t
cnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnattannnnnnnnnnnnnnnnnnnnnnnattatttatantataaagttatttaatttgggtgattaaaaataa

SEQ ID NO: 17294 - DNA, 966 bp, Diabrotica virgifera
  misc_feature (23)..(41): n is a, c, g, or t
  misc_feature (304)..(341): n is a, c, g, or t
  misc_feature (797)..(797): n is a, c, g, or t
  misc_feature (887)..(888): n is a, c, g, or t
ctgctggtgttgtacgaaatacnnnnnnnnnnnnnnnnnnngtactaatgtaaaaattaccgaagggcgcctattctagttttgcagacgggcaccttaaccgctgtgaacttgtaggtagaggagataattaaaagttcgtgagcgccagtagtgacaagttggtgaacttcggttggaaatttgatataaatgtgaaagtgaataatttaaaacattgaaattaaaaacataggaaaaaatattagttggccaaagctgtggcatatatttttgtcttaaatttacttacgttttagatacnnnnnnnnnnnnnnnnnnnnnnnnnnnnnnnnnnnnnnatctgttaatctagcgccataatatgtgtatattatacacaataagtgtgaaactatcggaagcaggaaagaagtaaactaatattccagcattagtttaattacacaaaatacaaataaactgttcaaaatatatatatttcgttgaaatcatatataatagatagacaataattattatttgctactattcgcaatacttttctcattaaatgtccaaccgaagttgaactagtaatccgctacttggcgataccagcgaagctcacagcgaatagttagctccgggactgagagacataacagaagcccacagttagctagtgcgcctacaccttaacgatagtgacatctttcgtattaacttgaaataaaatttcgtaacatccgatggttagggttgattccaataatagaatttacctatttaacggtttaatacatgggaaagagaanaacgccacggaaaagtggtttgatgtggattttactaaatatatacattatacaggatgtttcattgataaagaatgcttctttgtctcnnaatatgtttgtgtcttcgagagtcataatattacattagcattacgattttgagcatatatgtatccaattaattttt

SEQ ID NO: 17295 - DNA, 142 bp, Diabrotica virgifera
  misc_feature (2)..(92): n is a, c, g, or t
  misc_feature (110)..(110): n is a, c, g, or t
  misc_feature (113)..(141): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtgatcaaaaaataanttnnnnnnnnnnnnnnnnnnnnnnnnnnnnnc

SEQ ID NO: 17296 - DNA, 802 bp, Diabrotica virgifera
  misc_feature (7)..(801): n is a, c, g, or t
ctaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 17297 - DNA, 687 bp, Diabrotica virgifera
  misc_feature (10)..(10): n is a, c, g, or t
  misc_feature (29)..(29): n is a, c, g, or t
  misc_feature (384)..(404): n is a, c, g, or t
tttcaccgcnggccgccggagtgaggagnttccagatcttctgctttttcttctctaagaatgtgatacatgaatatttaggaggataaataagtaatacatttgttagagaaacagtgatggacaaaatgacacctaaaaagactgcagaagccagaagggttgacaaagattttagactatgcagagcattttatgaagaataacttcatcttcgtaaaattgataataaaaaagtttcccatatggttccttgctacgcagacatactgtataagagcttctgtataagaattttcaaatggtaatgccatattcggattcagcataatcaaaaaccaaatagaaacatattggatcaaagtaaaatgatgaattcaacgnnnnnnnnnnnnnnnnnnnnncaaaacaataattgttattgtttaaacaattaataaacaattagcgtcaaaatctgcccggcctttggtgtgagacacattcaagttattttcatgttcttcttgtacctgttaatgtatggaacacgatatagtttctcagtggctttggaagcaatgactcagagaaccacatcaaatcccgaaatacaggtatacaattggaccaacacagggattcttcactctaccttcttctgtagatacgttatcccacacagacatagatctatactgcgtatac

SEQ ID NO: 17298 - DNA, 748 bp, Diabrotica virgifera
  misc_feature (2)..(46): n is a, c, g, or t
  misc_feature (53)..(743): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttta

SEQ ID NO: 17299 - DNA, 733 bp, Diabrotica virgifera
  misc_feature (441)..(459): n is a, c, g, or t
  misc_feature (593)..(613): n is a, c, g, or t
atagaattgtagaacatattatcatacctacctcctttttaaatggcaaacggagaacaaacatttgagtcaactattcatttatcagtcaccctgtacattaatagtattagcttatacaattttattctccgtttgccatttaaaaaggaggtaggtattatagaattgtagaacatattatcataccagatattactcaaatgatccatatataaaaatggtgtaatgagttcatatccgataatggatgaaccacgattttttacaaatatgtttcaacttataaatataatataaaaaaactgaatagtttacttttatagtatatactattactttataacacattagttgttttagcttaaattggtaaaattttgacccttgatctgtttttggtcaagtttctcctcttatgaactgattacctatattctnnnnnnnnnnnnnnnnnnnggatcatttgaaataatggtaattatttgtattaggtacttaattctatttcatgaaacaatatttttaacagttgttaaaatctgcacatgttcttttatccactagtaacaattttatagtcgtctctctannnnnnnnnnnnnnnnnnnnnctttaattattagtaaaaagtgaatttgaacaaatcttttatataaaaaatgaagactgatatacctaatatggaattttctgttcagtcgaagtatttaattacgaataaattaatttt

SEQ ID NO: 17300 - DNA, 731 bp, Diabrotica virgifera
aatcccgaatactatccgacaatacttgtacttctcctttttttatcagactcacctacatctgaacaatatatacttatatagtcagagagaagatcatatatatctctttctgtctgtggtgcctttcgtgatgatatccagtatatcggtacgagtgttcctcctattaatagtatatatcacagaaattttctgtcacctacaaccttacattccacactggacctcccaacacttactgcgccaatctcgccatctagtaatatatatgactgaggactccattatcaattgacttttgagacgaatatatgatgtatgaggattttttttcgtaagtggttcgcaaagttaaccgcaggatgacattgccgtatcgatgaggcgatatttcttcttactagatatttttacattcttcgtgatcagcgtctctcgtaccattgctatctctcgaagctgttgagactgtggaccttacggtttaagattttttcttgaaagactctctagtactgttggctctgtgttattttcgacccttctcctttcacctcgagatcctgtagctctattgtgaatactgccatatgcggtatcgatataccatgtttatccgatgctgtagaatcgctcatccccgatatctacaccactcatcttagagctgcggaaattgctgattgcatgtttgctgctcgacttgaagctattgctttaacatataa

SEQ ID NO: 17301 - DNA, 199 bp, Diabrotica virgifera
  misc_feature (24)..(24): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (134)..(134): n is a, c, g, or t
  misc_feature (155)..(155): n is a, c, g, or t
  misc_feature (170)..(170): n is a, c, g, or t
  misc_feature (174)..(191): n is a, c, g, or t
taacagcgtaattttattggagangttcaatcgataataaagattgcgacctcgatgttggattanagtttataattggnnnnnnnnnnnnnnnnnnnnnnntgttcgannnnnnnnnnnnnnnnnnnnnnagnttaaaccggtgtgagccaggntggtttctatctttnattnnnnnnnnnnnnnnnnnngaaaggac

SEQ ID NO: 17302 - DNA, 642 bp, Diabrotica virgifera
cctccctacgtccggttaaaggagaactcattcgatttcctgcctttagtgtcggaattaatggaatgccaatcgtaccatggagtgtagaaaatgtgttgaaatttattaaggacgcaatataaggatcctattatactaatttcggaagtaggtacttctgaagacggcacttctttacaccatgcaattcgattattttttaatgcaatagcgttaaatgttatggacgttaatattacttgattatgacatatagggacaagatactaccctaccagagctttaattaatgcttggctaggtatgaagaacatttagccatcacacacttccttaatgtctacaaccactccgggaacagttcttatctttataattgtttcacacaaagaactaagttatggatgcctttactatctgtgctttgctttacttacgtgaaattttccttttgaaataaatgcctgaccatttaaacaaatatccctatgttatgttattgttacatctaccttaaatgacgttagagcattacttacgccagaaaatctaattgacgaatatcttgtacatatgatagagaatatatcaatacatttctaccttgatcttctccaatcaaaaaaagaaggttactaa

SEQ ID NO: 17303 - DNA, 634 bp, Diabrotica virgifera
ccctaagcgtccggtttcgaatttaaatatatatgtattacacttttgaaaccgcgacgagtaataagattattatcaattattcttaataataatagattacagaaaatattaggtgttctctaaaaaatgacaacctataaatgttgacttgtcggacaaggagtgagtgacatagacacctatgtttaaaactgatgatatgcgatattctaaaataaaattgaataatcattagaaagttataatcaccctttaatttttttcagattatatgataatatgcatttaaagtatgcaattctttatatcaattaaagaaaggtgaacagacagaagtaactacttccgtcgattttgttacattagtatatttgatactacttctatagtcaaacacagaaatgctccaaatcagtacgatgatcttgatagagtgagagaaaataacccaattttattgagttcaaaataagtttacttcctgcaatcgaaagataaggattagaggttggtctctacacgattacaaaatttataaaatgatgacatctctggttgatccatctacaactttgaaaaacccgtcaagtggatatatagcagtctcattgcatatctcaaattagaattc

SEQ ID NO: 17304 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17305 - DNA, 379 bp, Diabrotica virgifera
gaacatttacaagaaaattatcaagaataccaagaataaaatgacttcatatacattatacaaatctattcttcagtttgaccatacactacccgcttcatatgataacagctctgttatgatatcgcacaagaaggatatggacaagatgtttgttccttactgagacccttcgagtgacgtccgacatggagaaaggtattcctattctgaaacttcatcgtttgttccacacatcatgtcgattgtttcctaacatattactttctgttacctgtatgattgtaactaaaacctatctcatcagcgagtggccgcccgttaacaacctatgtgatacctacaaaaaatgttgtactaccacttcgaacaaacatat

SEQ ID NO: 17306 - DNA, 607 bp, Diabrotica virgifera
  misc_feature (275)..(290): n is a, c, g, or t
ctctttacgaagaataaagggcactcgacatatttttgtacaacaggtaacatgaaatattcattctcagagcataaatgaaattttatgtagcttctcttgctgtgaacatgtttgatgaacctagacacatatatttaattatggtcatgaggactgtaacattttatagtgactgtgttgttggaatttctcgtgactgtttttatttagtttatagggcatattactttggtagtcaaattgacgtgttcattatcgtataacacacagannnnnnnnnnnnnnnntaatttattctcgcgaatctttggcatctgcttattcagcattcatagtttcgcttgaagaggtgagcacgcaagaaagttcgttattttgatagaacgcgattgctaagccagtgttggtgctgtcaacatagattatgctactgctatagaaataaggatattggagtctgacaccacgacgtgtactaagctgatcgaaaagttgaagtgctggatgaaaagtttagcgcaagaggttgaccgagaagatccgatatagctgtctcccatcctcttcaaatgctagacggtcccgtattgcattctaagaggca

SEQ ID NO: 17307 - DNA, 592 bp, Diabrotica virgifera
  misc_feature (2)..(46): n is a, c, g, or t
  misc_feature (53)..(585): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccacg

SEQ ID NO: 17308 - DNA, 123 bp, Diabrotica virgifera
  misc_feature (57)..(81): n is a, c, g, or t
aaagaacccgtgaaccagaaaatatttcgacattgataagcaagtcttcgtgcgagnnnnnnnnnnnnnnnnnnnnnnnnntttattagtgcctctgaggcttttagttttgatttcagtact

SEQ ID NO: 17309 - DNA, 903 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (635)..(684): n is a, c, g, or t
  misc_feature (689)..(797): n is a, c, g, or t
  misc_feature (805)..(805): n is a, c, g, or t
  misc_feature (820)..(820): n is a, c, g, or t
  misc_feature (829)..(829): n is a, c, g, or t
  misc_feature (842)..(842): n is a, c, g, or t
  misc_feature (855)..(896): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatggtttttaataaacaggtgaaaaaaatggttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattnttatttaaaaattanatttaatanaatttattttaangctcatccctaannnnnnnnnnnnnnnnnnnnnnnnnnnnnnnnnnnnnnnnnntattggg

SEQ ID NO: 17310 - DNA, 197 bp, Diabrotica virgifera
  misc_feature (6)..(110): n is a, c, g, or t
  misc_feature (119)..(164): n is a, c, g, or t
ggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatgatnnnnnnnnnnnnnnnnnnnnnnnnnnnnnnnnnnnnnnnnnnnnnnagttaataaaaggaatccgcaacattttttttc

SEQ ID NO: 17311 - DNA, 944 bp, Diabrotica virgifera
  misc_feature (3)..(854): n is a, c, g, or t
  misc_feature (859)..(943): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 17312 - DNA, 700 bp, Diabrotica virgifera
ggttcatctgtctagagagaagagatctacttctattatcaacagtgagtgacgaagatgaacgagatgtcttgtcatctgtgaaagatacaaaattatatataaagatgttgtagagaaacgtgactcacctctagtcatattcagccttattggtagatcagccaaattattttgttgacaagcgatgatatgacacaatatttctattacgtaagaaataaagattcttgcagatgagcttcactatcattatttatatacacaattgagctagttaaacatgacctagtgcttcagaattgacaaatttaagaaatcgacattattaattttaataacgggtaattttaaaatttaatcaatttctaatcaaaatatagctatacaatatctacatctaggaaagatcgcatatattaatagttggctgattgcatattcagtatccatatgtaatgttagaaaatgtgatcctagtctcagttgaaatcatctgagtattataaacgtggatgatttggaatataaaagaagaaacgcctgaccacgtgatcaatctaactgtacgagagagctttgaacgtaaatcattgggttgctcgttagtctttaaattgaaatgcgaaaggtacgtgaggatgaaacaatggctgccttcaatcaatacatacaacatgcgattgataaagtaaaaacc

SEQ ID NO: 17313 - DNA, 177 bp, Diabrotica virgifera
  misc_feature (6)..(83): n is a, c, g, or t
  misc_feature (89)..(117): n is a, c, g, or t
  misc_feature (122)..(167): n is a, c, g, or t
tgttgnnnnnnnnnnnnnnnnnnnnnnnnnnnnnnnnnnnnnnnnnnnnnnnnnnnnnnnnnnnnnnnnnnnnnnnnnnnnnncgaggnnnnnnnnnnnnnnnnnnnnnnnnnnnnngtagnnnnnnnnnnnnnnnnnnnnnnnnnnnnnnnnnnnnnnnnnnnnnnggggtgattt

SEQ ID NO: 17314 - DNA, 905 bp, Diabrotica virgifera
  misc_feature (728)..(745): n is a, c, g, or t
  misc_feature (770)..(770): n is a, c, g, or t
  misc_feature (845)..(845): n is a, c, g, or t
  misc_feature (877)..(903): n is a, c, g, or t
attatttttaaaaatgttggatttagctaataggtttttaggtgttataatttctaaggccttaggagaacagcaaccgataaaagatagtaaacaatttttatttcattctgtggcagttgcgcatcatttatatgttgcatggtacagttgtactcaagtagatttgaaggatgtgactgagccaaaaataataattatggttaaatacgccccagcttatttcacaacttggaattttgcgctacaattatgctatttcaccttgtcagcgtggtgtgacttacagaatgcattaccaacaaaacacgaacgactgagtgacatcttaaaaataaaaagttacatttatacaacattcgtctttgcatctggaatatttgttaccactttattttggggactataccatacagacagcgagtatatcttcccccaggtctgccaaaattttttccctgcaatgctaaatcactcagtacatacagtaatttttgtatttttggtgatagaagccctttacgtagaccatccatggtatgatttaaagttatcagttgcctcgttcaccatatattttattatctaccacgtagtgtactttggtgtatgtgcccagttgggttactatatttatccattttttaatcttatgtcagcaacaggagtggctaccttcatcttttcctactatgtgtggcttataatcttaattgtaattggcattnnnnnnnnnnnnnnnnnngaaaacaaaaggaaatcaattttcnaaaaatattaataaaatgttcgtaacaaacactgtcaaatattgtaataatactcaactataattttccatacanaaaattgtgaaatatcaaatatagtacttagnnnnnnnnnnnnnnnnnnnnnnnnnnngg

SEQ ID NO: 17315 - DNA, 239 bp, Diabrotica virgifera; identical to SEQ ID NO: 16134
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t

SEQ ID NO: 17316 - DNA, 776 bp, Diabrotica virgifera
  misc_feature (624)..(647): n is a, c, g, or t
agtcgggtcggtagaatcgtaatggtaaattgatttgaattaaaataaaaacagagattttaaaaagaggttgaccacaatggctgacgttttagatattaacgatgccgttgatatagatgtcgaagatgaaggtgagcaaagcgttttgagactaaaagacaaagttataaaacgaaaaggtcgtggtttcggtcccggcgaaggaagagagcacgaaaaagtgagaggttacgagtcaattgatgctggagaccacggcgacgaaccagggccccaaaaatcagtagaaggttggatattgttcgctacttcggttcatgaagaggctaccgaagaagatttaagtaagaagttttcagactatggagtaataaaaaacattagtattaatttagatcgacgaacgggatttttgaaaggatacgctctgattgaatacggaacatatgaagaagcttctacagctagagaagctttaaatgggtcttctctactaggtcaaacgattggagtcgactggtgttttgttaaaggagcaaagaagtccagaagtaaacgtagcaagagacactaataatacacatttaaaaacaatctgtttcagattaatatgtaagaagnnnnnnnnnnnnnnnnnnnnnnnngtacaacttattttcactttagtacattttgtaaataacttggtcttgaatatttggagttatttgtgtagtattgaatatgcattttttatggaataagagaataaatgcagtgacacttttgaagat

SEQ ID NO: 17317 - DNA, 152 bp, Diabrotica virgifera
  misc_feature (2)..(27): n is a, c, g, or t
  misc_feature (29)..(58): n is a, c, g, or t
  misc_feature (60)..(122): n is a, c, g, or t
  misc_feature (127)..(148): n is a, c, g, or t
annnnnnnnnnnnnnnnnnnnnnnnnntnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnngtacnnnnnnnnnnnnnnnnnnnnnncgag

SEQ ID NO: 17318 - DNA, 65 bp, Diabrotica virgifera
  misc_feature (12)..(60): n is a, c, g, or t
aattatttaatnnnnnnnnnnnnnnnnnnnnnnnnnnnnnnnnnnnnnnnnnnnnnnnnnttata

SEQ ID NO: 17319 - DNA, 86 bp, Diabrotica virgifera
  misc_feature (17)..(53): n is a, c, g, or t
acccttaggataacagnnnnnnnnnnnnnnnnnnnnnnnnnnnnnnnnnnnnntgggacctcgatgttggattaaagtttataatg

SEQ ID NO: 17320 - DNA, 927 bp, Diabrotica virgifera
  misc_feature (3)..(42): n is a, c, g, or t
  misc_feature (155)..(187): n is a, c, g, or t
  misc_feature (310)..(331): n is a, c, g, or t
  misc_feature (631)..(644): n is a, c, g, or t
  misc_feature (647)..(659): n is a, c, g, or t
  misc_feature (683)..(711): n is a, c, g, or t
  misc_feature (856)..(856): n is a, c, g, or t
  misc_feature (864)..(864): n is a, c, g, or t
  misc_feature (910)..(911): n is a, c, g, or t
tgnnnnnnnnnnnnnnnnnnnnnnnnnnnnnnnnnnnnnnnngagtgtagcttataaaaaaccgaacaaaatgttgtatcagtaaggtctatcaatcgagtagaggcagagttgtggctcatgaaaggtacgttcttattcgtctgattccaaannnnnnnnnnnnnnnnnnnnnnnnnnnnnnnnngggcactcttcgggaaaaccccattcaaactttttaaagtgtttataaagggctttattttggttgtttataaaagtttctagcattagaaataggtgagttgcgctcgaaataaagttggtnnnnnnnnnnnnnnnnnnnnnntcatgaaaatctcctcgtgtttagctccccaaatgaaattattcgctaccgctttacaaacaatttactaacttatctattttttatatgatctgtcagtctcaccggtttgaagtgcttatttttgaaagggttgtggttgaaaaagcttgaacgggtcactaatcacgagtgtatgcaaattttgaacagccatatcttaaccaatttttggcttgcggaaaaacaaaatgaaactagcatatttataatagaaaaacctacatttttttactctttaagatttttcttatcactagnnnnnnnnnnnnnnggnnnnnnnnnnnnnggaaattcttcaaaaatttttagnnnnnnnnnnnnnnnnnnnnnnnnnnnnnattcaaaaataagcacttcaaaccggtgaaacttatagatcatataaacaatacacatgcagttaaaataaatggtaaatcggtgacgattaattttatttagggtgctaaatagagggaggattttacaatttttgtttaccanaaaaaggngccaactttttttttttcagcgtaactcgtttatttttgatgctgnnaacttttgtaaacaac

SEQ ID NO: 17321 - DNA, 853 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (810)..(810): n is a, c, g, or t
  misc_feature (822)..(843): n is a, c, g, or t
  misc_feature (848)..(848): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaatttttatttnaaaattaaattnnnnnnnnnnnnnnnnnnnnnnctcantccta

SEQ ID NO: 17322 - DNA, 627 bp, Diabrotica virgifera
  misc_feature (583)..(600): n is a, c, g, or t
cataaaccagagctaacctaagttttagttttgtttatcaattaattttaatttcaagaagtaaaaaataaaatacaatcacagtaaacatgacagaatctgattcaaaaattgggcgtctagaagatgaagctttaaaaaggaaagaaagattaaaaaacctaaaacgtaaaaggcaaaatgatagctcccgagataataacaaaaagggcgctgaaggtgaagcccttcctacaccattatttagaagttacaaacctatgaatgagagtttgaacgagtttgcacttaatccagcggagcccggcgatgtaactacacaggtgaaaaaccagctagagtctgcaaaatccaatgtggtgattgatcaactagatgtcacatcattggcccccaggaaaccagattgggatcttaaaagagatgttgcaaagaagttagcaaagttagagaagcagacccaaaaggcaattgcagaattaatcagaaataggttaaaagaaagtaaacaagaagatttggctgccattgtaaatgctggagcatcagacttataatctacaaatttcagattgaacagacnnnnnnnnnnnnnnnnnntatattagaattaaaaatagaagtgat

SEQ ID NO: 17323 - DNA, 631 bp, Diabrotica virgifera
  misc_feature (95)..(137): n is a, c, g, or t
  misc_feature (143)..(155): n is a, c, g, or t
  misc_feature (158)..(182): n is a, c, g, or t
  misc_feature (203)..(221): n is a, c, g, or t
  misc_feature (383)..(402): n is a, c, g, or t
  misc_feature (434)..(451): n is a, c, g, or t
ctttacgcgcccgagcgattttatgataatagggtattttttattactagcatagaaacggtttgtttgatgataggtgattaggatagggagannnnnnnnnnnnnnnnnnnnnnnnnnnnnnnnnnnnnnnnnnnagagcnnnnnnnnnnnnnccnnnnnnnnnnnnnnnnnnnnnnnnncggagttaggagagctatgannnnnnnnnnnnnnnnnnngaagaaagattttatctagtctttttgttgtgaagtgtgattcatcggttagatatatataactttgtaagaaagaaattaacgttatctatgagccagaaagttataatgaaatatttattatatggattaataagaagcatatttaggtcggagcttagnnnnnnnnnnnnnnnnnnnngagagcgattgaatagaaattgtgggtacgannnnnnnnnnnnnnnnnnatggtattatgttatgtttagataccattacttgtatgtttcatagagttgtttttaaaagatgtatactaagtgtttaaagttaggaatgttgatagaagtaggatttaaaaaatctagtgttatgatacatatataggttctgtaaaggtatgtcgtgtagtttttttcacgtgatta

SEQ ID NO: 17324 - DNA, 679 bp, Diabrotica virgifera
gtctattaagaggccccggcttatgttgtttggatgctacgtccctttaaagctcttgagaggataagagcaattgtttggtgagggattttagaattgttagagagggagaatgttccttttacatatcttaatcgtcttgccatagatcccaatttcgccagatgaagtattagaaagaaggtcgttgtgattgttcttctgttcagttgacaattgtgaaagatgagagtgaggcgactaagaaattgtggattatttgcggttgttgagcgatttataggaagtgcaggtagctagacttgatgaacagccaagtgaatcgatactaactgttacttcactttatttctcggaatgtatatggcttttcttaggaatgatctacatataataactgtatctataattactaatgaatgttttacagtatggcaaacgagacagacgaaaaaactatgaatgatcaggatggggatcattggactgttaggctatgtatcgtccattggataagaagtttgagttatattaagaacaataatgatccgatgtggatctacatttagtaatatcacgtgcaattggtgaattatatattatataatgaaagttggggttattgtattgattagagtggatttaggtaaattgttacatgaaaggtaggatcatattc

SEQ ID NO: 17325 - DNA, 909 bp, Diabrotica virgifera
  misc_feature (626)..(640): n is a, c, g, or t
  misc_feature (866)..(866): n is a, c, g, or t
cgtcgttgtcgtttgtttgtcctagaattttatccaattttggattcatttggattttgttggctgttttgtgtgtattttttaaaacttttgtttgtcatttgtaaattttataaatttaccacaatgcaaagtgactatttaaggaaattattattggaaactccgcagatgttttagaaagatattcattgaagctgaaaataattggagatttagatccatatacaattcagtcatcagaattggattttacagtgcattccatcaattactgttataatgctattatagatagactggtattagagtctcacagttactactttaagcagcaaatgaaagcatacaaaagccttcagacacataaaagccttcacaactggatttgttttgaaacatttgatgttttgatgatttctatattattgttggaaaggtgaagaattcccaaaaagctaatgctaaaccactagatgcttgggtgatagccagttccaatggcatagcaaatgcacattgtttgtgtattgccggtaatagtgaagtttgcagccatattgcagcaatcttatttgcagctgagtatgcccacagcaagacagaagaagaagaacccagtgcannnnnnnnnnnnnnngctatgtatattctctggtgaaaaactaatgagttttcaagctgttcggtcagagtgcttgttgcgctctctcaacgaattgaaatataagacggctttggcttcatgttgcagcgatatgaaaatggtgtctgtggatctttttgtatgcaaaaatttgtaataattatttgaaatcattttgaggattataagagtatggaaatatatgtgagagcacagactnattatagttttgtcctattttgatcatttcatcgtcttcttta

SEQ ID NO: 17326 - DNA, 482 bp, Diabrotica virgifera
ccttaactgtatacttttcgcctgcccactgatgaagtggaatggatgcggttttttaaaagagtgaagttgctcaaatcatggaacacttgttcattaacatgacctgtataagaacccaaaggcagttaaaaaatgatattgaatacctatgagccccattgaacgcctacactatcagaaagcacacagtatattattcctaatgttataaacttatgagaaccaaaaaccatataacacttggttcgatatatccagaatgccatatttgatagaggctgaagtcgaacgtgaatgaggtgtattccacattaaaatgcatgaattccaatctaattaacaggtggacatattagatcatttacatgctatcgcttaccaattaacacctttatctaatactatcttatgacccactgccaattttatatcaatatactccacagaccttacaaataacatttacaacgacaacaaat

SEQ ID NO: 17327 - DNA, 296 bp, Diabrotica virgifera
  misc_feature (2)..(268): n is a, c, g, or t
  misc_feature (279)..(280): n is a, c, g, or t
  misc_feature (290)..(290): n is a, c, g, or t
  misc_feature (293)..(293): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatatatannattatttaantgnggt

SEQ ID NO: 17328 - DNA, 900 bp, Diabrotica virgifera
  misc_feature (304)..(327): n is a, c, g, or t
  misc_feature (885)..(885): n is a, c, g, or t
gctacctttgggtcggcaccccatctagctttacatatgcaacgaagcatgtttaaacctttctcgcagttgcagcagttgcaaatgcaaataagaaatagagagacagatgtacggtatcttaaagacaaaataaatatggtaaatggataatgccagtttggaaaaggatgtgtctcccagctctggatccatgggaaacattagatatgctccacaacttcttaccatgaattctttaaacaaattactatatgagaaaccaacatatgttcagaaacaagaaatggccaaaaatactaannnnnnnnnnnnnnnnnnnnnnnngactaaattgctttcccaagagaaggccaaaaaaactgtgataattaggaccctaaaacaaaattatgcagctattctagaaaaaaatgaagagagaaattcggatttgatggaaaattaccataagttaagtagaggctctgaaaaactcaaagaatataaaaagaacatcctacaccacaaagaaatttactacaatatccattcccagctccagcagaggaggagacagctgttaaaggaactgctttttatttttcccattgaaaacatctgtgatgataaatatacaattataggaatacaccttccaaattcagatgtattagcagattgttcagacactggtttatccgtagcactggggtacatagcacatgttttaataatgtgctcgacatttcttcaggtaccagtgagatattcattgacccattacggttctaggtcttatatagctgataatatatcacctatgctgttggacaaagatcgtctctttccattgtttactagaggaaaggaaaaagtcagtttacatacgccgtctacctgctncataagaatcttgct

SEQ ID NO: 17329 - DNA, 940 bp, Diabrotica virgifera
  misc_feature (38)..(52): n is a, c, g, or t
  misc_feature (54)..(66): n is a, c, g, or t
gtagaacatagctatagatttttctttttcagtgctcnnnnnnnnnnnnnnngnnnnnnnnnnnnnagttatagctagtttttaaaaacaaataaaatggatttaccacaaccagatgattcaaaaaacctatttggccccttggtttttgaggaaagccagtacagtgacttccaaagtgatgttgaaactgattgtttactctgtgaggatcgttttaatctcaaactgtctttaccgatgttccttgcccatatatttgatgttcatagtgtagtaattgaagatgtgcaaaatatagataatttacatgaatatgtttcttattggcatcaaaagtttcaaaagaattctttagaacaaattattccatctcttagcttagattcaacaggtcagaaatattatctactgtcaagtttattaaaagaagataaagaattaagacacaaactaaaattggattatgttataaaaattcaggaatatgaaagaaataataaaaattttagaagatcttgtttgatgtgtaaactagaatatgaagggccgagacctggttattttgaacacctctcctcacaacataatctacaattaggaaaccctcaaaaccttgtgtttgttgatgaactaatcaataaaattgagagcaaaatgacagcactacaatgtatatattgtgaaaggacttttcctgatagacacgttttaaaagaacacatgagaaaaaagctccacaaaaggatcaatcctaaaaacgaggagtatgataagtactatattgtaaattacttagaggagaataaaacatggaaggctattcagaaggaaaatgacagatatgcagcgaataaagaatcagaaagcaatgcagatgaagagtattcccgatggaatgaaaagaagatctaataacatgtctggtctgcaaaagtaa

SEQ ID NO: 17330 - DNA, 615 bp, Diabrotica virgifera
ttcacttcagataccatcaggtacgttatgtgctgttgtgggacctgttggagctggaaaaagttcgttgttacagcttcttcttgcagaactccctactatctccgaaaaattttcgatagaagctatagctcacacagatcctttactattctcggaatcaagattcccaaaatatacaatatctttattgtctacgaactaaccgtacgtacggccccagaaatgcatcgtaatttcacttttatgatgacaaatttgccaggatccatgataaatgtatttatacacaattaatatcacaagacactccccgtagatgtaattatctctttattcattctgctcctcacctgtatgaagaaagtttatcattcctaactttgattttcaaaacttctaatattaggttttctattgatgaacacttaactattatcatttgtatacgaaaaatttaatatttactatctgtatgatagtatgctgtgcatacaattgatttaaatataagcatctgcagttctaatgaataagtaactgattagctcaccctgtagaaaatcctagtttaccttgactaattcactacccagatgtactccagcttatcca

SEQ ID NO: 17331 - DNA, 945 bp, Diabrotica virgifera
  misc_feature (5)..(913): n is a, c, g, or t
cgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataatataaatttttgatccattttttttga

SEQ ID NO: 17332 - DNA, 723 bp, Diabrotica virgifera
  misc_feature (2)..(50): n is a, c, g, or t
  misc_feature (52)..(722): n is a, c, g, or t
gnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17333 - DNA, 298 bp, Diabrotica virgifera
cgaatattatttatgacagctccactctaagagtaactccaatgaatgagaaaaaaaattaattgtcgcattaaatgaattaaattaatgttgacaatgtcagtagtacggtaattctccacctcatgtgacaggcgccaattgaatacaggattcactgccatctttcggattatttcgacattaaaaatggatatttatagtagtattcctgtcgttcattaaattaaacgaatgtagtcgttttcagaaaaaaaaacagaaattggtacaataaagtgatcattattaactgtat

SEQ ID NO: 17334 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17335 - DNA, 917 bp, Diabrotica virgifera
  misc_feature (409)..(437): n is a, c, g, or t
  misc_feature (453)..(473): n is a, c, g, or t
ggcgcatgcaatgttccagctgcaaggatctggtgtgaatagttgcgtggcgcgtttacttcaaatttggcgggtgttgtggaaaagtcttttagaataaaactggaattttgttttgcatccgagtcaaagtacattttcgtgccgcgtagtattcacgtcggatcttttgtagctggaatgttgtgtgcgacactcgtttttgtggcctttggcggttttttgttcttgttgattagtttacatcttttaacactagaagcaccaacatttttgcatacctagaagcaccggagcggtcaagatgacgggtattagaattttctatcgccagtcgtcttcttattgttttttaattgaaaagaaatcctatatggagttaatacctactagcaaaatacatttagcnnnnnnnnnnnnnnnnnnnnnnnnnnnnngcacaatttatgtagnnnnnnnnnnnnnnnnnnnnncttttacaagacctacacacaaattttttacataggtatatgactttcacatgtttgattttagttttagtttccagttttacacttctttttcttctgcaggtgctgtctctgctacggaggttgacaatcatcatagctattttaatttttgagtcagtagccctgaatagttgttttgagctgtgtccaaacctcagccatgaaattcgtcttcttccgatgcttcttctgctatctacccctccttgcattatgagtcataggatgccatacttctcgctccgcatcacatgtccgagatattgtagcttttgtccctgcctacgtttattattatttgattgaggtgttgtatctctgatttgtttccgttgatattgtcctgcctttagtcagatgatcttgtcgcatttctatgctaaatgaagcaggaaacttttc

SEQ ID NO: 17336 - DNA, 233 bp, Diabrotica virgifera
gtaaaaaatcgaaattcgttatcgcagagatgagattttatttcacttgtttaatgaggagagggtcaacaatcatgaaaaatgtatccattcacagtatatgtacaagctccactcgggagttaaatattaataacgaatgctgctactgacctttataaaagaagactaccataactgatatgaagatcaaaacttctgttaaaaatttctcgaatcaaggacacctaacc

SEQ ID NO: 17337 - DNA, 950 bp, Diabrotica virgifera
  misc_feature (24)..(43): n is a, c, g, or t
  misc_feature (46)..(58): n is a, c, g, or t
  misc_feature (90)..(108): n is a, c, g, or t
  misc_feature (480)..(501): n is a, c, g, or t
  misc_feature (859)..(859): n is a, c, g, or t
aattaatgagaggtataaagacgnnnnnnnnnnnnnnnnnnnngcnnnnnnnnnnnnngattggtgtcacaaaatgagcacgtgcaatgnnnnnnnnnnnnnnnnnnncgacttgtcagttcaaggatccgtagctggttttatacgaagtgaaggagatcaacaattaaattggagaaataagggatacaagactattttggacgttctcatggagaaaactccagatcgcacgaaaacacttccagttgaggataaaattttgcttaacaaagaggttaacaaaatagtttgggatggaaatacttcgaatgggagtaaacccacggtttattgttcatatggaagttcatatacagcggatcatatattaatcaccacatccgtgggagttttgaagaaattccacaaaagttggtttgtaccggaacttccaccctataaagttaattgtatagagcatatttcgttgggtgttgnnnnnnnnnnnnnnnnnnnnnnccctagtaaatggtggccagatggcactaagggtttcaatttattatgggccgaaaaagatagtttaaatctactaaacgaactgccagcttcgggaccagttgatgaagatggaaggtcttggttagaagacgtgtttggattttacatcattgatagtcaagtaaatacgttattaggatgggtagttggaaaaatggcggcagaagtagaatatatgagtgacacagatgtcattgctgtttgtatgtttgtcttgcgtaagtttttaggtaaaatttatgatatctgcgatgctgacgaaattttaaggtcaaaatggagcagtatcccccattttttgtggtcttatgtctantaaagtattgaccaagaaaagcacaatgcaacagctgaagatctagctagaccattaatttgcaaacatataacaacctacctttattttt

SEQ ID NO: 17338 - DNA, 800 bp, Diabrotica virgifera
  misc_feature (370)..(388): n is a, c, g, or t
  misc_feature (714)..(714): n is a, c, g, or t
  misc_feature (718)..(740): n is a, c, g, or t
cctccgcgtccgggaaattaccagagtacaaatgaaattgccgttacaacttccaggagaaaaggaaactagaactatagaatttgcgcattgcatcatagcttctggacatgaatcagcaacagtgtaaaagttggcaggaattggaatgaaacctggaatgctgtcaataccgttaccaatagaaaataggcggagatttgtgtttgcctttaattgcgaaaaagatgtgccaagcatcaacactccgatgatcgaagatttctcaggaatatatttcagaagagaaggattagcaggttcttttattgtaggtgtcgctccacaaccagagtttgtaccgctcaatgacaccgaggaagacagggcnnnnnnnnnnnnnnnnnnnaaatggtgcatccgctattagcaaatagggttccagcttttaatgatattaagctaacggggtcatggagtggtgactatgattataatatatttgatggaaatggtctagttggaccccatccgtattacttgaacatgtatatagcgactggatttagcgaccaaggaatccaacaagctcctggtatagggagggcagtatcagaaatgattatagacggaaattttagaacaatcgatcttactagattaggatttgacaggttgttagtcgacaaaccaatgttccagttgaagataacttagttgctgatttttagttgnttgnnnnnnnnnnnnnnnnnnnnnnnattttgtacatatttttacacagtttgagaactccaatggaataaagaaaatatttatta

SEQ ID NO: 17339 - DNA, 768 bp, Diabrotica virgifera
acaataatcaaaatgtacttgttcttccttgttgccctcattgtggacacaagtgacaatctaagcgtctttgaatactgcaacagttctactttaacacgtaatattcctactcccttgataaagacaaactgccgcattgcgcatccttccaataaaacatgtacaacatctcataacataatgccatgtacaacaccgcagacaaaacctacgatcttggcgttgatcaatttggcgattagctccattgatgaatttaaagatattactcgcattctcaaattatcgacataccatatactatcctttagcgaaacatactaaaccatatcccaacgttgaacttgcaaggtctgatgaatgaataaacaatgctgatataggaaggcatcaaacaagcaagatgtgcatcttgatggcctttcacagccacaactgctctcgaattgcatattgccattcatattaatcaaaatatcccactaatcgaacaagaatagatagaatgcgactcatcaaactctggatggaaagctgtgttagtgacaaatgtcattggatatgtcacaagtcactcacttgcatcatatgagatgtatgcttacgccgatcgataagcaaaatacattacaaaatcaataatactttctactatctctaaatatgtaaatcttgtcactactgacgatgctatggctaaagatctttctagtgcatgcccagtatccatagatgtagatgtagatgcatgtgagatttatggaa

SEQ ID NO: 17340 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17341 - DNA, 696 bp, Diabrotica virgifera
  misc_feature (7)..(695): n is a, c, g, or t
tacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 17342 - DNA, 140 bp, Diabrotica virgifera
  misc_feature (7)..(44): n is a, c, g, or t
  misc_feature (115)..(116): n is a, c, g, or t
taacagnnnnnnnnnnnnnnnnnnnnnnnnnnnnnnnnnnnnnntgcgacctcgatgttggattaagtttataattggtgtagcagctatatcatcaagtctgttcgactttcannattttacatgatctgagtttaaac

SEQ ID NO: 17343 - DNA, 947 bp, Diabrotica virgifera
  misc_feature (144)..(168): n is a, c, g, or t
  misc_feature (874)..(875): n is a, c, g, or t
  misc_feature (886)..(886): n is a, c, g, or t
  misc_feature (911)..(911): n is a, c, g, or t
  misc_feature (921)..(921): n is a, c, g, or t
aaatatttcaccagatttctcttgaaaataattattgaaacttgtatttttagatactgaccttttgtgttccttccttagttttctacagacaatatgcacgtagaaatagaggatgattatgcattaaaggatttagctacnnnnnnnnnnnnnnnnnnnnnnnnnctaattaagtcaattgaaaactttaaacatattgaaggttcacaaaaactgagcagaaaaatcagtcaagaattgaaattcttaagaaaagccaacaaaaataattccttaaaaaaagaacatctgcaatgctcaaatttaactcatttctctgctctcatcgacaccttgaaaactgtagaaagatgtcagagtgtaaataaagtatttgtgctggacgatagaaaaattacagttgatattattagtgatggtggtttaacttggactaaagtaattgctcgtaatcctaagtcggttagtcaaatatgtatgggaaatgccagctatggggtgagaagtataattgatcaagctgaggaatacattagatgtgcaaagcagtacccatgtttgtttcaatttccaaagataatttttgtcttcaccaatggaataggcagtcacatagcagcaaaactagaatctcgtggtatcatcgtccaaggagaaagagttagtgactttcccttagactctgattctgatagtgatatagaagaagagtacccaaatatttcagatttgtccacgaaagatatagccaacataaacaaaataaatctagacgtttctgcgatgctagcctattgcagttctgtgacaaatggtagtgctgagttgtatgacttcaatgtaccagtattaaagcagcaagccgaatggnngagagctgagncacaaaaaccaattttagatatttnctttcgaagnaaaaagctttactgctgtcaacagct

SEQ ID NO: 17344 - DNA, 797 bp, Diabrotica virgifera
  misc_feature (2)..(44): n is a, c, g, or t
  misc_feature (52)..(160): n is a, c, g, or t
  misc_feature (173)..(582): n is a, c, g, or t
  misc_feature (584)..(774): n is a, c, g, or t
  misc_feature (779)..(779): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataanatattaaatagtttttta

SEQ ID NO: 17345 - DNA, 508 bp, Diabrotica virgifera
  misc_feature (433)..(459): n is a, c, g, or t
gtcctttgagtacccaaatccaagagaggatacatgctttcattcatgatcgctttctgcaccttggacaacttatttgtaattggattatgttgtatgatgattccagatgacattggatacaagaaccaagattttgtgtataattcatgaataatatatcttctcatttgttcattcccatcctttatactgtagagtttactgtgcatcgtgccacaaagtaccaagtgcttacttacaaaatataagagtgaacaaactcttgcaaacttaaattacaaataccatgaaacatccgaacacgatcacagatactgttcaattaaaaatcaaatatataaacaataaaagatcaatcatgaatattattcaaaattagcttattgtatgtaatatatatataagcttcgtccagcttaataaatgtagnnnnnnnnnnnnnnnnnnnnnnnnnnncataataaatgttagatgcattaatatagaaatctaaacaaaatatacc

SEQ ID NO: 17346 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 17347 - DNA, 873 bp, Diabrotica virgifera
  misc_feature (383)..(403): n is a, c, g, or t
  misc_feature (745)..(745): n is a, c, g, or t
gagagagacaacagataacagttgtgtagtaaactgttcaagtgtaaacagtaaaccatcagtaaaccagtgacttatttaaacccctgacaaacggaacttattattgttgctaaaatggcattttcgatatttagacaatgcgtgaaaaacgggataacagtttctaacagaagtgcccttatggagggtgttttgaagaacacgctggcgaatgtgagttgcagatgtgttcccgtggcagctgtcaattttaacaattctatagtagctagaagttatagcaaacatgccaaacacacacacgcagaaaggaaatatcagtcagactcagaatcagatagtgatctggaatggattggacacagaggtgaatcagattnnnnnnnnnnnnnnnnnnnnnccttccatggaatcctcgacttaaataaggacggtgttatttcttttgacgacttcaaactgctcagtgatcggtttataaatctaggtcatttacgttcagaacaagtgaaaaaattccaggatgttcttaagaatctttgggagaagcagtttggagaaatatccccttacaacttagtctcagtggaaagatatttagaaaatatgcaccacgtgctcaacgataaaagactggtcaggaaggcacattcctttttgccttacttattcaaggcagttgataaagacagatccggagaaatctccgtggaagaatttaaattatttttcaatgtattgngcctcaaagaacaagacgccatcttagctttccgggcaatagactcaaacggaaatgaaaaaattaccccaaaaagagttcgtgaagcacgaaagagatttctttttgactgaagaccaagaaaggat

SEQ ID NO: 17348 - DNA, 951 bp, Diabrotica virgifera
  misc_feature (5)..(22): n is a, c, g, or t
  misc_feature (492)..(509): n is a, c, g, or t
  misc_feature (830)..(830): n is a, c, g, or t
  misc_feature (842)..(842): n is a, c, g, or t
gtggnnnnnnnnnnnnnnnnnncaacaaaatatagagtaagaaaataatatattagataaagattgaaagaaattttggtggaaatcaacttgtgtgaatccaacaccgctgtcctgcgcgtagcaccagtgattgatgtttgtttggaaaaattcctgacgccgtggtagttaatcaattttaattttacaaattgcaaatgaagggtacgcaaagaaagtttcagcttgctatctgctttgttttcggtcctgtagcattttgaaggattgaattttttttgcgaaagcttgatttcaaggtttgttttgcgaggtctattgaaccgatcttgatgaagtttacagtgccgttttgctgtatcgtggagtttttttgggtgaaatatgaatttcctaagtgtggcgtaggtggctgaagggcgtagagtgcgagtgcttgtttttgtatggttttttcgcaattgttgctgttttgcaacaagggtgacnnnnnnnnnnnnnnnnnnctaattctatagtgtagcaagtttggttacgcagcttttgtgttggtacatcttttctcggaaatgaatacttttaaagttataatcaaaagacgaggaagggaaccgaatttttccttcattttttgacattttgattgtttggacagtgttccggacctttctgagagggaggatagctcggatattgttgtttgagttgtttttaagcaatttctgcaaggaagtttgggtcacctctcaacgtccatctcaagacagatgggccctggactaatcctgggtcgtcgttcgtgagatccagtctctacgaatcgttgntatattttttgnaccaacaacactgactcaagctgtctgacagttctctttgttcattcattatcaatcaagtaacattttgacagatctagcaatctctcagcataagtttaaataaaaa

SEQ ID NO: 17349 - DNA, 832 bp, Diabrotica virgifera
  misc_feature (2)..(44): n is a, c, g, or t
  misc_feature (52)..(790): n is a, c, g, or t
  misc_feature (792)..(822): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnatttatttaa

SEQ ID NO: 17350 - DNA, 880 bp, Diabrotica virgifera
  misc_feature (2)..(25): n is a, c, g, or t
  misc_feature (348)..(382): n is a, c, g, or t
  misc_feature (439)..(467): n is a, c, g, or t
  misc_feature (741)..(771): n is a, c, g, or t
  misc_feature (786)..(786): n is a, c, g, or t
cnnnnnnnnnnnnnnnnnnnnnnnntaatatttctggctacataaatacaagtaatatataataataaccaccaacaataaagaaagtattgtttctttgaatatcctataccacatttatgattttcttataatatagtatgttacattttacttttcagtagtttctatggaaaaaatagtaaaatgagcattatgcacagttatgagactcaatttacagactcaatctacatatctttaaagtaccaaagtatcataagtcagctttttcttcatatcagagtcagtctatcgaaagtaggtattataattaaatgcactttctgttgaaataattaagtatcnnnnnnnnnnnnnnnnnnnnnnnnnnnnnnnnnnngatatagaaacaaaacgaaaaatttgtgacatacaatccacttaacccattaacgannnnnnnnnnnnnnnnnnnnnnnnnnnnnttacttattatattttatcagttatattgttcttaatatggaaatattcatgatattgttttatatctgtgcagttttgaattttgactcatcttattaacgttgctgttatcataattgcaagtatgtacctaacctatgtatgaacgagttaaaaacagttatagaaattaacatttttatttcatcatcattggctcgacagccctttctgggtcttggcctgttccaggattcttctccactctgatctgtttcgtgctttttttttccnnnnnnnnnnnnnnnnnnnnnnnnnnnnnnnttctatttgttctanatatctcagcttcggtcttcctcttgttctttttcctactggcatctggttgaatattttgtttggtatttcgccttcttccattctttctaca

SEQ ID NO: 17351 - DNA, 162 bp, Diabrotica virgifera
  misc_feature (5)..(96): n is a, c, g, or t
  misc_feature (101)..(155): n is a, c, g, or t
cattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtnnnnnnnnnnnnnnnnnnnnnnnnnnnnnnnnnnnnnnnnnnnnnnnnnnnnnnncattttt

SEQ ID NO: 17352 - DNA, 193 bp, Diabrotica virgifera
  misc_feature (2)..(65): n is a, c, g, or t
  misc_feature (72)..(184): n is a, c, g, or t
cnnnnnnnnnnnnnnnnnnnnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgt

SEQ ID NO: 17353 - DNA, 137 bp, Diabrotica virgifera
  misc_feature (62)..(75): n is a, c, g, or t
  misc_feature (77)..(100): n is a, c, g, or t
  misc_feature (108)..(129): n is a, c, g, or t
taacagcgtaattttattggagagtcaaatcgataataaagattgcgacctcgatgttggannnnnnnnnnnnnngnnnnnnnnnnnnnnnnnnnnnnnntgttcgannnnnnnnnnnnnnnnnnnnnnagtttaaa

SEQ ID NO: 17354 - DNA, 67 bp, Diabrotica virgifera
  misc_feature (2)..(60): n is a, c, g, or t
cnnnnnnnnnnnnnnnnnnnnnnnnnnnnnnnnnnnnnnnnnnnnnnnnnnnnnnnnnnngtacctc

SEQ ID NO: 17355 - DNA, 237 bp, Diabrotica virgifera
  misc_feature (12)..(34): n is a, c, g, or t
  misc_feature (80)..(102): n is a, c, g, or t
  misc_feature (111)..(126): n is a, c, g, or t
  misc_feature (128)..(143): n is a, c, g, or t
  misc_feature (155)..(192): n is a, c, g, or t
  misc_feature (195)..(225): n is a, c, g, or t
ctctctctctcnnnnnnnnnnnnnnnnnnnnnnncttaacgatagttaattagtatcgtgagagaatatctttcttttcnnnnnnnnnnnnnnnnnnnnnnnggtacctcnnnnnnnnnnnnnnnncnnnnnnnnnnnnnnnntcatttatctcnnnnnnnnnnnnnnnnnnnnnnnnnnnnnnnnnnnnnntcnnnnnnnnnnnnnnnnnnnnnnnnnnnnnnntaatcgaaacgt

SEQ ID NO: 17356 - DNA, 587 bp, Diabrotica virgifera
  misc_feature (2)..(17): n is a, c, g, or t
  misc_feature (79)..(106): n is a, c, g, or t
  misc_feature (127)..(164): n is a, c, g, or t
  misc_feature (215)..(261): n is a, c, g, or t
  misc_feature (269)..(409): n is a, c, g, or t
  misc_feature (411)..(586): n is a, c, g, or t
gnnnnnnnnnnnnnnnncgtgagagaatcatctttcatcttctctctcaaaagaaaaatttcatctctttcgtacctcnnnnnnnnnnnnnnnnnnnnnnnnnnnncatcatcatttcatctcatcnnnnnnnnnnnnnnnnnnnnnnnnnnnnnnnnnnnnnnttcggtaaaataaatatctttcaataatttttttctaacgaaacggtatcnnnnnnnnnnnnnnnnnnnnnnnnnnnnnnnnnnnnnnnnnnnnnnncttcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17357 - DNA, 909 bp, Diabrotica virgifera
  misc_feature (8)..(52): n is a, c, g, or t
  misc_feature (73)..(171): n is a, c, g, or t
  misc_feature (179)..(203): n is a, c, g, or t
  misc_feature (217)..(240): n is a, c, g, or t
  misc_feature (248)..(517): n is a, c, g, or t
  misc_feature (519)..(576): n is a, c, g, or t
  misc_feature (578)..(614): n is a, c, g, or t
  misc_feature (616)..(639): n is a, c, g, or t
  misc_feature (641)..(672): n is a, c, g, or t
  misc_feature (679)..(730): n is a, c, g, or t
  misc_feature (744)..(825): n is a, c, g, or t
  misc_feature (827)..(846): n is a, c, g, or t
  misc_feature (867)..(898): n is a, c, g, or t
attgatgnnnnnnnnnnnnnnnnnnnnnnnnnnnnnnnnnnnnnnnnnnnnncgatagttaattaatattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagagnnnnnnnnnnnnnnnnnnnnnnnnnacataagtattttnnnnnnnnnnnnnnnnnnnnnnnngtattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnngnnnnnnnnnnnnnnnnnnnnnnnngnnnnnnnnnnnnnnnnnnnnnnnnnnnnnnnnacgcgtnnnnnnnnnnnnnnnnnnnnnnnnnnnnnnnnnnnnnnnnnnnnnnnnnnnntaatgaaggattgnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnggatgattaataagttcttannnnnnnnnnnnnnnnnnnnnnnnnnnnnnnncttcattgggg

SEQ ID NO: 17358 - DNA, 918 bp, Diabrotica virgifera
  misc_feature (23)..(49): n is a, c, g, or t
  misc_feature (282)..(300): n is a, c, g, or t
  misc_feature (647)..(673): n is a, c, g, or t
  misc_feature (883)..(884): n is a, c, g, or t
  misc_feature (894)..(894): n is a, c, g, or t
gttatccaatagtctcactaagnnnnnnnnnnnnnnnnnnnnnnnnnnnaaccagtggttcaacctcttgagactgagactagctctattcttactagtaatataccactaattttgattggaattatctcagttttattaggataccaatactggtttaaaaaccaacgatatgttcagatgggcaataaattcccgggacctgccactttaccatttataggaaatgctcacttagcatttggaaaatctgctcatggattgtttgaactggccatggcnnnnnnnnnnnnnnnnnnnattgacgttggtaggatttggcttgggcctagattgatcattggcgttgcaaatgccgatgatatagaaattattttaggcaatagtgttcatttggaaaaatctcctgactacggtttattcgaaccctggcttggtgatggcctactcattagcaaaggggaaaaatggaggtcccacaggaaaatgattgcaccaactttccacacctcaatcttaaaatctttcatgccagtatttaacagaaatgctactgctttggtcgaaacatttagaaaggaacagggaaaagtattcgattgccatgattacctcagcagtacaactgtagatactttgctagaaannnnnnnnnnnnnnnnnnnnnnnnnnnacagcaaagctggattcgattatgccatggctgttatgcgaattacaaattgacgttggtaggatttggcttgggcctagattgatcattggcgttgcaaatgccgatgatatagaaattattttaggcaatagtgttcatttggaaaaatctcctgactacggtttattcgaaccctggcttggtgatggcctactcattagcaaaggnngaaaaatggnaggtccccacaggaaaatgattgc

SEQ ID NO: 17359 - DNA, 88 bp, Diabrotica virgifera
  misc_feature (5)..(5): n is a, c, g, or t
  misc_feature (14)..(62): n is a, c, g, or t
  misc_feature (69)..(69): n is a, c, g, or t
aatanatttaactnnnnnnnnnnnnnnnnnnnnnnnnnnnnnnnnnnnnnnnnnnnnnnnnngatatangaataaattaccttaggga

SEQ ID NO: 17360 - DNA, 727 bp, Diabrotica virgifera
  misc_feature (81)..(112): n is a, c, g, or t
  misc_feature (124)..(162): n is a, c, g, or t
  misc_feature (165)..(198): n is a, c, g, or t
  misc_feature (208)..(224): n is a, c, g, or t
  misc_feature (226)..(726): n is a, c, g, or t
cttaacggatagttaattagtatcgtgagagaatatctttatcttttatcaaaagaaaaatttcatctttcccgtacctcnnnnnnnnnnnnnnnnnnnnnnnnnnnnnnnntcatttatctcnnnnnnnnnnnnnnnnnnnnnnnnnnnnnnnnnnnnnnntcnnnnnnnnnnnnnnnnnnnnnnnnnnnnnnnnnncgaaacggtnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 17361 - DNA, 886 bp, Diabrotica virgifera
  misc_feature (2)..(15): n is a, c, g, or t
  misc_feature (147)..(164): n is a, c, g, or t
  misc_feature (373)..(393): n is a, c, g, or t
  misc_feature (861)..(861): n is a, c, g, or t
  misc_feature (863)..(863): n is a, c, g, or t
cnnnnnnnnnnnnnnggtatattgttgaagatccatacttgaatataatactacaagtactactagttgtactaaataaatgttattacatatctcgttgacaacataaaataattgtttacgcattttgaaaaattattgcaacannnnnnnnnnnnnnnnnngtaattccatatcaagtttcctatgaaagtttccgtgtgaaatatgactatttgacgttttgaagatatttagtccaagggccagtgatgtgtttccggtagttcacaaaataccaagagacatttatattttcaggtttctaatagtgctaaagatgtatcagaaaattacacaagataccaaggactctaatttattctgataaagnnnnnnnnnnnnnnnnnnnnngatcttttattatattattagaagaaatgttgaggtttccaagatttatataatttgtaaagatttaaaatgatcattttctcattgtatgcattttattaatccgttaaggttatttggattataatttcgtacaataaatatgttaacgttacaaagagaaaaaacgcaaaaaagacattcgaccaggaatgtgaacaaagcttaaagctaaaaaccagcaaaaagacagatctactaccaagatcaacagatgagaatagcgaagcttaccatataattagaacagaaacgagaacactgttaaaaaggaagaaaacaagaggtacctaggaaatttaataaagcagcttgagagcaaccatagaaccggttagccaaggcagtttattaaggaaataaaaacactgaaaggcaaaaagtaaatagtccagaattcataaaagatgacagaagacaattttttangnaaaatacggacataagccgacaa

SEQ ID NO: 17362 - DNA, 735 bp, Diabrotica virgifera
  misc_feature (2)..(535): n is a, c, g, or t
  misc_feature (542)..(579): n is a, c, g, or t
  misc_feature (599)..(612): n is a, c, g, or t
  misc_feature (615)..(637): n is a, c, g, or t
  misc_feature (645)..(667): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatctttaagttattaatatattttaggacgaaagga

SEQ ID NO: 17363 - DNA, 766 bp, Diabrotica virgifera
  misc_feature (2)..(46): n is a, c, g, or t
  misc_feature (53)..(164): n is a, c, g, or t
  misc_feature (177)..(754): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagaaac

SEQ ID NO: 17364 - DNA, 907 bp, Diabrotica virgifera
  misc_feature (6)..(25): n is a, c, g, or t
  misc_feature (100)..(124): n is a, c, g, or t
  misc_feature (132)..(604): n is a, c, g, or t
  misc_feature (606)..(897): n is a, c, g, or t
attttnnnnnnnnnnnnnnnnnnnnctcgtaaatgtaaagaaaaattttcatcttaacgatagttaattcgtatcgtgagagaatatctttcatctttcnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaattta

SEQ ID NO: 17365 - DNA, 894 bp, Diabrotica virgifera
  misc_feature (200)..(221): n is a, c, g, or t
  misc_feature (243)..(262): n is a, c, g, or t
  misc_feature (299)..(333): n is a, c, g, or t
  misc_feature (346)..(365): n is a, c, g, or t
  misc_feature (374)..(396): n is a, c, g, or t
  misc_feature (403)..(420): n is a, c, g, or t
  misc_feature (422)..(666): n is a, c, g, or t
  misc_feature (668)..(699): n is a, c, g, or t
  misc_feature (706)..(882): n is a, c, g, or t
gcggtccggtttttcattcatttacaaaacacaaaacatttttacgaaaaggtaaagaaaaaatttcactcatcgtcgttcattcagtatcgggagtgaatcatttcattttctcaaatgaaaatttaatttttctaccttctggtatcagggattcataaattcatcaatctctcatctcataattttcgaaatttcannnnnnnnnnnnnnnnnnnnnntttcatcggtaaaataaaatcnnnnnnnnnnnnnnnnnnnncgtaatcgaaacggtaattcgtttttcaatatcatcnnnnnnnnnnnnnnnnnnnnnnnnnnnnnnnnnnntaacaatatatcnnnnnnnnnnnnnnnnnnnncattatctnnnnnnnnnnnnnnnnnnnnnnncgagctnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnngccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagagttta

SEQ ID NO: 17366 - DNA, 787 bp, Diabrotica virgifera
  misc_feature (241)..(255): n is a, c, g, or t
  misc_feature (485)..(502): n is a, c, g, or t
  misc_feature (593)..(613): n is a, c, g, or t
  misc_feature (645)..(668): n is a, c, g, or t
  misc_feature (673)..(786): n is a, c, g, or t
aaaattttcaacaccattgaattcaaaatatctaacaaaaatgtctctggaacgtcaagtccgtaacaaactcgccgctaaacgcgatccccaacaagacaaagaagctcaagcatggatcgagactatccttggcgccaaattccctccaggtgaagcctacgaagatgttatccgtgacggaactgtcctctgccaactcatcaacaaattggctccaggatcagtcgccaaaatcaannnnnnnnnnnnnnnattcaaaatgatggaaaacatcaacaacttccaagccgcaatcaaagcatacggtgtagctgacattgatgttttccaaaccgtcgacctctgggaaaagaaagacatcgcccaagtaaccaataccctctttgccattggcagacagacctacaagcaccctgaatggaaaggaccttaccttggacccaaacccgctgacgaaaacaagagagaattcactgaagaannnnnnnnnnnnnnnnnnactatgattgggctccaagctggtcaaaacaagggagcttcccaagccggacagaacatgggtgctggtcgcaaaattatccttggaaagnnnnnnnnnnnnnnnnnnnnnttttacactattttttaatttgtatacgtaannnnnnnnnnnnnnnnnnnnnnnncaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 17367 - DNA, 762 bp, Diabrotica virgifera
  misc_feature (239)..(253): n is a, c, g, or t
caattctgtatgctgagacgcaactagtctagggatgttagccccttttttgggattgaggttgctaccacgtgactcgtgagttactacactacctaacgtaccttctcatagtctagattatggataggaaacagacataactcacatataccttacgtcagccgataattatttattgttcgaaataagattattatgtgaagaaataaattcgcacacccttttatgagtttatnnnnnnnnnnnnnnnatttgcataattcttctttttttaggtgagattaatgtgatgttgagtagttacatattgaagaggtagaagttgttgtgatgcctgatacgaactctgaatctgaggaaatgaatctcgcctgctacgcattaagattatttgccctgatccatatcattccgactctcgagagctactgattctacctgaatgaatggctctaggatgtgatcaccgctgctgtataattctgtgactcattttccatcggtaccagatatgctgtatacgttgctgaactccagaatcacaaaatatacctgatgccaccattgctgtactcgtctaggagtgagaggacttgcatcatcgtgaattagacgacctcttgtttccatctgtaagagccgatagtgtggtatctatcttcttcgctgcggatggtctctgtgtgaacacactcatcgctggacacactcacttgtggatcgttccatttcctccacacaacgaacaatcactttgct

SEQ ID NO: 17368 - DNA, 301 bp, Diabrotica virgifera; identical to SEQ ID NO: 10170
  misc_feature (7)..(102): n is a, c, g, or t
  misc_feature (109)..(146): n is a, c, g, or t
  misc_feature (166)..(179): n is a, c, g, or t
  misc_feature (182)..(204): n is a, c, g, or t
  misc_feature (212)..(234): n is a, c, g, or t
  misc_feature (264)..(295): n is a, c, g, or t

SEQ ID NO: 17369 - DNA, 577 bp, Diabrotica virgifera
  misc_feature (320)..(334): n is a, c, g, or t
  misc_feature (404)..(422): n is a, c, g, or t
acggtctgcaaggagtgtttatgctggcgttggcctattctggatgcgataagatgactgccatagcaatgttatctttagctgttgccgtcaatggagctgtttcgactggtgcccttgctactctagtagacatcagtccaaattattcagctatattactcggtatagtcaattctgccgtggcacttgttggattctgcacgccagctgtagtaggattctttacattccaaaatcaaacaacggctcaatggcagaaggtcttttgggtgtgtacagttttcctgatctccacttgccttttcttcgtactattnnnnnnnnnnnnnnnagcctcctggaataatccggtccaatccataccagaaacagaaatgatggttattaccagggatggcgannnnnnnnnnnnnnnnnnngatatgaatgagactgagaaaattacttataatgacgaatcttattagttctattaatgagtatttgttttgtatatatttaatactcatgattattatacagtatgcttgttgtatatattaatatataaggattgtaaatatagtatagacac

SEQ ID NO: 17370 - DNA, 641 bp, Diabrotica virgifera
aggagctagtttgtaatcagagggtgcgagttatcgatcaaatctaaattgttacatctctgaaggtggtacaagattccagtggtggagaattaaatttaaatgaggcgagtgatttgtctacattaggaggtatgaaatgagtatgctaatgtgtgtctaggtgagatgtttgaatgttaagataaaatgttggcaacatataagaaatcagaaaatctattacaaaattataacaaaactatgaaacaaagattggtgaataattcctgcctacgaaaattatggaccttgatagagaaacgtactgaagtaatagcactgatgcatcatcgcacatcactgtgtgacttctgtaaagtagaacagcgagaaaagcttttcagtttcatccaaaatagccctttcagcttttccaaaatttaaaactatataactcatatagactcagaagatagaagaattggcagaatgtttcacaccacttttggaacaaggcaaaaaggcaatttttcctattacaaatttgaactgtgactgatagacacgcagagttagaaattggaaagactgaagatcaacacaggatagtttgttatacaataaagtttttattggcaataaattcattacatactact

SEQ ID NO: 17371 - DNA, 983 bp, Diabrotica virgifera
  misc_feature (74)..(89): n is a, c, g, or t
  misc_feature (162)..(191): n is a, c, g, or t
  misc_feature (204)..(239): n is a, c, g, or t
  misc_feature (242)..(256): n is a, c, g, or t
  misc_feature (270)..(310): n is a, c, g, or t
  misc_feature (319)..(801): n is a, c, g, or t
  misc_feature (803)..(825): n is a, c, g, or t
  misc_feature (827)..(876): n is a, c, g, or t
  misc_feature (888)..(926): n is a, c, g, or t
gtacggcctcggcaggtaccgaggtccgggaatctcccaggggtcagtacccacagtcagtccagcaagaggannnnnnnnnnnnnnnntcaatctatcatcatcttcattctctctctcgaatttcaaaacgcgctcaaaagaatttaaattcgttctccnnnnnnnnnnnnnnnnnnnnnnnnnnnnnnctaacgaaacgtnnnnnnnnnnnnnnnnnnnnnnnnnnnnnnnnnnnncgnnnnnnnnnnnnnnnattaacaatatcgnnnnnnnnnnnnnnnnnnnnnnnnnnnnnnnnnnnnnnnnnctagggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnncnnnnnnnnnnnnnnnnnnnnnnnnnnnnnnnnnnnnnnnnnnnnnnnnnncggtgattaacnnnnnnnnnnnnnnnnnnnnnnnnnnnnnnnnnnnnnnntcaattttttgatgccaatttttttgcatagtagaataaattaccttagggataaca

SEQ ID NO: 17372 - DNA, 720 bp, Diabrotica virgifera
gaattgtgaagagtacatttattttttcttgcatatctaacttctttgactcttgtgaagccggagttactaattcaaagttatatagtaacaatgtacgaaatgtagagagctgtaaaataaagactgatcataggattgaagaaactttaacaaactgttgagaaacgaacacgacgtgccatctttttcagtagtcgaattcttactacactttgattcagaccaatttcttaactaaatacttataatgaaatattagtacatccctacccccaaccactcttacatgtatacgcctgtctcggcatgcttttagagtctgctgtcctatgaagagttagcaatccctatctccaatatcatgacagatgtgattatatattttgaaagatcattatttttcttcttcatcttattattcacacgcgatgactctggcttattcctacctagctagagatgataccatccttgaatcaactcttctctacaggagaaggactatatagcactgatacaagctgctatcatacaactgtctcacctgattataacagctttcactgcttccgctcaagatactgtctccctctgcccactgtatatgttgactgatcgcggaagatggctagatctgggacaacctatgctgactgtgttctgtagcgtgatgccccgttcactcgtatatatcctctacggagtctcgttaatcta

SEQ ID NO: 17373 - DNA, 895 bp, Diabrotica virgifera
  misc_feature (3)..(44): n is a, c, g, or t
  misc_feature (50)..(72): n is a, c, g, or t
  misc_feature (263)..(336): n is a, c, g, or t
  misc_feature (341)..(406): n is a, c, g, or t
  misc_feature (424)..(442): n is a, c, g, or t
  misc_feature (451)..(465): n is a, c, g, or t
  misc_feature (467)..(483): n is a, c, g, or t
  misc_feature (486)..(504): n is a, c, g, or t
  misc_feature (519)..(539): n is a, c, g, or t
  misc_feature (677)..(726): n is a, c, g, or t
  misc_feature (731)..(839): n is a, c, g, or t
  misc_feature (842)..(859): n is a, c, g, or t
  misc_feature (862)..(887): n is a, c, g, or t
agnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnntannnnnnnnnnnnnnnnnnnnnnnnnnctcatccc

SEQ ID NO: 17374 - DNA, 588 bp, Diabrotica virgifera
  misc_feature (51)..(75): n is a, c, g, or t
attatttgtattatgtatgtcggagaaaccattaacattttaactgaaccnnnnnnnnnnnnnnnnnnnnnnnnngtctttacttttctttatgtgtatttatctcgcactgagttggtgtgctgtgttcaaaaaagctaattcactaataaataaagatgttgaatttacgaaaccatactagagattaatatatagagaatgcagcatcaaagactataatctacaagaggttgagctccacgatatgatcattattactaacgacgatgcaaacgacaccgacgatgacccagctttcttatcatcaataatgctataattatattattatccaataatatccagatttcataaaacagcccgagcgatcaaagaaagcgagaatatcaacatcacagataacggagttgatccacaacatgaacaatctgaatgaattattaacaatcgataaagtctaatagaaggatttgacagaccattatttacgcctgtatacaaggatcaaggcagagtgcgtcaccatgtaaacttccgactgcccactgattgatatgtacgcccgcgacattttgactgccggta

SEQ ID NO: 17375 - DNA, 121 bp, Diabrotica virgifera
  misc_feature (39)..(56): n is a, c, g, or t
atcgaagagagcgttctgtgttttctagctatagttatnnnnnnnnnnnnnnnnnncaaaatgagggaaatcgttcacatccaagctgtacaatgcggtaaccaaattggagccaaattct

SEQ ID NO: 17376 - DNA, 892 bp, Diabrotica virgifera
  misc_feature (191)..(208): n is a, c, g, or t
  misc_feature (469)..(504): n is a, c, g, or t
  misc_feature (845)..(858): n is a, c, g, or t
  misc_feature (861)..(880): n is a, c, g, or t
gttttgtggtactgaacaacaaatttcttgaaattttaccatgtataaaattacgtgcagaacttgcctgtcccttgcagatgacgacgaatgtattcaaattaccgaacatttggataatgagagtatcaaagatgttttactccaatatgttcctcaaatggaatcaacattatcagataaagatagannnnnnnnnnnnnnnnnngaaactttgaagaaatttagtgagttgattgatagatgtattgaaattgaagaacaattaagtaataatcaaattatttttgagaatgtcgatagcgaggaagaagatcaaaacgagggttagtattttatgtaaaaaaattcaagtaaaataacaatatttatttttaacttcctgaagaatatttttaatattaaggaatatacaaaatttaatttgtaataaaacattgaagaatagtctattaaatgttttataggnnnnnnnnnnnnnnnnnnnnnnnnnnnnnnnnnnnngatattccattcaatgaatataatcatggtaagtctatagaaatctacagcatagaaaaagagcaagaaaatgaatttataggaagatgcatagaaatacagtagaactgcaattatccggattaattgggaccggacctgatccaataataaaaaatccggaaaatttaatttttctcgaaaaaggccttttccgggaaagaaatgtaattacagcaaaacacaatggagaacatatacggtatttattatgaaaaacaatacagtatacacaacaatacgtaaatggcaaagtttacattacgtaatattgacacacaatactgaatcacagtaaaatnnnnnnnnnnnnnncannnnnnnnnnnnnnnnnnnntcaatctgatcc

SEQ ID NO: 17377 - DNA, 965 bp, Diabrotica virgifera
  misc_feature (116)..(160): n is a, c, g, or t
gaattcaactctactttcccgtttccttgaggattataagcagtagttctacttgttgcgattcctctggagttgagaaactctttgacttcagctaatagaaattgagtctgtcnnnnnnnnnnnnnnnnnnnnnnnnnnnnnnnnnnnnnnnnnnnnnaattcttgaagaggagcagtgatggtagccttcaaatacgttggtagacgcactactgctcttgaagcggcaaaccttgttcttgaagcggcaaagtgcctctttttatcacaggatttgcagatggatttctgagccagacaattcttccttggatgtattggcccaccgcggaagaaacgtgtgtttcttttgcttgaccttgaagagttagtagtaggtagcagctgtcacagtgacactttcagaattcgttggagagctctgtaagtcgaatttatagttaccaggtaggtccaacactcagtgttggattttgatttccacaaacctgagagttgagttctgctatttccatcgaagtagctatatcataagtttcttctaatgttaacgttaaactttctaataatcttgatcgtatctttgtggacgtcattccagcgatgaaagcttcaaagggccgttgttatttttgttagttttggcagtaaatgctaactgttttaacaattgcatgtaagtatcgatagtctcgtctagtgtgtgacgttcatgaatgatatatttggtttgatgaatattttatcaagcgtttgaatggattcattgtaagtttcataatcgcttatataggtatatactcttagcgaaataagtttactaatagttgtagtttggtattattagtgcctagagggtgtacaacagtgaaagtgacaacctgggcagcataaaagttcatgaaggtactttttcaatggccccattccttttgccgttggttttccccaatggaatctcc

SEQ ID NO: 17378 - DNA, 420 bp, Diabrotica virgifera
taagaatatatcataagcacgagctcatgagccaaaacacacattcgtctatctaatcatcccggcgaagtaatactggatttatgaaaattgctttctttgatacctctgcaaactttgacaatcaccgacctgatttccttcttcctgacaatgtaaacgacccacatgaaccatatagacttggatatatgagtatcatgacacttgtatatactgtaactccagcaaataatgatatgacttaccatatattagaacttaagagagattaaggaaaatattaggaactttgtagaaaatccacatcatatcaccatctgatgtcaaagcgctggagccgcatctgtgacttatttactacagtgaaaacaaacttgagcactctttagtatagaaattctcaactctggatctagt

SEQ ID NO: 17379 - DNA, 943 bp, Diabrotica virgifera
  misc_feature (742)..(757): n is a, c, g, or t
  misc_feature (760)..(773): n is a, c, g, or t
  misc_feature (812)..(832): n is a, c, g, or t
  misc_feature (837)..(850): n is a, c, g, or t
  misc_feature (852)..(880): n is a, c, g, or t
  misc_feature (882)..(937): n is a, c, g, or t
cggacgcagtgggcggacgcgtcggggtcatattcgttcctcctcgagttactctatccatcatcgttaattaaagtataattcggtttctcagctcgaatacgttcgaagtcctcgtaaacatattaacgttcaattcttttaagaaagatcatcagcctcaaacgggtatcaactttaaaacaaatcgaagatggagtaatttaacagacttcgttcggaggcctattaatcgggctttaaaatcggagatctcgtaggactcatttgcattcgtcgaagccgagttgcgatcgataaggcttcgaaaaataattatttcgcaattcgtattcgtgcactaattttacaataatctcgagttctaattcgttggatttaagtttagtaaacgtttttttcttcgtttttattacagaacaaattttatttgaaacatttcttttattctcttttagtttatgagccagagccttataaacaattaatttgtttataacaattttttgaccactcggatcgaaatccaccatcgaaattcgtaatcagcagacaaaaatccataagaaaccgattgagtttgtccatcagaattgaaaaggacacgtggattttttggggtttttatcaattagttatgtgaaaattttgtgctttttgtcattaatgatacatattcgattgatttgtgataatgttgaatgctgcgagctattgtgatcgagctaaggtagtataatcnnnnnnnnnnnnnnnnagnnnnnnnnnnnnnnaatgtatgagaatgaaactgtctttatttagtttatacnnnnnnnnnnnnnnnnnnnnngaagnnnnnnnnnnnnnncnnnnnnnnnnnnnnnnnnnnnnnnnnnnncnnnnnnnnnnnnnnnnnnnnnnnnnnnnnnnnnnnnnnnnnnnnnnnnnnnnnnnncgcggt

SEQ ID NO: 17380 - DNA, 992 bp, Diabrotica virgifera
  misc_feature (361)..(435): n is a, c, g, or t
  misc_feature (477)..(491): n is a, c, g, or t
  misc_feature (901)..(901): n is a, c, g, or t
ccaagacaagttcttctcattcctatggtaaagacaattatcctgtagaaccagttgttgaaagtaattcgaaaatagttacaacagaacatattgacaagccagtagaaattatcaaagtcacaagttctggacaaccagtcactaaagataaaactattgatgtaacaaatgaaaatcgtgatgtcagtgtatcaggtggatcgaaaactaccaaaacaacaatcacaaaaactgtacatactagtggacaatctgcagataaaaacgaaaatgaaggtgcttcaagagtaataactacacaaaaaaacaataaacatgtggacagtggcaacacagatgaatttgtccacgaagatannnnnnnnnnnnnnnnnnnnnnnnnnnnnnnnnnnnnnnnnnnnnnnnnnnnnnnnnnnnnnnnnnnnnnnnnnnaaaaagattccgatatacttcataaaggtagtcttgatattnnnnnnnnnnnnnnnaaagacaaagaccaagacacagtaagcaaaaccacaggatctaatattgtaaaaaccacaataacaaaaacttctcactcaaccgatcaagtaaaagaaccttcgaaatcagttaaaaaaacagaggttcacgaagaagatgatatgaactcgaaggaaaataatggatcaaaagtcacaaaaactagtcaatcaggtggaaccaaaactattacaactaaaatcacgaaaactagctcaagcagtcattccgacgaaaattcttcggatttgggaggcgcagcaacaggtataaaaacaacaatcacacaaactgtacatactagtggacaatctacaggtaaaaacgaaaatgatggtgcttcaaaagtaataactacacaacaaattaataatcatctagacagtgncaatacggatgaactttccacgaagataagactttaagacataagtggatccaaattattaaaacaccatcactaaaacagttctcattct

SEQ ID NO: 17381 - DNA, 69 bp, Diabrotica virgifera
  misc_feature (2)..(16): n is a, c, g, or t
  misc_feature (18)..(62): n is a, c, g, or t
cnnnnnnnnnnnnnnncnnnnnnnnnnnnnnnnnnnnnnnnnnnnnnnnnnnnnnnnnnnnngtacctc

SEQ ID NO: 17382 - DNA, 972 bp, Diabrotica virgifera
  misc_feature (848)..(848): n is a, c, g, or t
  misc_feature (850)..(850): n is a, c, g, or t
aagatgtgtcgttaattgctgtattttctctctcttttacataatcaaaatgaatttatctcagtcaaagttattttctgctattattttgggggtttcgagtttgtttgttggggttgtaccaaattgtttcgctcaacaaggaagacgacgttggcctttgtttatatcaagtttactttgttttggtgctggggtactgctagcaacttccgtagtacatattttaccagaggtacgagaatcaataccagtgcaatatgaaaactatgccgaaattttatactgttgcggtttttttattctctacataattgatgagatagttcattacttctacggtgattccgaggaagcaaatctcttccacaaccatggtaacaatcatgaccaccacagaagacaatcacaacagctaaagtcatcatatggcactgctgaaagacacaatctactacatgccgagtccgcaccctataatccatctttttatagaactagaagtgacagtgcactgtttggtgatcagcaaccatctcagctgtgccacgttggccatcaagagccttgccataatgccccgactgctaactttggacttatagttgctctttcaatacacgagttgctggaagggttagttgttggattagagacgaaaccagaaaaggtgttgctgcttttgggagctgtagcatcccataaactggtgatttcattttgtttaggagtagaattatcatctaccccattaatttcgtgtacaagacactttatttacattcttatcttctcggtggggtctgctgctggtataatagcaggaatgattgtatcagatgttcctngnagggtttaagaatgttgcaatgcctatattacaagcacttgctggcggcacactgttatatgtaactgtaagtgaagtatacctcgagaaagactagatggcatcagcaacatgacagaaaa

SEQ ID NO: 17383 - DNA, 206 bp, Diabrotica virgifera
  misc_feature (7)..(44): n is a, c, g, or t
  misc_feature (64)..(77): n is a, c, g, or t
  misc_feature (80)..(93): n is a, c, g, or t
  misc_feature (167)..(198): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnaattaagtctgttcgacttttaaatttatcattgtgactctgagttttaacccggtgtgagcccaggttggttnnnnnnnnnnnnnnnnnnnnnnnnnnnnnnnngaaaggac

SEQ ID NO: 17384 - DNA, 830 bp, Diabrotica virgifera
  misc_feature (2)..(803): n is a, c, g, or t
  misc_feature (814)..(814): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatttatantataaatttatttaat

SEQ ID NO: 17385 - DNA, 210 bp, Diabrotica virgifera
tgcttgctcatactttcttgaagaagatccgttacctgaacctctgccagaagatgtaatttatattagagctgttacggatcaagagacaaaacctaaatatgttgcctcaaattaaattaaagacttctatatatttaagtaagtaatgtaaagttaatatttatcccgacattttgtgtattttctagttaattaatctaactgtat

SEQ ID NO: 17386 - DNA, 527 bp, Diabrotica virgifera
  misc_feature (4)..(46): n is a, c, g, or t
  misc_feature (52)..(74): n is a, c, g, or t
  misc_feature (265)..(338): n is a, c, g, or t
  misc_feature (343)..(408): n is a, c, g, or t
  misc_feature (426)..(444): n is a, c, g, or t
  misc_feature (453)..(467): n is a, c, g, or t
  misc_feature (469)..(485): n is a, c, g, or t
  misc_feature (488)..(506): n is a, c, g, or t
tttnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagctttcaat

SEQ ID NO: 17387 - DNA, 605 bp, Diabrotica virgifera
  misc_feature (115)..(136): n is a, c, g, or t
  misc_feature (196)..(208): n is a, c, g, or t
  misc_feature (211)..(224): n is a, c, g, or t
  misc_feature (474)..(494): n is a, c, g, or t
  misc_feature (496)..(509): n is a, c, g, or t
cgctcctccttcgcgtccgcttaggtatagaactgcgattgctggcagctttggactgtgtagaatcatttgttatttctcatatatataccattaccgaaataaccagtgctgnnnnnnnnnnnnnnnnnnnnnnttagaaccaccttaaataattattatgaaacgaaaggttattcccccttatatatcacgnnnnnnnnnnnnnccnnnnnnnnnnnnnncaataccgatatatgtataattgaatgttttgatgttattatcattaaattatttttagtgtacgactattgagaataaggttttattagaactgtaattattagatacctatcaagacaaaatatatcagatatgaagaaaaggtattcttaattcttatatacgattatctttattgttgataaagtgtttatgaagagatacctttatcttatctaagttcaggcacgatgatgatcatgagtatgnnnnnnnnnnnnnnnnnnnnncnnnnnnnnnnnnnnggaagggatctcgacagcatttttgtccgactgtatattacggaaatgtctattagaagtgtagataaagtatcaacggagcactgttaaattgga

SEQ ID NO: 17388 - DNA, 889 bp, Diabrotica virgifera
  misc_feature (402)..(428): n is a, c, g, or t
  misc_feature (499)..(560): n is a, c, g, or t
  misc_feature (815)..(815): n is a, c, g, or t
  misc_feature (825)..(825): n is a, c, g, or t
  misc_feature (860)..(860): n is a, c, g, or t
  misc_feature (872)..(872): n is a, c, g, or t
ctcaaattacaatattacaacatcagattacctccggcaagagagacagaagaacaaggggatcagtgcgtagatgtcggcactatcattgttgactggaagactgcttacgaaaccaaagacttttcaggaaaaataacagtaagttatagaaacggtaagaacaagtcggagatcccgtaccatatgaccattttgaagggcggtctgacgtacgatcctctcacaacgacgtattttataaacgacaagacggtggatttgtctgcgagatcgttcaaagtgaaaaacgagttcgacgagtacatctatgtcgctgacgttatttttccccgtgatattcatcattattttaagattcagagcctttggccgaaggtgataaaaccgggcgatgaaacnnnnnnnnnnnnnnnnnnnnnnnnnnncaacattaggctatcagatctccaactgcaatctttcattcttttaaaaacgaacatttcgcacgtgcggnnnnnnnnnnnnnnnnnnnnnnnnnnnnnnnnnnnnnnnnnnnnnnnnnnnnnnnnnnnnnnttccttggaaatcgggcttttgggcttcaacacaaagaaagaagtctattttatgatcgtcaaccataatcccgttacactcaacgtaaaacacgttcattcttctattccgatgactcacgcagatattctaggatgcggttcgggtgatttcagactgggtgttgttttctccttcgtttccgaatctcaccaaatgccataatctcaaagcaggccattatgccataataaaagtcaccattacaacgactncagtggaggngcaagtatggggcgacatctacgtggagactcagntcgagaatttgnaatccccgttcattcaa

SEQ ID NO: 17389 - DNA, 66 bp, Diabrotica virgifera
  misc_feature (10)..(56): n is a, c, g, or t
  misc_feature (60)..(60): n is a, c, g, or t
ggacctcggnnnnnnnnnnnnnnnnnnnnnnnnnnnnnnnnnnnnnnnnnnnnnnnttanagagct

SEQ ID NO: 17390 - DNA, 833 bp, Diabrotica virgifera
  misc_feature (162)..(199): n is a, c, g, or t
  misc_feature (203)..(234): n is a, c, g, or t
  misc_feature (243)..(786): n is a, c, g, or t
  misc_feature (788)..(822): n is a, c, g, or t
attcacctcaaataataaaaattctttcgtaaatgtaaagaaatttcactcacgatagttaattcgtaccggagagaatcttttcacttcctaaaagaaaaatttctcttcctcgtacctcgggtatcagggattcttaattaataattctatatttcttcnnnnnnnnnnnnnnnnnnnnnnnnnnnnnnnnnnnnnnatcnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnngacgagaaaga

SEQ ID NO: 17391 - DNA, 881 bp, Diabrotica virgifera
  misc_feature (816)..(816): n is a, c, g, or t
  misc_feature (836)..(836): n is a, c, g, or t
gtctttcgaacagtgcagtccaagagttgatcgagatgtatacgttcacagttagacagacatcgtaaaccgaatttatccttaatcgcagatcccaacttagcatcagccactaatagttgctctcgaagatccttatcaaggataaattcagtttacaatcgtctttcgaacagtgcagtccaagagttgatgagatgtatacgttcacagttagacagtttactgtcaggtttgccaaaaaaagaaatgactggtatggcattgggtttagcccattcattatctaggtataaattgaaattttctccagataaagtagatactatgattgtacaagcagtgtctttattagatgatttagacaaagaattaaacaactatattatgaggtgtagggagtggtatggttggcattttccagaacttggcaagataataactgataacgtagcttttgcaaaaactgttaaaattattggtactagagaaaatacagcaacctcagatttgtcagatattttacctgaagaagtagaagaaaaagttaaagaagcagcagaaatttcaatgggtacggaaatttcagaggaagatatatttaatattcaaaatttatgtgaccagatcctagatttatcaaattatagggcccagctctatgattatttgaaagctagaatggatggaattgcacctaatcttactggtctagtaggagaattggtgggagcccgacttatatcccatggtggttctcttattaatttagccaaacatcctgcttccactgtacagattccttggagctgaganagctctatttagagcactanaaactaagaaagatactcctaaatatggtctcatatacatacaca

SEQ ID NO: 17392 - DNA, 676 bp, Diabrotica virgifera
  misc_feature (22)..(43): n is a, c, g, or t
  misc_feature (166)..(213): n is a, c, g, or t
  misc_feature (231)..(265): n is a, c, g, or t
  misc_feature (282)..(378): n is a, c, g, or t
  misc_feature (380)..(430): n is a, c, g, or t
  misc_feature (447)..(470): n is a, c, g, or t
  misc_feature (475)..(529): n is a, c, g, or t
  misc_feature (558)..(584): n is a, c, g, or t
  misc_feature (628)..(643): n is a, c, g, or t
  misc_feature (645)..(658): n is a, c, g, or t
ccctcgccctctcgcgtccgcnnnnnnnnnnnnnnnnnnnnnncaaaagcaattaaaaatctttcatttgaatgagtagtataatatagccatgtgcgagacgaatattattatatcttataaataggaaacaatttatcttttgtgtaccttgttgtatcagggnnnnnnnnnnnnnnnnnnnnnnnnnnnnnnnnnnnnnnnnnnnnnnnnctaacaaattacaattcnnnnnnnnnnnnnnnnnnnnnnnnnnnnnnnnnnncaatgaaatgatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnncaaaaattacgattatnnnnnnnnnnnnnnnnnnnnnnnntatcnnnnnnnnnnnnnnnnnnnnnnnnnnnnnnnnnnnnnnnnnnnnnnnnnnnnnnnaacttcacatcatcataaatgtacgaacnnnnnnnnnnnnnnnnnnnnnnnnnnncatattcaatacaaatatataggtctaatacaggaactcatccnnnnnnnnnnnnnnnncnnnnnnnnnnnnnncctttatgtactgaccag

SEQ ID NO: 17393 - DNA, 538 bp, Diabrotica virgifera
  misc_feature (2)..(339): n is a, c, g, or t
  misc_feature (346)..(383): n is a, c, g, or t
  misc_feature (403)..(416): n is a, c, g, or t
  misc_feature (419)..(441): n is a, c, g, or t
  misc_feature (449)..(471): n is a, c, g, or t
  misc_feature (501)..(532): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 17394 - DNA, 643 bp, Diabrotica virgifera
  misc_feature (94)..(116): n is a, c, g, or t
cccccccccctttcgggcccgacgaagaaaaaccaacgcatggagccctttatcatagagtagactgagtagttgtatctgtatgaattgtgcnnnnnnnnnnnnnnnnnnnnnnnaagatttctattagccacagaactgctataaaacgtatgtgttcgatagaaatgtaactactgtttaaataatcaccaaatgaagaaggaaacctgagaaagctattcatgaactacgtcttgatgctcaaacagtatgtggaccgtagacgatcagatatgcctgacggactgagctgaaaaaaaaagtgttattaaagtagaatctctcacgacaaagaatgatcaacaacactcctacattatcatatgttatcgtgtatggttacataggactatgtctattctttaccaatacgatatctggtacttcaccatctgtctggagatttacgatgaagaagaaaataccgaatgatttgcagcaggtatactacaaaagtgtacacttatgaacgcgctctgacctgcatacaccctctgcaggacacaaaacacatggagttgttgatacaacgatatagactggcccgccccctgaagaatctgaatagggcgagtattcagaccgtgctcacgtagcacaa

SEQ ID NO: 17395 - DNA, 433 bp, Diabrotica virgifera
  misc_feature (43)..(63): n is a, c, g, or t
  misc_feature (90)..(107): n is a, c, g, or t
atttttagttattttatcataatagaatctccttttacaatgnnnnnnnnnnnnnnnnnnnnngcgagatgctaattaatattgtgagannnnnnnnnnnnnnnnnncacgcactcttaatgttttcgtaaccacgcgtaattaaggattatgaaatcgaaaggatattttcaatattttatctttttttttttgtctaaacatataagatttatatcggaaccgaagattgtcaaataagttgtattgataggtatatggcgtacgtttttgactgattccctcttgtgatgaaggtccagataatcagtatatataataaatacctaaccactcaacaattatctgatatgaagaaaaggtattcttagggctgggataagataatagatccttgatgaaatagtgtttttcaagagaaaccattgatcat

SEQ ID NO: 17396 - DNA, 640 bp, Diabrotica virgifera
  misc_feature (17)..(17): n is a, c, g, or t
  misc_feature (21)..(78): n is a, c, g, or t
  misc_feature (94)..(129): n is a, c, g, or t
  misc_feature (145)..(229): n is a, c, g, or t
  misc_feature (231)..(245): n is a, c, g, or t
  misc_feature (249)..(249): n is a, c, g, or t
  misc_feature (256)..(319): n is a, c, g, or t
  misc_feature (321)..(418): n is a, c, g, or t
  misc_feature (460)..(505): n is a, c, g, or t
  misc_feature (564)..(582): n is a, c, g, or t
acccttaaagccgaggnaatnnnnnnnnnnnnnnnnnnnnnnnnnnnnnnnnnnnnnnnnnnnnnnnnnnnnnnnnnngaggagggagagagannnnnnnnnnnnnnnnnnnnnnnnnnnnnnnnnnnnaaaagagaggaagagnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnngaangaaaagnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattaaaaagtttgatatttaaaaatatgatattattaagnnnnnnnnnnnnnnnnnnnnnnnnnnnnnnnnnnnnnnnnnnnnnngtgatttagattaataaaattgaggatagattataatataagtatataatgatatgttnnnnnnnnnnnnnnnnnnngtagaataaaatatttagtgtgagatttatattatgtggttataaaaaatatgatttt

SEQ ID NO: 17397 - DNA, 521 bp, Diabrotica virgifera
  misc_feature (2)..(114): n is a, c, g, or t
  misc_feature (116)..(173): n is a, c, g, or t
  misc_feature (190)..(220): n is a, c, g, or t
  misc_feature (402)..(419): n is a, c, g, or t
  misc_feature (453)..(477): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnaatgaactgttattcgnnnnnnnnnnnnnnnnnnnnnnnnnnnnnnnaattaaaaatacttattaccaagatattaataatcaaatatttttatcttcttctgattaacacatctttaggaatgagtttacaaaccatattctataaacatttactttttaaacaagacttaggactaaaatgtttcatatattataagaatatattactttactttaatatattatgnnnnnnnnnnnnnnnnnnggtgtttatccaaaacaagcttatacatgatgtnnnnnnnnnnnnnnnnnnnnnnnnnccatactacaaactggttatcttataattctactatttagaact

SEQ ID NO: 17398 - DNA, 646 bp, Diabrotica virgifera
  misc_feature (2)..(31): n is a, c, g, or t
  misc_feature (50)..(65): n is a, c, g, or t
  misc_feature (67)..(129): n is a, c, g, or t
  misc_feature (131)..(307): n is a, c, g, or t
  misc_feature (310)..(345): n is a, c, g, or t
  misc_feature (359)..(399): n is a, c, g, or t
  misc_feature (463)..(481): n is a, c, g, or t
cnnnnnnnnnnnnnnnnnnnnnnnnnnnnnngtactagtaaagaaaaacnnnnnnnnnnnnnnnngnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnnnnnnnnnnnnnnnnnnnnnnnnatattgtttatgtnnnnnnnnnnnnnnnnnnnnnnnnnnnnnnnnnnnnnnnnngaaaaaatacaaatctaaaaactttcttattttaaaataagttattattcattgttatatatgnnnnnnnnnnnnnnnnnnngattttttattagtatatcgccttaaattatattatctttcagcacggatgttaatattagtagttaactgattgtatcatttagtataaatatataccctgaataaagtaacttcggccaggtatttttcacctgttcataataaacatgcctttttagattaa

SEQ ID NO: 17399 - DNA, 795 bp, Diabrotica virgifera
  misc_feature (62)..(93): n is a, c, g, or t
  misc_feature (159)..(182): n is a, c, g, or t
  misc_feature (329)..(350): n is a, c, g, or t
cttctcgcgtccgcgtgcgtgagcctaagatcctgttcctccttctcgtcttataattattnnnnnnnnnnnnnnnnnnnnnnnnnnnnnnnngaacacagtactccttaaaatgtaagttaataaaggatctatgtacactttttatctctaccaccnnnnnnnnnnnnnnnnnnnnnnnncttttttactacagataataaaaatattagatttagaactacctattctatttctttagtctatttagatctgatagaaaaaaagttctaggataaaaactttatcttcatgctcttgtgacttcaattatgacaaacaataactcnnnnnnnnnnnnnnnnnnnnnngataaagcgaataaaaactgatgatgacccatttcttgttatcgtgataacattaaataaacacttttctatgattattgcatgatactgatataaacggataagacaatccatgacatgttgatactcctattgaaccgtattaggacgtctttcctaacttctacttccatttttggaaccagcatctacttactctctgacgtactccttgacagaagtaagactaaggaacgattgctatgcacgcaagattactctctcatcatccagatacatgcccactgcctcttatgggcttcccatgtataaccactccactgaacgcaccctatgcttgtatcgcagtctgacgaggcaaaccacgatcgtgacgtcaaaatagatgttagacgccaagagtacaatcacggagatttaaacgaggaatattttagattttcta

SEQ ID NO: 17400 - DNA, 557 bp, Diabrotica virgifera
  misc_feature (38)..(56): n is a, c, g, or t
  misc_feature (163)..(180): n is a, c, g, or t
tctttcggcgtcgttcgagttgataaattgaattattnnnnnnnnnnnnnnnnnnngaggatgtgggttgttattttttgagtgattgccaagttctgatatgtagagaccaagagttcttgtgcaacaggtctgctataagtagctatggattgatatatannnnnnnnnnnnnnnnnngttacgaatagaaagaatttaaactgtggtgcatattcatgatctcgaccaacatggacacactgtagtagactgtgacgttacggaaagatgagtatatatatcctatagtgaacgtagaataaaacgagacgacatgcccgcaaaattggatgaccaccaccatgacgataacaaatgatgatgatggatgcttataagaaaaggagactataagtgacaaataggaaaactgttacacctccaaatgggtgtaggaattagaaaggatggataagagaccgtgtgatccgtgagcagggaatctagaagggtgtatttttagtgaagagcactctgagcctgactgtccccgatcatgatttcaagcattcgga

SEQ ID NO: 17401 - DNA, 409 bp, Diabrotica virgifera
atctaatcatgtttgcgatgttgccatgagattcttatctaaaatatgaaatgctaagcacactagtgatccgtctcattgatattttcctacgctcgtgttgtcgtaacatgatgtcatgatatagacaatagtctatcttcacaccgactacaaaaacctgctctgaaacgcagaagatgacgaaatccacctcgatgcacctccgcaccacctcaaattaaacagcaatataaccacacaaatcccgtatgatgccatctatcacccatcgtcatggcactaatacatcacgtactctgagtatacccttcttgtcgtaccacacgactcggcttacccttgagagatgttgtcacactcaatcaatgtaacgaacaaagatatagtattcctgccatcatcctct

SEQ ID NO: 17402 - DNA, 888 bp, Diabrotica virgifera
  misc_feature (727)..(727): n is a, c, g, or t
gttgaaaaagtatctaatcgttacaaagtactcgttacttacgaataccgaaagtaacgattactatacagagaggcaaatcgttactttgatcacttttattactctgattatttcgtaccaattgtatcagagcgactaacgactattgtatctacaaccagtacacttgatttctttctatgaaaaaaaataccaatcgtatcccagcgagtaacggacgggaccggtattttacgagtgttatcgaattttttattccttaaacagatcggtgaaagtcgttgttatatcggaatacctatacaaaatacctacctactgagaaatacgattctcgatatgattaccggtacatactcaaatacaaaagtaatcatagtaatcaaagcaacgaatactgtaaatgattactttatacaaaagtaacgatttgtaacgaatactcgaaagtaactacaatcaacatcactatatggtctggttatctgtacttaagcgaattttgtgcccagatatttttttgttgatgttctatacttgtgtcagttatgttgaagttctcactcagaatgaggtttgtcatcacttgtgtttttgagttgttgatctttaaacccacttctgtagaggcatggtgcatggtagagcctttatctgttatcaggactatgtcgtccgcgaacctgagatgactaagttgctgtccatttatgtttatgccttntgcgtctaggtttgtaggcttacacatatattctagtagaaatcatacagaaatcatcaagcagatacaaaaacagaatggaatggatgagtaataatgtactctaatagaaagatataggaaatataaacacgttggtataaagtacgagggggcaagat

SEQ ID NO: 17403 - DNA, 703 bp, Diabrotica virgifera
gcgactcgaagtgaggatggatgtagctcctttttgacttagttaatatagaaatgtacagcatgaaatatgcaaatcgatggaaaaaaaataatacgggctgcctgcttaagcgcatccaaaattacgtacaagtgcatgacacacaatctcaactctatagtgagacctatattctattcactgcgtcgtagttttacaacgaagtgaccgataaaaacctgatctcacccaactcaaacgccttgcagaacatcccccattcgtcagctaggagtaacatccgaacacgacctgctaacgatcgatccttcccaacaagttgcacagccagaatggagaatgtgacgcgaccagtagcggagcatgaagcgcggcgagagtggaggttacgcgaacagcgaccgctaaacttgcaagcgaccaacagcccgatccattcagtttcttcccttccaatctcgacacgttaggcgcgtttccacgtgaagatctaaatagtcggctcccatatagggtgatgaagtagcgctttactcaaccacgaccccagaaaaatagaacaggtggaaggttcacgcagtgggccaacgcactgatagaccgattttcgccctttgtctgagaaggccacaatcttagtactgtactctagatctaaactggaagaacactcatacctatctcggactaggctattgat

SEQ ID NO: 17404 - DNA, 633 bp, Diabrotica virgifera
  misc_feature (20)..(39): n is a, c, g, or t
cccggagccggaattcccgnnnnnnnnnnnnnnnnnnnnggggtgtattttcagatacgatagtattttatcagattacttttattataatgataacgattgccaccaaatgaacgtccctggaagcgatgtttagattttatataactaaacctgatttctggtatcttatgtaccaacgagtatccagtattatcaatttaccgattattcctccgttatactcaacctcaccatcgcatgttaatttctactaatgaaatgctataaaatattttctatccttgtgttgtagttccatgttattcatatctagttatatctaatttccacaacgagcatttaaaaccattctgtctcgaagtaattattgatatataataagatacacccaagattcgactcacagtaaacacgagtatattcatcaagacttaatatgtatgctacctatcatacaatacgcactgtcctatgatatcactcatatcatggagattcgatctcgtcttccctatctattctatagacccttgataaatgttgtatttttaaatctatgtaatgaataaagatatagaaacgatgacaacacctgctttaagttactgcgtatatatctatgatatatag

SEQ ID NO: 17405 - DNA, 923 bp, Diabrotica virgifera
  misc_feature (6)..(20): n is a, c, g, or t
  misc_feature (878)..(878): n is a, c, g, or t
ccttannnnnnnnnnnnnnnaatgtgtaaagatcgtgtcttcttagtgtttttgttttgtagacgacatgaagataaccttagtgatagccttgctcgttgcggcattattcaaggaatccttacagcaatgcttccctccatttactggtaatcaaccaagtcaaaaagccgccccagacctttattctggacaacaggacttttcgttggctttactgaacgccgtcaacaaagtgattcccaatgaaaatctcttcttctcgccgtattctacgtatcatgctttacttatggcgtatttcttatcaggtcgacagacggaaagttatttaaagaaagttctacgactgaatcaagctcaggagaaagcagacatttacgccgcttataaagtagataaattcgtgacccaacttctagccaaaagtgcaccttatgaattcaccagcgctaacaaaatatatgtagaaaacgaagtaccagtgcgcgaatgtgtattaaatgattttccaagtgaattggaaatgaaagattttaaaagtagtcccgaagctgctagacaacaaataaatcactgggtagaaaatgttacacacaatatgattaaagatctcattcctcctggtacgattgactcatctacaaatttggttttggtaaatgcagcatatttcaaagggttgtgggagaataagtttccaccagaatataccaaacaagaagtgttttatgtgagtcccacaaagcagattatggttgatatgatgcatgtcgaaggaacatttaaacatgacgtgtctgaatctttgagagcccacattttggaaatgccgtataagggagataatataagtatgtacattcttctccctccantttcaactactgaaaactctatagaagctacattaaagaattaac

SEQ ID NO: 17406 - DNA, 856 bp, Diabrotica virgifera
  misc_feature (2)..(17): n is a, c, g, or t
  misc_feature (19)..(61): n is a, c, g, or t
  misc_feature (69)..(852): n is a, c, g, or t
  misc_feature (854)..(854): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngngt

SEQ ID NO: 17407 - DNA, 909 bp, Diabrotica virgifera
  misc_feature (4)..(736): n is a, c, g, or t
  misc_feature (738)..(892): n is a, c, g, or t
  misc_feature (899)..(899): n is a, c, g, or t
atcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaanttatttaatt

SEQ ID NO: 17408 - DNA, 99 bp, Diabrotica virgifera
gtggacttgagtacactaaataattaaattaattaaaattcatacatttttgtaacttaagacaatgtttaaaatttaagtgattataatttagtatat

SEQ ID NO: 17409 - DNA, 1008 bp, Diabrotica virgifera
  misc_feature (45)..(45): n is a, c, g, or t
  misc_feature (82)..(82): n is a, c, g, or t
  misc_feature (965)..(981): n is a, c, g, or t
ttggtacggccttgcagggtaccagggtccgggaaatttcccggnggtcggactccacggcaggtccggcatggaaattacncgtagggattcaagaaaatggtggaaaaacctctcaacattcgggatacctcggtccaaggatcgcttcaccttcgatcatcgtccaaataccaatggtggccttcggttcttcatggtggtagggactctaaacctaataactcggaagaacattctagagagctaacgtccattcgctcgccaatggttaaccgggctaacccctttctaacgaacaatatgcgacttctttcgatctccaatcgacatctaataatcggtttccaaaataactttcaactttcagtcggaccagcagcaataaccaaaaggctcggcagaaggattctaattcaaaaaattaatcaacatatttttctcggccagaaaaaccaaggaggtcactcgggggtgaaaaattcattttctcgtcataactttcattctcgttagaacaaccttctcagggcaaggaggcttcgtttcaaattccgtaaatcagtaaaacttcgcccaaaatagcagaaaggaactctaagaaacgggtaaatggcaacggaaattaagaatgaagggaaaaaccaaacaggtttcatgcatgaaaatttcttcgaggcatttctatgaaggaatctcgggtgggattctctccaaataacaatggtttcatgaacttcggaaacggaatgaggaaaacttcaaggaaaaatcttaagaaccaaggctcacaaaactcgctttccttcattaatttctcgctcgttggtgaaacttggagggcttaaagaatcaaattcagtttcgctcataattaaaccgaggataaggcttacgtttcggaaggaaagctcgccggtcaaggcacatttcagggtggtggtctggataaaccttgataaaannnnnnnnnnnnnnnnngaggcaatagggatataattaaccttc

SEQ ID NO: 17410 - DNA, 923 bp, Diabrotica virgifera
  misc_feature (874)..(874): n is a, c, g, or t
agtaactcgagatcgccgccggaagggacggctaccggttagccttacaaaccagggagcaacatattagaagagataaagccacgagtaacatttgtacagctcaagcactcttggccaacatgtctgctatgtttgctcgtatatcacggtcctcaaggtcttaaagatattgctaccaagatacataatttgactttggttttgcaccatggtctccaccaagatggaaacacattatcaaacaaactcttctttgatacattgaagatctatccaaaactagacgtagaagaagtcaagacgagagcccaggaaaaaaagattaactacagatattacgatgacggtgctgttggtgtagccttagatgaaactgttacttttaatgacgtaaacgatatcttttacaccttcggatgtccacagaaagtagaaaatattgttaacagtccaatgatccgtgaaagggcaatctatagaagtgaatacaaaagaacatcacctttcctgacacacccagttttcaactcccaccattctgaaacaagaatagtgcgatatatgaagatactagagaacaaagatatttctttagtgcacagtatgatacctttgggatcttgtactatgaaacttaactcgacaacagaaatgatgccttgttctttcaaacattttactgacatacatccctttgcccctacagaacaatgccaaggctaccatcagttattcgaagaactagagcaggatctttgtacaatcacaggctatgacaagatcagttttcagcctaatagtggagctcaaggagagtatgctggtttaagggcaatacaatgttatcacgaggcaaagggagaagcacatncgtgatgtatgtcttatttccatcagcgctcacggtactaacccagcta

SEQ ID NO: 17411 - DNA, 907 bp, Diabrotica virgifera
  misc_feature (407)..(424): n is a, c, g, or t
  misc_feature (428)..(463): n is a, c, g, or t
  misc_feature (466)..(480): n is a, c, g, or t
  misc_feature (496)..(543): n is a, c, g, or t
  misc_feature (545)..(583): n is a, c, g, or t
  misc_feature (593)..(676): n is a, c, g, or t
  misc_feature (678)..(698): n is a, c, g, or t
  misc_feature (702)..(730): n is a, c, g, or t
  misc_feature (744)..(762): n is a, c, g, or t
  misc_feature (766)..(801): n is a, c, g, or t
  misc_feature (811)..(906): n is a, c, g, or t
gcggtccgatttttacttcttttcaaaacatcaaatcacttttaggaaaagtaaatgaaaattttcattcaacggtagttcattaggtaccgcgtgagaatattttctttttctcaaaggaaaatttaatttttctacctcgggttcagggattcataattcataaatatcatactaataattttcgaaattcaaagaggtcaaaaattcaaaattttaatcgtaaatcaaatatttcaatcatttttttcggtaagaaaacgttatttcgtttttcaaaatcttctaaattttttcaggaataaattaaatttctttcttcaacaatatcatttctaaattaaaataattttctcatctttctctaaataattcaaaatacattttctcatggggatggaggcttnnnnnnnnnnnnnnnnnnctcnnnnnnnnnnnnnnnnnnnnnnnnnnnnnnnnnnnnggnnnnnnnnnnnnnnnaactttaaaaaaaggnnnnnnnnnnnnnnnnnnnnnnnnnnnnnnnnnnnnnnnnnnnnnnnncnnnnnnnnnnnnnnnnnnnnnnnnnnnnnnnnnnnnnnngtaatgatgnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnntggnnnnnnnnnnnnnnnnnnnnnnnnnnnnngattaatttggaannnnnnnnnnnnnnnnnnngggnnnnnnnnnnnnnnnnnnnnnnnnnnnnnnnnnnnngttggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 17412 - DNA, 850 bp, Diabrotica virgifera
  misc_feature (2)..(839): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatttaat

SEQ ID NO: 17413 - DNA, 779 bp, Diabrotica virgifera
aattattcagaatggtcgatctacaacgccttttttaggtaagaattagtatgtaaagagagatatttataaatatggagtggttgatgggatatagtttggataaattatattatatagttaatctcgcccttgtacgtaaccatctataggatgcatgatagtgcactaaactcgttctatccgttacctctactagacaagtcagcatcattgtagttgcatttctagtgcatacaacaacatctctatcgcttctccaagcaagtcattcgcttaggagagcgtgatctctacacatcctcaatatgaactttgtttattcatccaaacaccatatcactcacgacgccgtcctgtctcgactcttatacaagatttcctacctactgaggatcacaattctcgagatggttactgaaccatcctcgatactgaaattgatcatacgaaaccaagatacgaataactgccttggatcaatctatacatcagtaacaatgtgtttcatgtactccctcgcagctacaagctgaaattatattgagtgtgcttatctgtacttaattctactctgtctacatatatgtttatgtagaagtgctatactcgtgacatatctgtggtaaatatcacttcgggtgatcatcggcatcaattgagcttctcaataagaccagattgtagcacacttttggaacgtgtgacagaatgtgatcggctctatatgatatatcaaatagaatttttacaagacagtaatgtttaggatattgtcc

SEQ ID NO: 17414 - DNA, 779 bp, Diabrotica virgifera
  misc_feature (2)..(18): n is a, c, g, or t
  misc_feature (23)..(46): n is a, c, g, or t
  misc_feature (55)..(70): n is a, c, g, or t
  misc_feature (72)..(84): n is a, c, g, or t
  misc_feature (96)..(132): n is a, c, g, or t
  misc_feature (138)..(169): n is a, c, g, or t
  misc_feature (178)..(556): n is a, c, g, or t
  misc_feature (558)..(589): n is a, c, g, or t
  misc_feature (598)..(772): n is a, c, g, or t
cnnnnnnnnnnnnnnnnnctttnnnnnnnnnnnnnnnnnnnnnnnncctacctcnnnnnnnnnnnnnnnncnnnnnnnnnnnnncacatttctccnnnnnnnnnnnnnnnnnnnnnnnnnnnnnnnnnnnnncctccnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagag

SEQ ID NO: 17415 - DNA, 898 bp, Diabrotica virgifera
  misc_feature (366)..(388): n is a, c, g, or t
  misc_feature (833)..(834): n is a, c, g, or t
aatcccctttaccaacatgtcctgccttatcgtctccccccaggtcttctttggtcttcctcttctacttttttactggtttccagttcattatcttcctgatcagttcttctacccctcttctttgtgtgtgcccaaaccatctgagcctttgtgctttaatgagttttactatatcttctcctttatttatatttattacttcatggttcatcagctttctatattcccctgtttctgtctttactgggccatgtattcttttcataatttttctctcaattattcttaacttttcttcgtcttttttcgtaaggcacattacttctgctccataggctatcactgatctgattgctgctgtgnnnnnnnnnnnnnnnnnnnnnnnctcaggtttttgtccttgagtaattggtgatatttccaatatactctattacctgctttaattctttcgtttatctctatactccttccgtttttgccgtccaccatcacccccaggtatttgaagcaatctattctctggaatgtattttcacctatctttatttctgttattctgtttacattgtctcgtttgcttataagatattttgttttattctgattgattattaatcctctcgtctttgcttcccttaccagggttaaaagtgcctcttctagtctttttatctcgtgctaccagtccaaggtcatctgcatatcctatgatctgtgttgagctttgaattattgtctttttcagccctgtgtcactaattactccttctagagcgatattaaatagtgtcgtttgtcgtcgacagactgtctccttgtcttacttnncagtctatttttatgtcatttgtatcgccctcatttgttttaactttttgctgtgagtctttta

SEQ ID NO: 17416 - DNA, 616 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgagcgta

SEQ ID NO: 17417 - DNA, 865 bp, Diabrotica virgifera
  misc_feature (2)..(16): n is a, c, g, or t
  misc_feature (19)..(35): n is a, c, g, or t
  misc_feature (40)..(63): n is a, c, g, or t
  misc_feature (71)..(184): n is a, c, g, or t
  misc_feature (194)..(826): n is a, c, g, or t
  misc_feature (830)..(830): n is a, c, g, or t
  misc_feature (833)..(833): n is a, c, g, or t
  misc_feature (838)..(856): n is a, c, g, or t
  misc_feature (858)..(860): n is a, c, g, or t
cnnnnnnnnnnnnnnnccnnnnnnnnnnnnnnnnnctttnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattnatntatannnnnnnnnnnnnnnnnnngnnngtgat

SEQ ID NO: 17418 - DNA, 694 bp, Diabrotica virgifera
cccgcctttgcgcgcccgtggaaggtacgctcaatatgtaaaaaagccaacagtcatttgaataaaaaggaaaagggtaataattagctggtgattgaagataaaatatgttgattttgagttgatatccacatgcagaagaataaactttacaactgcaagcacattctctcgaaaagatgattctgtgctcaaacttttgaatctatatttgaccacgtccacatctaactgttgacaacaatgatgaatgttaaaagcagaagccgtgcgcaaatcacaatgtctgaactcgaatatatggattcttggttattaagaattgcaggcattatgaagtttgtttttctgcttatcacaatagtttttctgctgaagatgtaattttaagtatggtctcttttatggattaataaaatcaagtatgctgatatccatatgtatcactgatgtgaatgtagaatataagatatgtagttgtcatgattatagaagaaagcttgagcttagagaaagagacaacagttcagtattcaaatgcttgttatattgtttatatgaaattgtagtactaccgaaagtgtagatgctatagaaggatttctgcctcttttatacacatgttcattgattactctgtcttttctgtcatagcatatggagtctgcagtctgcccactgattaatatgaatg

SEQ ID NO: 17419 - DNA, 901 bp, Diabrotica virgifera
  misc_feature (645)..(669): n is a, c, g, or t
  misc_feature (824)..(824): n is a, c, g, or t
  misc_feature (851)..(851): n is a, c, g, or t
  misc_feature (877)..(877): n is a, c, g, or t
aaggcacacttattgctgatttttgcgttaaaaataatatgcaatgtgggcggttatgaagtgttagtggtttttccaagcccggttccaagccattatatcttaggaaatgcgttagcgagaggtttggccaatgctggacatagtgttaccatggtgagcccgtatgaagagaaagatccaccgaagaacggtagctacaaagatgtagttctaactggaatttttgacatgatgagagagttgaatccacctcaatggatggagtttggagcaatgaaccccgtagaaataatttaccgcacgcacgcccctggacacgccaccaccaactttacactgagacacccaaatttccagaaattgttaaactccggtcagaacttcgacgtaatcattttggagcagtttgtaaatgacgcccttaaagccttaggttgtcatttcaacgctcctgtcatacctctatccacgtgcacacccagcatgtgggtaaacctacctgctggtaatccagaggtaccatcgtatatgccagacctttaccaagattttcctacaaagatgaacatttggcaaagaggaatgaacagtttgtttatagttgcaagacggatcctgaatgacttcgtatttttaccagtnnnnnnnnnnnnnnnnnnnnnnnnntttcctcattgtgccaaaggtagagagttctattacaacgtatcactgacactagtcaaccatcacgagactatcaatggagcaagacctttcgtaccaagtatggtagctattgcaggattccatcttaaccctccgaaaaagttacctaatgnaatgcagacgttcctggacgaagccanagaaggagttatatatttcagtttgngtaccaacgttaatccttcgtcgc

SEQ ID NO: 17420 - DNA, 897 bp, Diabrotica virgifera
  misc_feature (287)..(304): n is a, c, g, or t
  misc_feature (313)..(344): n is a, c, g, or t
  misc_feature (356)..(407): n is a, c, g, or t
  misc_feature (436)..(454): n is a, c, g, or t
  misc_feature (458)..(476): n is a, c, g, or t
  misc_feature (495)..(513): n is a, c, g, or t
  misc_feature (516)..(573): n is a, c, g, or t
  misc_feature (599)..(669): n is a, c, g, or t
  misc_feature (680)..(811): n is a, c, g, or t
  misc_feature (825)..(851): n is a, c, g, or t
  misc_feature (853)..(889): n is a, c, g, or t
ggaaatttccccggagagtcggaacccaacggcaggtccggcgggtacggcggtcgggggtttcttactcttactcttctcaaaaatcaatcaaaatcatccttctcggtaaaaaggtaaatggaaaaaaatcttctcactcacaacgataggttcaatctacgtattcgggggaggataacttccacctcctcaaaggaaaatttaacctttcgtacctcggggtatcagggattcacaaattagataaattatcatacctaacaaccctcgaaatttaaaagggnnnnnnnnnnnnnnnnnnctcaatcgnnnnnnnnnnnnnnnnnnnnnnnnnnnnnnnntaaggaaacggnnnnnnnnnnnnnnnnnnnnnnnnnnnnnnnnnnnnnnnnnnnnnnnnnnnncttcaataaacaataataattttcaatcnnnnnnnnnnnnnnnnnnncaannnnnnnnnnnnnnnnnnncttttagggatggaggctnnnnnnnnnnnnnnnnnnnctnnnnnnnnnnnnnnnnnnnnnnnnnnnnnnnnnnnnnnnnnnnnnnnnnnnnnnnnnnggtattaatcttaatcttttaatcannnnnnnnnnnnnnnnnnnnnnnnnnnnnnnnnnnnnnnnnnnnnnnnnnnnnnnnnnnnnnnnnnnnnnngtaatggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactggattannnnnnnnnnnnnnnnnnnnnnnnnnngnnnnnnnnnnnnnnnnnnnnnnnnnnnnnnnnnnnnngtggaatg

SEQ ID NO: 17421 - DNA, 919 bp, Diabrotica virgifera
  misc_feature (22)..(22): n is a, c, g, or t
  misc_feature (546)..(572): n is a, c, g, or t
  misc_feature (747)..(776): n is a, c, g, or t
gtacgccttggcaggtaccggngtccagggaattccccaggggtcagactccatcagcagtccagacgaacctcatttatattttctgttgttctcaattacgtgttctcttaatatatcttatacagaaaagaatacacaagaacactggaccccactctcgataaggtggaagagatggagaataatctgttagaaactctatatcgtcgagaaagctcacccatctcattttcattaacaagaagttagaaattcttccgtcgataaaaatcgaggacaaattttaatctctgaaaactaatatcttttttgacatctatcgcatacgtatgtctgatataatcgaaaaaaataatagttgggaaggggaaattatttgaaagaatgctatgaccccatttcaacgtatgagtgttatcttttttcatagttaagggtatctcttaactaatacgacgtattccagtaagtggccctttattagctcgtagagacgggagatttattgtactttgctctactacatttagcgtttatatttannnnnnnnnnnnnnnnnnnnnnnnnnnaaataacgaaggagcggcaatagctggctttcgaaatttataaacaaagaccagagtaatttataaattaatatgtgtaatttatggatttggaattgctagaatctcctaagtggttgatcatattatttataataatagagttttttatgtgatgtacctcgatagccattgnnnnnnnnnnnnnnnnnnnnnnnnnnnnnncttcttaaaaatagaaattttgatgtaatatatattgattactatgttcagcactaaatatgtaagaatcagcatggtgatacttgctgataattagataaagacaattatcgtcatagatccagttgtttgaacaacctttt

SEQ ID NO: 17422 - DNA, 640 bp, Diabrotica virgifera
gaatcgtatgatttgaaagtgaattccgaaagcaatttatagtttttgttgtaataaaatagtgaatttttagtaactacctttaattcctgtccagtgtcttcttatttgtcagcccagttttaaaaaatgtcagcaaaagctatacggtaggcgacagggaaacacctcatcaacaaatacctcggtcgggaacacacgcggccgtacaatgcagatttgcttcagtcgaggctgacactaaattctctgaattagtaagcaacaacccatgtttgataactgaaaaactagtcgttaaacctgatcaactaatcaaaagtagaggaaaattaagactgatatccgtaaataaagatttaaacaccgtagtggactgtgtaaatgaacgtatgaaccaaaatcatcaagtcgacaacgccacaggaaaattacgatacttcatcatcgaacctttcgttccacacaagcaagaataagaggcttatgtgtgaatatactcacatcgtctcgcagacactatcctcttttacctcgaaggtgtgtgtagatatcgatgatgacgactgcaatgcgcttattttacatgttctctgctgtagagacctgaggaccctggaactatttctaaatatctagt

SEQ ID NO: 17423 - DNA, 729 bp, Diabrotica virgifera
  misc_feature (367)..(380): n is a, c, g, or t
  misc_feature (383)..(397): n is a, c, g, or t
  misc_feature (440)..(491): n is a, c, g, or t
  misc_feature (505)..(529): n is a, c, g, or t
atatttttcgaaatttaaaaggaggctaaaaaaatctcaaaaattttctaatcggtaaaaataaaatcacatcttctaaaataaattcttcttctcgtaaatcggaaatggttaatttcggttttctaaaatacatattctaaattttcttagagaaaataaaatctaaaattctaatcttacatctaaacaaatacatcaatctctcaatcaaatctagaaatacattctctctacataatctacatcttcaaatacatctagaaatcaatctttctatgagagaacggaggctctaaaaaaataaaaaattcttaatctaaaaaattctaaatctcttctaaaataaaaaaattcataggaatcnnnnnnnnnnnnnnatnnnnnnnnnnnnnnncggttaataacctaacctttaaaaaatctaatctaatttctannnnnnnnnnnnnnnnnnnnnnnnnnnnnnnnnnnnnnnnnnnnnnnnnnnntctagtaaagatcnnnnnnnnnnnnnnnnnnnnnnnnngataattagtaaaaaataataataggttaataaagggaattcggaacatttttttcaccggtaataaaaaaaggttttttggaataaatataaaggttcggccggccatggataatttgaagagccggggtattttgaccggggtaagggagcataatcataagttttttaatggaaggtggaatggaagggttggatgg

SEQ ID NO: 17424 - DNA, 899 bp, Diabrotica virgifera
  misc_feature (231)..(253): n is a, c, g, or t
  misc_feature (387)..(407): n is a, c, g, or t
aaaactaaaaacttcgtgttcaatagttttcaaaaatctatcgaaagataccaaacacgaccccccacggaagtggggtggggggttactttaaaatcttaaatgggagcccccattttttattacagatttggattctttgcataaaaataggcaacttttattcgaaacatttttttgaattatggatagatggcgctataatcggaaaaaacgattgttggaaacggnnnnnnnnnnnnnnnnnnnnnnngtccccaccaaaatggaaaattttactttttaggtttaggacctaataatcacaacccaataggtccccaaagcgctcgagtgactgcacatttagcatactttgctcccctaccatttggttttatatttacnnnnnnnnnnnnnnnnnnnnncagttaaataaagaaagagttgcaatactgactttggggtccccagacaaagacaagtggaatttataactcaatttgtgaaaaatttgcatttgtatcactgtttctccaaaggtttgatatactaaaaatattaattgttttttttatgtaatttactcgaaagttttgtatttctcaaccttagacaacattcaatcttcttaacaatagtaactttgttgtgactttttttaatttctatatttatctttatattcgtaataatctgtatggtgttcaagctgtttaatgttgaagtccatcaatctcctcaatagtgaaaaaagattaaacacttcaataaattaactttataaagtgcgttcacgaaataatagcgatttcctaattattaccactaacactctgacagtacgtatcaataccacacatcgacgtacgtttcactttatttttgattcaacttgtttgaaaatgaatcgtgacgca

SEQ ID NO: 17425 - DNA, 911 bp, Diabrotica virgifera
  misc_feature (372)..(389): n is a, c, g, or t
  misc_feature (566)..(597): n is a, c, g, or t
  misc_feature (599)..(629): n is a, c, g, or t
  misc_feature (656)..(673): n is a, c, g, or t
  misc_feature (726)..(747): n is a, c, g, or t
  misc_feature (842)..(859): n is a, c, g, or t
gcggtccgtttacacgaaaaattcaataccttctcttagaaaattcattcaataatctcattcaattctctttcaccataccccctcctaataatttctctcaatagcgaaattctcggatcattcattaggactcacgtttaggaattcaaattcttacaggcctctttttcgctatacattaccgcccaaacgtagaattagcatttaatagagtcgctcataattcgccgagacgtaaattatcggtcgattactacgaacattacacgcaaacggagcatcatttttttttcttcgtttatacatccatatcggtcgaggaatatattatagatcttataatataattgaaactcgaataattggagnnnnnnnnnnnnnnnnnnacaatagcaacagcatttctaggatatgtattaccacgaggtcaaatatcatttcgaggagcaacagtaattactaacttaatatcagctattccataatttaggaaatatattagtccaatggaatttgaggaggattagcagtagataatggcaactttaactcgattctttacnnnnnnnnnnnnnnnnnnnnnnnnnnnnnnnncnnnnnnnnnnnnnnnnnnnnnnnnnnnnnnncaaacaggatcaagaaatcctttgggnnnnnnnnnnnnnnnnnngataaaattccatttcatccttattttacttttaaagatatccttggtattcnnnnnnnnnnnnnnnnnnnnnncaacattaactttaaaagacccatatttattaggagaccctgataatttcacccctgcaaatcctttagttacaccagttcatattcaaccagannnnnnnnnnnnnnnnnnatatgcaattttacgctcaaattccaataaattaggaggagtaattgcatta

SEQ ID NO: 17426 - DNA, 737 bp, Diabrotica virgifera
  misc_feature (238)..(260): n is a, c, g, or t
  misc_feature (268)..(293): n is a, c, g, or t
  misc_feature (341)..(361): n is a, c, g, or t
  misc_feature (363)..(449): n is a, c, g, or t
  misc_feature (451)..(729): n is a, c, g, or t
ccgggaaattcccgaggtcgaacccacggcggtccgatttttcattcacttacaaaacacaaaacatttctacgaaaagtaatgaaaaatctcacccaacggattgttacatcgtaccgcgagagaaataacctaactctctaaaagaaaaatctctcacccctcgtacctccgcgtattcagggatctaacaaattaaataatctcatcataacttaactaaccctcgaatcttaannnnnnnnnnnnnnnnnnnnnnnccaatcgnnnnnnnnnnnnnnnnnnnnnnnnnncctcgtaacgaaacgttattcgtttttcaaatatcatctaattttttnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactg

SEQ ID NO: 17427 - DNA, 858 bp, Diabrotica virgifera
  misc_feature (196)..(216): n is a, c, g, or t
  misc_feature (822)..(822): n is a, c, g, or t
gtggggcctactatagacgccgttatacgtgccgatgttaaatttgcagaatttattttaacatcttcgaaagcaatgaagaaatcctcggtatacggttttcttcatggatggctcgggaaaaggtcttctcactagtacaggaacaaaatggaaacagcataggcgcatgcttactccaacttttcatttctcnnnnnnnnnnnnnnnnnnnnncatatttgacagagttggagatattttcattagaacattaaagcaacaagtaaacacagcctcattaaatgtgtttcctttagttactttgtgtactttagacattatttctgaggcggcgatgggtattcaaataaatgcccaagaatcccaaacatcagaatatgtaaagtctgtgaatacaatgtgtaacatatttattggtagagtgacgtctcctatcccacatttcttgtaccgtttgacgccaacttactacagagaacggaaagctatcagaatattacatgaccagacagacaaaatcattgatattaaaatggaagaaagaagtaaaaacgcaaacaaccaacaggatcaaagtaaccaacaggatcaaagtactaggaaaaggcttgcatttttagatttactcttggagagttctattgatagtaaaccattatctagactggacattcgagaagaagttgatacgtttatgtttgcgggtcatgatactacagcaacagccataagctttgctttatattgtttagcaatgaaccccaatgcacaggaacaagcatttattgaacagacagaaatgtttggtaaaaatttaanaacggctaaaccgactatacatcagcttcaagaaat

SEQ ID NO: 17428 - DNA, 658 bp, Diabrotica virgifera
tattaattgtagcataataatatagtgctcattaaaagaacacaaaaattaaattgtgtgacagcgatgtagtgttgcgagacaatatgaaagttttagaaaagagcaactatgcattcgcaccatgtggctcaccccttgtcatcttcccctcatacattgattatcatcgacgtgaaagaggctgaatgataggagatatattgactgaataattattagaagtagtcctattttggaagggaaagccactcatttatagagatctttgaactctctgatcactcaccatcatgtgtattacgtaaaaacatagttatctctacatatgttaatgtcatcgagattatccataacaacgcccagagctcatcactgaaattccactcagccccaaagatataaaagagattaggcccaaagcatggccgacaccagtcgctccccctcttggtatgtagtcagccaagtcgtcactaccttagacgcttctgatcgtgccactagtatagaattttgcccatgagtcgcggcgcccacatcgtaccgaactaatatggaagcgatctaccgcatgtcatccgcaacttagacactcccggacatgacttgcccgagtacctcaagaacatgcgtaatgaacgaggatacacattca

SEQ ID NO: 17429 - DNA, 592 bp, Diabrotica virgifera
  misc_feature (146)..(165): n is a, c, g, or t
  misc_feature (416)..(458): n is a, c, g, or t
agaaattgtattactggtaggtaaggagcgctcgtgggtcattgtcttattcttctacgagaaaagaatatgcattcgcatccttgcgggtcgcgacgatgaagtcataattatatagtaattatattcgagtataaaagtgctgnnnnnnnnnnnnnnnnnnnngtcgagaaaatgttttatagtatgtttttttgtgatgaaatgttattggggtttttatgtatgtcaatatttaaaagataaattatatatatttatcaacactatatttttaattggagatctttatatgataaccatataatatttttagcagggagctgagaaacattagtttatcagcatttattctttagataggaattatgagtgagaaaatatcttatttttacatatgttattatggatttttnnnnnnnnnnnnnnnnnnnnnnnnnnnnnnnnnnnnnnnnnnnataagattaagttacttaaatttagcaatgatggtaggattatattgaagaaattgtatatctagtcatgatatataggtgtaataacggaagtcgtaaacatttttttctcctgtctattaatgcatgtcttg

SEQ ID NO: 17430 - DNA, 824 bp, Diabrotica virgifera
  misc_feature (79)..(119): n is a, c, g, or t
  misc_feature (139)..(185): n is a, c, g, or t
  misc_feature (191)..(209): n is a, c, g, or t
  misc_feature (211)..(244): n is a, c, g, or t
  misc_feature (250)..(283): n is a, c, g, or t
  misc_feature (289)..(309): n is a, c, g, or t
  misc_feature (311)..(362): n is a, c, g, or t
  misc_feature (402)..(437): n is a, c, g, or t
  misc_feature (440)..(497): n is a, c, g, or t
  misc_feature (534)..(567): n is a, c, g, or t
  misc_feature (575)..(606): n is a, c, g, or t
  misc_feature (646)..(665): n is a, c, g, or t
  misc_feature (667)..(686): n is a, c, g, or t
  misc_feature (739)..(757): n is a, c, g, or t
atttattttcacataataaaatatttcccccgcataagccaagaacaattttatttcatgatagttaactagcattccnnnnnnnnnnnnnnnnnnnnnnnnnnnnnnnnnnnnnnnnngtacctccgtgtatcagccnnnnnnnnnnnnnnnnnnnnnnnnnnnnnnnnnnnnnnnnnnnnnnnctaacnnnnnnnnnnnnnnnnnnncnnnnnnnnnnnnnnnnnnnnnnnnnnnnnnnnnnccgccnnnnnnnnnnnnnnnnnnnnnnnnnnnnnnnnnntaaccnnnnnnnnnnnnnnnnnnnnncnnnnnnnnnnnnnnnnnnnnnnnnnnnnnnnnnnnnnnnnnnnnnnnnnnnnccttaacaataaaattttattaacatttaccttttacacnnnnnnnnnnnnnnnnnnnnnnnnnnnnnnnnnnnncgnnnnnnnnnnnnnnnnnnnnnnnnnnnnnnnnnnnnnnnnnnnnnnnnnnnnnnnnnncaaatgtaacttatttaactttagcaatgatgatccnnnnnnnnnnnnnnnnnnnnnnnnnnnnnnnnnncacatacnnnnnnnnnnnnnnnnnnnnnnnnnnnnnnnngcctgctccttagacacatgtctttttctatcacacatgnnnnnnnnnnnnnnnnnnnncnnnnnnnnnnnnnnnnnnnnctttgaccgcgctaagccaccataatcattcgcctttttaccgaaagctggcnnnnnnnnnnnnnnnnnnncaaaactgtcttcatgtaatttataaagaaccttatttctaagctagtaagcttgaactctcttcat

SEQ ID NO: 17431 - DNA, 577 bp, Diabrotica virgifera
  misc_feature (219)..(219): n is a, c, g, or t
tttcttctcggttggaacaaatatgaacaaaattcggtggtctcgggatctcccggtaggacaaggaaccaatctcaaaactcggttgggaaacaacccttcgtggccggaaacggtaatataacaacaaattctcaaggaatggaatgggaacatctctccggaattcggggtaattcctcggtggtaaaggaattttcatcccccaataccaacggnccaaagcccatattcattcggtattcgggctgggatggggaaccggtaagggtggaagagtaagggaaacttggaaccaattggccggtctaaagaatcaaccacttctgggtcacactgggttaacttcaaaacacaggttggcaggtctcttcctggacgggtaagcttaacggggctatgcgggagggtaaagaatgtgaaagccacggtggtgggatcttaaatggacgggcaaggcacttaacaaaccttgggaccataaaggacatcattcaccggctttggtggctttcttcaccaaacagggtactgggctggggtggtggccttcgggacccttcaatcaaaaatctgg

SEQ ID NO: 17432 - DNA, 1000 bp, Diabrotica virgifera
  misc_feature (606)..(624): n is a, c, g, or t
  misc_feature (631)..(650): n is a, c, g, or t
  misc_feature (671)..(717): n is a, c, g, or t
  misc_feature (719)..(740): n is a, c, g, or t
  misc_feature (762)..(781): n is a, c, g, or t
  misc_feature (793)..(816): n is a, c, g, or t
  misc_feature (825)..(885): n is a, c, g, or t
  misc_feature (898)..(898): n is a, c, g, or t
  misc_feature (908)..(909): n is a, c, g, or t
  misc_feature (921)..(963): n is a, c, g, or t
ctctacacggatagttaatctcagtatccggtcgagtgaatctctctcctctctctctaaaagaaaaaatctctctccctccgtacctccggtcgtatcagaggattctctcaattcaataatctctcatcactcactcactctcgaaatcttcaaaagtgctcataaaaatctcaaaatctctctctccggtaaatataaataactcccaaatcaattcctctcgtaatcggaaatcggttatctccgttttccaaataatcatctcaattctcctcaagaaatcaaattcaaattctacctatccaacaataatcacttaatcaattcaaatatcttctctcatctcaatctcaataattaaataatctttctcaagggatcggagctctaaataatcaaaattttcatctaaaaatttcaaattttctcaaatcaaataattcaaggattaaaataatttttcatctctttcaaaataacggttaataacttcactttctcacatcatctcataactttctctctttttcatcaaattttcttctctcaaaataatcaaatttcaaattaattttcaaaatttaagtaatggatggataatannnnnnnnnnnnnnnnnnnggtatannnnnnnnnnnnnnnnnnnncaggtttaaataaagggaatnnnnnnnnnnnnnnnnnnnnnnnnnnnnnnnnnnnnnnnnnnnnnnngnnnnnnnnnnnnnnnnnnnnnngccactggattaatttgaagannnnnnnnnnnnnnnnnnnngtaaggtagcannnnnnnnnnnnnnnnnnnnnnnngtggaatgnnnnnnnnnnnnnnnnnnnnnnnnnnnnnnnnnnnnnnnnnnnnnnnnnnnnnnnnnnnnngttaaaagcttanattcttttannagacgagaaacnnnnnnnnnnnnnnnnnnnnnnnnnnnnnnnnnnnnnnnnnnnccaattcattatatcataactcattttaatgggggtg

SEQ ID NO: 17433 - DNA, 561 bp, Diabrotica virgifera
  misc_feature (27)..(55): n is a, c, g, or t
  misc_feature (122)..(148): n is a, c, g, or t
  misc_feature (158)..(187): n is a, c, g, or t
  misc_feature (233)..(285): n is a, c, g, or t
  misc_feature (288)..(318): n is a, c, g, or t
  misc_feature (372)..(386): n is a, c, g, or t
  misc_feature (388)..(412): n is a, c, g, or t
  misc_feature (450)..(467): n is a, c, g, or t
  misc_feature (470)..(491): n is a, c, g, or t
aaaaaaatctaaaaattttctacatcnnnnnnnnnnnnnnnnnnnnnnnnnnnnnctttcttcggtaaatcggaaatcgtgtatttcggttttttaaaataatcattctaaatttttctatnnnnnnnnnnnnnnnnnnnnnnnnnnncactacaacnnnnnnnnnnnnnnnnnnnnnnnnnnnnnnataatctaattaaatatctaaaataatttctatgggatggtggctnnnnnnnnnnnnnnnnnnnnnnnnnnnnnnnnnnnnnnnnnnnnnnnnnnnnnggnnnnnnnnnnnnnnnnnnnnnnnnnnnnnnncggtaatctaacttaactctctcaacataattaactaactctctcaacttctcnnnnnnnnnnnnnnncnnnnnnnnnnnnnnnnnnnnnnnnncttaaaatcttaagtaaatggatggataaataattatnnnnnnnnnnnnnnnnnnatnnnnnnnnnnnnnnnnnnnnnngagtttaaataaaggaaatttcggcaacatttttctttcacctggtttattagaaaaacatcggtctttt
